United States Patent 10,113,201 (METHODS AND COMPOSITIONS FOR DIAGNOSIS OF GLIOBLASTOMA OR A SUBTYPE THEREOF) - sequence listing, part 5

SEQ ID NO: 50 - DNA, 169616 bp, Homo sapiens
gtgcttcggatggcggcgggaggttgatggcgagtggtgctgaagggacagctccagcagtggctgatttgggggagaaacaaaatctgcagatggaatccgagcagggcgacttcaccttcaagtggtgagctctcctgacctgcggccagtctccactccattcacggccagccgatctgcccgctcccggaggggtcgggcagtgccggctggacccgccccgagctccatggtttgcccaaccctgcgcgatggtgactctgggcgcggaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaaggtatctggaaatgggggcgggggtggtgaaaggggcgatttcctggaaagggcatgttgaccctgcaggccagcatccccccgctccgcctttccgcaataggaatgtagagatgaagccctggggagaggtggctgggaggctggaaacagggacactgtcagcgagactttcagctcagggacccagggggtgtgcctccaagcagcttttccccgagcctcgcccctcctagaaagcaaatcccccaccctccacccactaagggatttgtttttcttgggaagggggatgggtgggatgcattgatcacttctattcttaaagatggatcttagttagttgtttcctttcccaagtaataataatatcaacaacaataataataataacgtgaaaaggaaatcgaatgaggaaataagtcagaggtctcctaggtgaaaagcaacagcagagattttttttttctctgacttctgtgttgtctttttgcttggtctgtgagcaggtgtagaggtgatcctagaacaggttgctcagaaggcactccctgagcgctagggagtagagaggggtccggggttgacctagggtgggtgtggaatccgggctcttcacagggtggggggagggtgtgctctcacccaacactgccaagttgcctgaggaaaactccctgcctaagagaattgcatccaagctaggggaaggggagaaagaggagggtcttggagagtgggaatgagaggccaaccaggggaggaggagagaatggggcaaaggagggggagaaagtaggtttagagggagagagagtgtgtttggggaggcagagagggggttaggggctgggagcaggttggacttgagtgggaacagaaaagaggaagagtggaaggtgaaaagatgaaggtgaagagatcagagccaaaagaaaggaaagcgggaggcagggaaaacggtgtcatgaaaggtcaagaaagactaggactgctatctctgtagttctctggaaacctgggaaaggtttgatgcaagaggcggggacagcgctggacgctgatcccctcccggggagggtctttgccccgtgcctgtctgccaactctgcatccctggactcgctctgggttggtggtgggggtcatggtgtgtctttgacggctaagatctttaactcggcgctgtgtttgcctccccctagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccagggtaaggccagaatcgaccccttccctgctgcttcaacttctcccaactccctccccaactttctgttcttttccaccccagggcctcaggcatggggggtagaagagacccgggatttcctagcgatacagttagaggctcatcctttgcagggtaaacccagggaccccggccaccatccctacccagtcccatctttctcctcctcctcttctcccaactcaaacagatttgctttagcagatgggacctagagggccaatgtcgacttttctgtgcacgtctttggaccctgtcctgaaacgggtatgaggattcatctcgagtttctccctcactcctttgttctaacttttcctttagctcagatctctcttctggcctcctggtcatccctatttgacattttcagtgaggcccccttcacatctgactcacccagagccgtggctccaattgggggttgaatctgaggacagaggaaggggaaatggaatgtatctatgtgtctggggaggtggagggaggaaaggtttgcctggaggtttatgttgtgaagagaatctccagaacgttgtttgggcctgtcactttccaagggagacgaatactaggattgtttccgtgagttgaccagagagcccacttacacacagaattttgagcctcgtcccttttgcttagggctgtatctctgatccttacaggttgaacatacattaaccactttggtgatcctagttctctaaatctgagtaatttagattggagcaaactttattttacttttaatattgtgatttcagcctcagtgttctttttcgggttctagtttaaatgacagctcaactttaatccttgacattcccaattaattcttcaaaatctcatgaagagattataaaagtaaccaataatgatttctctggttgaaaggaaataaagacatataaataaccaaaaattatacagtatgtgaatggtttttaattatatatgagaacaaagtactgtattcagttaaatctttgcaactgcatgtgtctggtttgcttccgacacccagaaaagacaccccatgggcagaatgggaattctcccaactttactttggctctatcttcattattttcttcctctgtatgtcagaagtgtctgcatctgagacgttatgcagctatctactaatttgtcagaagatgtgctactgataacactttggaagtctgtggacgtgttttgttttcagtgtgaaatagaatatgaaagagacaatttaaagcattgctactcctttagacttggtatttaaatgcatacataaattctaacatgcctgcatacacatatttgaacatagaattagtagcttcaacttggaaatctttttttttttttttcaggccatgccataaattcaacaacagagttggcattcaggaaaaaaaaaaaaaaaacccaaaccaaccaaacaaaaccgcaagtgcatattcatttaaattaaaccacaggctcatgaccattacatctgtgcatctgtgttttttggattccagctgagtgttatggagctctttccacttggtggctaaaaagataatctgaatttgttttcaggcccatcatgtgattctttttttccagatcatgtgctacaaaaggacataatgttttactatttttccttatgataacataatacatcttattgtaggccagattgcatagcaaaaactttaagaaggtgttcaacttttatcattgccatgaaatttgattctatagtttattgatcaaaaggataaaccattgacttgaaaattgtgtttaaaaagcatttactacgatatttctttataatactcttgagactttgatctgcatctgttttggtgagaaaagaatacaccaaaattgagattaaaacaaggtcaaagagcaagtagaagcagaatcagctaagaatcatagacctgaaaaatttatttgaggtcacgtttagtcaagaccctttatactgtagatgagggaaatgaagactgcagatgctaagtgatggccaaggttatacatcaagttaatagcaaagccaaagttatcccagaggtctcatgacactctcctcaggccctttctagcaaaactactgattataactggactggattgtgaaatctctgcagatcacattggtcttgagatttaatgcggcataagacattcactagggtcctaactgtgaaaggtcatctatgacttttaaaatatatgtattccaggactttcgctcctggaatttttaccctttaccacccaacagtagaataaaaatatgggacttgaattaacttcttaaaaagaatcctgtttgaactttccatttttattgaccagtcagggtttaatatttggctttcttttgtgggtcttgtcttcagggaaatcccttttcaaattcctaggggttggctgaaaaaaagtaatcataagtcaccattctatttaaaagtgacttaatatttttacctgagcacttttagttaagatgataacctgacaacgttatctgactagtttgaaaaatagaatcatatgtggaggccacaagttgaaattatattttgcatcgacacaattcgaggaaacataaaacatttatcaagtggtttgcttcagttcttattatcatgagtctcattcttaatagaagtatttaaacttttataaacactcttattttttaacattagctcatctttcattgaaatatttgacacaaaaaattttaactctctaaatttcccttttcaactcattatacctgtttcacaattttcttttttctccaatattgaaaggattggatcagttatataatagatgtgctttgtttgtaatttttgtgatttaaatggcagacaaaacaacggtgataggaactgaataattaattgaattttgcaaccctgcatttttgccttttgttttggttggcatgtccctctcctctgtgatttttaatttatgaagtaaatacgtatatgaggggtctatattgttgtatttcaattggtaaataagtgtatattttatacatttaaattcttattcttaagaatagtattcaaaaatagaaatttataaaaattcaaatataagttgtcatggaaacctgttgtggagaaaacgagatcaggaaaaaaatgagagtttattttgttgatgctagtgagtgatatttacaaacagtaaaaaacaaggatgcataaatatatttgtaaaaatgtgatgcactgtatattttcaatttaatgtgtaagtgttagaaaaacatgaagcttgtatgtgctttcctttgaagaatgtatcatatataagaggacaggtaccaagcagaaattccttgatagagtttctagatttttagaagtttttaaaaatcacataaggacaaaatactaaaataaaagacaattttgaagaatctgtttggaatattaaacagctgagagcagttataagtttctctttctcttcttttcacttatattttttatagggtaggggagatgattgaattcagctctgttttagaatgttggctcttccttggtgatttatgcatatctttgattacttggcagatcttctgttttttacttttaaagcacattttagaaaagaaaaaacaaaataataactgccatggaaccccacttaagatgttgcctttttgatgtgtttctagctctttcacatacattcccctgacctttatctcatttactgttgttgaaatacaatatgggttgtatctcatatacgatccttctgcatcatacagggattgtgatagcgaatctatcattttttaaatcttgaaaatattcatattattagcattatagattacttctacagcattaccaaaacgtactccgtagaagccattaaaatggaaattttaatttctagcattagactcaaatttgcaaatatttaatttactttgtatgggccactttttcctcttcgccaagccacaaaacaaaacaagaaagacatgatctaaataaacatttgctagtattaaatgtagcacttgatttttaaaaattataataaggtataggaacaatttgaatcatatattaagattaaaggaagaaaatgtattaagtcttgttttgtaagagtggttctaattaaaagaattaatggctaaatatagcttattcataaaatattgttgtcaattattaaaattttagaaagcacatttattcaatgaatattgattacacagtcactgtagactgaaaactatgaaaagtactgggaatgcatggagaagatataatcctttgccttcaatgagctcacctctctatttgtaataaaacgtttcctaaaggcattatctattaaattaaaaaaaaacaagattatggcaaataaaattctagaggtgttaaaaatacattttcctaaaaaaaaaaaactcacataggaatattgcctgacacatgcagtaaaatattccttttagaaatgatgatgttaaggtattattggtctttattttattacaaaatattaggctcttaaattctttatttttctgttttcacaatgacttacaggctctctccttacaatataatgaagactgtacttataccaaacaacaattgagctatttggaggtgtggccaagtttctttcattatttctatttaattaaaagtcatggccaacatcatgacaatgcatacccaaacttcatattcctcaaaagagtctgctataatagtccagtgtgtttgcactttccacctaagcattgaagtgtcttttgaccttttcagggtcaaaaggcttataaataaatttaattttatgcttatagtctaagcattggatagaatcagagagtacctgattaatagatcactaaaataatcaagtaaatttaattgccaactaaatatacatacaagtgatatacatatgaggtggcctgatttatggttggacattaggtgtgcaaaaagtgaatatagttggatagattaggtatgatctcttctgtaatattttgctaagagctcacttgtagacctgagttgacaaaattaaataaaagacaaggaaagttttttatctttgtcagtaaactcattttcaaagcaactgaaaaggaaggtatagatcaacctttttgtagattttgcatttgaaaatgtttatcattgccatcaatttttactatgacaaataaagtaaatgtcattttcaagtattgtattctttgaacttctgagccatgtattctttttattgtgggaacctttagaaatgtgtctaaataaaatagtaaagggcattaaagataaacacagacctgtagaagaaaatatatagtggaaaaatagtctaaaaaataaccttcaatatattccataaacttaattcaattctggttgaaatatgaagggcttttcttcgagaagagcagtcaaaatattcttttaagacagaaaagcactgcttttttgccttccgtgcaggttgagggatggtaataatcctaacacggtgtagtcaatattttcatagaaagtgaatagaatgtgagtgttgggaggagaacagagcaggactggatattatgtggaaaaagaattgaaaaatgcctgaattgagacctaagagacctacgctccagtcttgatttcaacactagttgtgtgaacttggagaatttacttcatcttcctaaatcttgatttcctttgctttattctgaaaaataaaacccaaacattgagatgacacattggactagatagtatctaaacttcagctctaaaattttgagatttgtaggataattattgctaaagattctgggggagagaggaagggacgacatgttcatgcccattcagattgcactccaaggaccatcacactaataaagtaaaccagaatctggttttttttttttttttttttttttttttttttttttccaatttcgtttgtaactttctgcccttttttttccctacagctgttgggtagctactgctgtggttaccatagaaacaggttagctcccagcttcctgtttccattgaaaacagctttctctcaaccacatattgatctcaggaaatcattttgctgtggctctgtcatgaaacccatgaagatgttcagctctgtcatttcttaggtctaagattcagtgcaggtgtatatccaaccacctgcaagggtaaccgattagataatctcagtcgcattttcacttgaaaagtatcttatcaacaacaccatgtttttccccttttcatattttatataaaagggacagtcttattctcttgaggacttacactatgcctaacatatttaagtgtttacaaaatagtgtcaaattattcaattctaatctcttccataacccattctattagaataaacgtagaaaatagtgtgctgtctagcacacttcataagttaaaattatattttgttcataatgttcattaagatatattttaatgtgctcactagtgaagattattttaaaatgaatgtgtatgtatagtgtatagtgctccatatttctgtttttagaaaatcatttttctatttttagggtatatgtatatacataaaaagaatatatattcaaatatatattcactgttgtaatacagacacatactcagggaacatgtttgtaaaatttgtatgtgggtaagagatagaatagatttgtgggaatatggctttaagttttgtttgagaagtgcgtgtgtgcatgttattatatgtgtccaaaatatatattatattagtgaaattggtgaagaaatatgtgatagacttctggtgtttatgctgattagaactggaagaaaattggcaatcatctggcacaactgcctcaattcacagagaagacaactgacatgtttcagccatgataagttaacgacaatggcagggctagtatttagatcttgtgacttctgattaagtgttcattctgttcaattttgattgcttagtttatactgtgtttaacactaaatgcacaaattttagctgtcgggaagcagcaagactgttaggaaggataggctctgatcccttccatgtcttattgttcaacaatatcagaaatatgtcattattttagggatttgccttattttcaagattcccttccagttgcagtcttccattgctaccttccccactagttttacatgttattgtcttcctaaaaagccttaaaaatagcctgcttatgcacttaaccactttttttcccttcagcttgtaacacctatgagaagacctgcaggagcttacctcccaagctgagccagaagatatttagataattaagaaatgatacctatttttcctttggcccttttgtgtataagtcttttataatacgtttttctacttttgtttgatttatttatttttaatgcaacactggttcaacctattggcaatagaacatcatcttctcaaatgtaaataaccaggtcatggtgggttttcccagggatgactggtgaattgaagagaaaagcatttagagctattggagatctgcaaacaaagttaaatgttgttgtaaggtcagtaaatacaatacagaaaaaacaatttccctgaatattctttaatgaacagtaagccaaagatgatgtgatgggaatgtaaagcagtgttgtaatttgggagtgtcctagaaaatacattttatagaaatcaaagcagaagaacttggggcaaaatgttatgggtaatgttgggcaaaaatactccatgattactgcaattacttgactggtcttctttcctgaaagttgatcatgataccaacatcttgctaaactgacatttcctcattgttttatgtgtccagaaaatctcatgcagacacttcagtagtgtctccttcattctttgtttgaagcccctggttggtgtgctatcaaatcttagaggtttgccattcttcaacaatatctgactgtgctgtagacatctttaaaaattggagcaaaggccaagatagtctttcttgacagttttttctgtaatttagtcttagcagtaaaaggtgttttcctttgagttgtctctatgatgagagacctagaaagaaaaagtaatcaacttttggttgcataaattctcttattttacaccaatattttatccaggattttaaaattgtttagtaaataataaaatgcaaagacatcttttataaaatgtcgtgatttaaataatattgcccatatattcaaataatattaattgactctaaatatatattacatgtttataaattatgtttaagcaaaaactatttggaccaatataaatttttttgagttttttgtcattttgtgctccatgagaaggccagacattattcagaatttatgtaaaatttgtgtctatgcttgcaaattatagaatagaaattcagatatggggttcttgattttggtacttttaagtttattgacttaggattaaatgctatttgctaaaagtgaatattgtataataattgtaccggaaatgatggcataataatcattgcagtaacaaacttccttaccgatgttgatgtattaatttttagataaaagtagtaaaattggtatttaggaaaatataacaatagttattacagtttgacttatcatttaagttgttctgcttctctcttttaggcttcttgtaggagcaatgagaggaatattatgaaagttactagaattctcttaatgcaaccaagtagactgagtaggaaatgggcagaatagaaccttaactgacttttctctgtacaaacagaatcgaaaatagcagttatctttaattttttaaatatattataactttataattaggcctgagtgaacctatcaccatcatctaaaataattagtggatgcgtcaaagttgagcaactttcatatttgtatcatttgtgtatgctgtatgcttatgcttaattcccaggcacataatgttgactgtaatttgatacttagaatgcaatgctagaaatatagaatttaagcaaactaataagatcaaacatattttaatgtattattaggctttagtgacattaaaaaatgattagacttgatgcaaaagcaggattgtctttaattaattgcctcatgttttctataaatttactgtttaattcttaattgtagtatgtacttgctatcagttgcaagatttttttaatttagtgagtgttttaaaaaatctgattctttttcaatttttttcatcattgattcaattcatcgctgatttatctatcttaggtgatttcttagtaatgtttgttttttagatgtaagtgcagttgtcagagtacttgactttgtacttcaacgctgggtttctttatcactatagtcttttgtgtttcctctactttgtccacactgattggatgataaagtagcatgttgttgtcaggatttgtacattctcctttaactaaacaaactgggaaagaaaaaaagcatcagagtttctaatgcttttgaatctgttagttgacaactattgaatttcaactgttggccagaactaggttatgttctaagaatgcaaaatggattaaaatttagcacttgccttcgcaacacttgtattcagtaggaaaagaagaactataaattcacagttatagtgcactaagtgatatagtagagacattgatatagtgtagacccacaggttaaggaggaaacaaagatgacattttggttaactcccagaagataagtaggcattttccaaaaatcaaggggaaggtcagtggagtagtgagcaaacatgaaggcttaacggggaatatcatgtcatgtaacattgaataataaaaagatctgaaggcatgaaacatggcaaagacagaataacaggcttgagagaacagggagggtggaaattgggaaggaggggaccactgggcttatatgtaagatatcctgcttagatgtaagactctcagtccaggacagcaatggacactgttttatcagtttacttaaaatttgcagttcacaaatttgaatgtgcctatgaatcacctaagatgttgactaaaattgtgcaactcaggtctcaccccagagatcctcattcagtgggatttgggtatgattcatatcaggtgaatgcactttgagcacagttggctacttgctcactatgtgccagtattgtgctacaactgcagaaaaaacaaatacaattcaacaatgaattaagagacaaatcaagcttagaccagtattagaactggttacctgtagttcagcaggatgttaacaggtgttttctctcaaaatactttcatggatggaagaatttggaaaaaagttaaaaataaagttatatagttgttttttaattgcatgtcttcttagtcaaggagttaagtaactaactggctgacttctgatagttgattttgagatggaagctaattagtgtattagtgttaaggacttgactgaatacgctaaatatgaattctgactcaacaacttgcttgctgtcttttcttcagggaattctctaagcctccttttttctcatctggaccagggagaaaataatagtgtctgactcagtagagtgctacgaggaaagactgagcacatttatgttaagaatccagacctggttctagaaatgtcatttgtattattattactcttaacattatcattgctattattccttgaggcaagcattgctcatttctggaggtgaggcgtttatagtagcctactttaagaagcctttctggtgtttagaatgttcatgaagaaataagttgtctctccctgagattttctgtgtggattctaaatgactgtctgggcagttgtagaagtaattatttcatttatgattaaatggtaattaattaaaataatatccaatatacatactataaatcaggcatattgcaagcggcaaggtgaaggcatattcccagcctttaacacacttgtagtctattgtaagaaaacaaccaaaggatgatgatagtgcaatgtcataatatctgcagtagaagtgagcacagggtgatttggaggttaacacagctttgctagcattggaaaaatgttccagtctttgttggtaccacaggatgaagaggagatagatttttcagacagtgggaagagcctaaatagtttcaacaggaaaggaaggcatggactgtttgtcctgtttgaggtactgtgaataattaaataccactggagcattgagcaaagggtggggaggtacaccaggagacagtccctgaggttggctgggaatgcttgacaagttctcttgagaagttctggtctttctctgctggtaatggagagattttgaaggattttaagagcagcggcaaacaaatttgtaatcggcaatatcattctgaaacctttgtagctgaagaggggattgggttggagagggtgagtgtaagtttttcaagagggccacagtttagtgtgttattgaagtaacacaggtggtaggagacaacattgaaccttgaaataagacagcagcaagaggaatgaagtaaaatggtaaagtggacacagttgaagaggagttttgactaattaggtaggagtgaatgaggcaacaagaaaagtcaagaatgttcccttagtttctctttgtgttatgggacaagagaaactttatgacttctttctcattcaagattcaatggttactatttgggtatctggctcatgagtagttagttattcttttacaagatttaacactataatatttggtattatattttgtgatttttttcttttatatttctgtataaactacctaattatagaaggctacttcataggttttatggttatgaaattagatgctgagtatgccagttaagatttttggttaatgtaattcacccaccaccataacaagttagtgagataagcaatcctctgtacaagaaatacaggctttatattgctactactttatttaaagcccaagaaaataatattagtttttgcacagtttctatgaaacagaactgcctgtcccatgtagaaatccatgtggattccaaagctagaaatttgaattgaactaggattaaatgaaaatgataatgtgattctgaagttcaaaatactctttggaaaattgctttacataaaactcactgtagaaaagtagaagaaagagcaaaggtagtgaggaagaaaaataaaaatgaaagcaggtattaaactgggaagatggtgacttcagaaacaaggcagtcattccttccaagacacatatataccacaccattttcttgttttaaaagaactttatctgttttccttgactacatactaagattccatagaatggttcttcagaatcttgttactacctatgctcctagtcattttccttacaactccactgccaaaagcatagtcatgttcaaaccacagtttttgcccttcctggatataagacatgtattctctagttatcaaatatttttaaacacctcttccaaagcagttaatttctctctctgagtttccacgtcactttatagacattgtattatagcacttaactaaactgtattaatttcctaaggcttccataacaaatcaccacaaccaaatgacttcaaaggggtgacttaagacaacagacacctatcgtcttacagttttggaggctagaagctagtttggcaggcttggtttcttctactggttctaaaagataatctgtttcatgactcagtgctagcttctggtggttgcaattcttggagtttctttgtgtttcttggctgtagatgcatctccatcttcacatgatgatccccttcccctggcctcgccttgccctcagtgtatgggtctctgttttctcttcttatcaggacaatagtcaattggattatggcccactctagcccagcatggctccattttgatttaactaattgttaaattagctaaaatttaattctgaggtttggggtagacatgaattttgagggacactattgaacccagtaccctaatttttccattttgacaacacatttgcaatattcagggaatctttcttattttctggttactcttttttttcatatctgcgtgttgtatcttaatgactataatgtctttgtgaatctttctgaagatactaattggaaaattctttaaattctattttatttctggcattaactctagtccctctatggaatttctttttcatttgctcgtcttggttgttgcattttatactattgaatctcttcagatatcttttactctgaaagagagttgggtgaatatagtgtgttgtgggtaggttggcaggattgtgcagaacacaggattcccttcagggtgggtggataggagcaggccggcaaattggggtattgtggaggtctaaaaaagtaagttttatttggagatagaactttagagcatttcaatcaatatggggttacctttcctttttctttttctccatgcactttgaggaaatatgaaggtaccttagattttgctccacttttctttatcacaccaacatacctaatttagaactgtcttctcttctgttgattccctactctatttatagagctgttcttgctagctatattctaagggcaaattctatagccagacactgaaagaaattccagaccttctgagcagttgtcccatagccagctccctctcctagtacatgttgcctctgaatttgaggctcctccggatttccttgggaagaaaaggaccaaccccttttctttacctatattgaattacattactccacttccaacctatgtattcattattttcatcctatttgctttatatctcagtattctagtccaataataataacttttcctgtttttcatccctgtgattatttttcaccattttaaataaaatttggataagaagataagtttactatcttcaactacagttggactatatgtgtataggcttcttgttcatactagttataaacttgtgtataggaacactattttgttgtcgttgttgttgtttttacccagagttatgaacagtgtctggttattttctcactaggttttaaaaaaattgtagatatttatagggtacaatgtgatattttgatatatatttacaatgtaaaataactaaatctggctaatgaataaatttctcacctcacatactttttttgtggtgaaaatgcttaaaatatactcttttagcaatttcaaaatatataatgcattattatttattatggtcaccattttgtgcgatagattactaaagcttaggtttttatcaccatctgaataattctgtgattttccttgcctacaatgatgtatttctctatgattcttccccacaaaggcaatgtttcttcttcttttctttgagctcaccttcttttcccactttttaatttattctgatccccaaatacatacacaatcctactgagaaaattagaagcctagccataatgtgtgattttctcattgccataagaagctttttagactaacagtaaatgaaaaattcttgaaaaggatcactcggacgacggtgacacttaatttattatctacccactgagaatacatttgtaagaaccatgcactttgatggcttaacaaatgtctctgagtctccatagaaagtacaccattaagttggaacaatatttacatattagtgtactttaagtttttacacagaaacatcgccggtgggaccaaatgctaagtccccattatgtagagaagcttctaactaacaataatagatggcactgattgtcctgctaattacagggaaacgaggccttcatggaaggatgccgtgtcctaggaaaagatgctgaagaatggatgttgcggcagcaaggaaattagacaaggagcgcaggaaaaagaaagaatccctatttatcgcactgttgttactttgtttcatttaataaattagaaatatccaaaggtgaatttttccacattctatctagaatatgcttcatcaaacaaatgctgtaaagactattacatgtaaaactgaattatgcccagatagtccatctgagctgtggcaaatagcaggactgagaaaggtgtttaaagaagcataggtacattatagcggtcatgtaaatagaatgaaaaaagtcttcatttataatattatagagattaggtaaaactgtattgttttaggaaaaaccattgtaagatagtagatgaaataaatttataaaatagattataataggccgggcgcggtggctcacgcctgtaatcccagcactttgggaggccgaggcgggtggatcatgaggtcaggagatcgagaccatcctggctaacaaggtgaaacccgtctctactaaaaatacaaaaaattagccgggcgcggtgccgggcgcctgtagtcccagctactcgggaggctgaggcaggagaatggcgtgaacccgggaagcggagcttgcagtgagccgagattgcgccactgcagtccgcagtccagcctgggcgacagagcgagactccgtctccaaaaaaaaaaaaaaaaaaaaaaaaaaaaaaaaataataataataataataataataatattcagaacaaagtattagaatgaatttgtggttttaagatgaggtgtctttatagttaaattatttatttttaaaacaaaaagttttcttaaatcataaatttaaatatttttacaatggaaaattcagaaaatattgaatagcctgaggaagaaaatggtctttttttccccaaagactattaaaaatttagtttagttaattcattttctctaagataattatatccatgagggcatacgtaggattttttttaaatttaaccttcacaggcaagaacatagtaccttttcatttgtttaaatctggttttagatctcaaaaagtaattttatagcttactttatataggtcctacatgttcattttaaatgttattcctaaatattctatgcctggttgttattgtgaatggtgtcttgcagtccattacactttaattagtcattgatggcatatgagtaagctactacttttagtacattaatcataggtatagttatcttactgaattcttattgattgaaatattatttaaacttattgtcttagtttatttgtggatatgccatatataaatgataattcagtttataatttataatagttattaatagtctatatcttgtatcttttaatttatactatatacatataatttgtaattacttttgtggtcataattttcagtcatatttatacctgtttaattgctactactgcttttctgaaattattttctctggagtcaatttggaaacatctctttgtaatatgctatatattttccaatttctttatggaactaagaaatagcttgaatataatatatttttgtgtgtcttcatatatccgaggatatctttctgttgtattcacataagaaagttatcttagcttagtacacaagtttttgatgtgcaattttgtttattaaaacctgctatctaacatttagaaataataaagtgtaggcaaacaaagaggatagaaacatttctatgctgtgagcacagacaagaccccaaaacaaaatcttggatctggaaaggccccaaggaaagcataacctttgattgttagcatcacctcctgaactatcacaacactgaaatataaaggaacagaacttagccaaaggagataaggggtgtttaagaaatagaaattagtgggatagaggtcttagagatgagagcaaagaaaattaaaggaactgaaagaagataggcatgaccagaggtagagggctactgggagctattgaaagagggcctagagaggtagttatgggacaatcaaaggatatgaccctacaacatagtagttgtataaccatggataatttaagtttctttttcaatttcataataaaacctcctcataaatgggtattatgaggattagatgagataacatatttaatgtgcatagcagactgcctgacataaagtgaacattctataaatcatagctattactatatcaagcttaatggtaggctaatgttcaaaatctttagtctaataaccggtggtatttatcaagtgatttttgtattggcgagaggtggggacagaagagtctctttttcatcgactcataggtagaaaatccacgaggttacagaagacagttttgaagataattgtcttttttgccaataagttgcagagcgcagctgacaaccctctattgctgctttgactgtaattgcattagatatgaaccctgtgtagaatgaagatagacaacattcctgataccattgcctaacttcactctgaatgcggtgtagggaatgaaagatcaagtggtacagaggagacaaataatgaattactgaagcctggcacaggtttaatgaattctggtgcctagcacaggtttaattactgatgcctagcacaagtttaattaattactgatgcctagcacaggttggtacacagtaggtacttacagaagtgttttcctaacagactggtggattgactgctttttaggtggaaaagtacacttttcagtaagctagaccccaaaggcttctactgcttcaacttacaaatgcatctccaagggaagcaactgtaatcccctttcttccctcagttctgtgactccttgaaatggttgtcagatgataaggaacaatgcacaggagtaccccttgtcctctgttacaccgctggttgtagagaacgtgaccatggtggtaactttcttcacctcctgaactatcaaaacactaatgactgaaaaacaatattgttggagaagtagggttcatccctcttacaaagtagctcccagtcttcaaaacattatgggtggactgattcttggctaatgttatttccctagtcagagacaatgcctgcaccaactaactttcaagctgaagggagttttaaaatttcactagtcctgtcaatattcactattttcatttcaagagcttgagcacaatttactatgatcatcaactcttaactattctcaacagttattttgactaatacaaacccttctggattttgccatgtagtttattgttgtactgagtttcctgggctattatagtgtgtcaccttgttatttatttatttatttatttatttatttatttatttatttattgagatggagtctcactctgtcaccaggctgcagtgagtgcagtggcatgatctcggttcactgcatcctccaactccgggttcaagtgattctcctgcctcagcctcccgagtagctgggattacaggcacgcaccaccatgcccagctaattttttgtatttttagtagagacaggatttcacatgttgaccaggctggtcttgatctcctgacctcgtgatccacccgcctcagcctcccgaagtgctgggattacaggtgtaagccaccgcgcccggccaccttgttatttttttatggatgtactgccagataaagtatgataccagattaactttcaatttcagatatatagtaaataaatatttttaatctaagaatctatactaaattgtggttcacatttatgctaaaaattgttccttatctgaaattcccaatgttaaataaggatcttatatttttatttgctaaatccaacaacactacattgtgttttaaagtgaattcggaaagaagctttggtggttttacattgcagtctttctcactgttttagcattagtcctatacacaaaattttccaactatatgtatttatggtgctgtagagagtctactgtaactctaattctaatttttgaaacagttagtgctcaaataaagatcgataactcctctggccatccagtagcacactgacagaacaaaacagacatggctgggtccttgccagaggtgatttctgtggtcctagggctaagaaagggtgaaatttcatggcattttcatcaaaacgttattggaccaacatacttcaaattaccttctatttctatttttactgttgcttatacaacttctattgtttgcatgttgatagtctgttcctagtatattttaatgaaacaaggtatgactatgacaaaaagagggcttttaattattactaaataattatacacaaaggcaatactctgaggaaaactcagtaactacttatgtgctgtatagaaatccatctttttgttacaggtgtatttttaaatacatgtgtatatgcattcttctggcaatttgggttctcataattttcatttatagtcgtcgggttattatatttatggtgtgacttgtgatattttcagacaggcaatagtaaatgggcaattaaacttaaataacagtctgctccataatgtattccaagtaaggttgcttctggccaccacatttaactgggtcctacaatcactctctttggccttcgctatatctcttctgcaaataattctcctccctagcagtgccagcctgcgctactgtaagctccgcataattcagtaagtgaggaacaagcagtcgaaggaagatatgtgagaatattgggacaaagaaaaaggttggaacaaaagagcatatcctataactgtaattcaatgagactgattttccagtgtttggtaaattgtcatttgaagtaagttccaacagaggacttccaaacatattttaaataatggcaatatcatattaaggttgtactctcctagagcagaaatgtgttcttcggtacacaattcctttgagatattgctcataaaaaataaattgcatttgggtactgagtcacacacactacctccacttgtaaatttacaatgcacattgtgtattaaagcctcttacaagtttcatttaaaacaaaaagggaaagtgcttatcttccaaatttgtcagttttctgaaaacatccagtttcatggaatacctttggtaaagtactgttcttagggcatcttttttaaaaaaaggaagaggtcatttaattgtttatctgaatttggtatgtgtatttttaaagtcatcactttagagtaatatatcacagtgtgttaagatggctaataaaaagaaaattatacttggatttacttttccatgtaaaactgaaggactgagatgtaagataccaatttggtgaaataaggatttagctcaacattgtatgtttttgagcttggccattatttaagacaacatttgagagttttgattacttgacatcctaatgtgctaaggtatcaacaactaaaaaataaagtatcatgaaaataagaatctcttcatgaaagttaatggcagtttttctttcaatcaaggggaagtctgctgaaatgctgttgtctttgtaattggcaaaattgtttctcaatataataatcttactttcaggaaataaaagaaagtttattaaatatgaggaaagtaattgttgcataaaagtgtcccttgaataattgtttcatagtagtgaacattttataataataacctttttttacaacagaaggagatgggttgtacgtaaactataacaatccacatgatagaatattctattctgaaaaatatttatgaaaagagtattagtaacatggaaaaatgcatattctaaaatcttatcatagaaataaatagaaatttgttcctgttagagggcaacactgggaatgccttgagtttgtgcatgctccatgaatcgattgttttgattggagtggtgtgcagaggcacaagatgcatggaagggagagccctgtgtatttcttcaaaatgcaccagatgtttcaagaactccaagaaggcgcctcagagaagccagaaaaaaatttcccaaggtatatgatttgtagactcttttgtattatgtaactgcgctagaattatacctctattttctttatttaattacaataaaatttttatttatttatttatttatttatttatttatttatttatttatttttgagacagagtttcactcttgtcacccaggctggagtgcaatggcacagtcttggctcactgcaacctccaccttctgggttcaagtgagtctcttgtctcagcctcccaagtagctggtattacaggcacctgccaccatgaccggctaatttttgtatttttagtacagacagagtttcaccatgttgaccaggctagtcttgaactcctgacctcaggtgatccacctgcctcagccaccccaaatcctgggattacaggagtgagccaccacagccagcctacaataaaatttataattaaattaacacatacaagaaattatgatagtacatttatttagtagacttgaaattttgtatgccttagttttgtgttgctatagcagaatatcacagactgggtaatttgtagagaacaaaatttttttggattatggttctggaggctgagaagtccaagatcatggtgccagcatctagtgtgggccttcttattgtgtcatcccataacataagggaaaagagaaggaagaggataagaaacagagagtgggcaaaactcaatatttaataaggaaactgctcctgcaataatagcattaatctattcatgcaggtcatgcgcccatgacccaaacacttcctatgaggctccacctcccaataccattgcatggggaatcaagtttccaacacatgaactttgaggggcactttcaaaccatagcattgtagcattttgttttccaaaatacagagaaattgaataataactgaaacttatcaatcacataaccttagtagcctgcgttatcactgttatagcccaaagatgttcataattccatactctactacctaattaaatatagtatgttactatttctattaagaattgcaagttaagttctttttaaactcttgcttttactttcttctatgagaaaatacaacatatctgaaatcatttcaggtataaagtctactatcattttaaatttcattctgcgttttcttccggctttatgcttctgctcccttcagatagagcctgcattcatgtgtccacaaatgaatacttacatacttaaaatctcttatgaagatatcaactgtcacaatcatgcttatccctggttctgaatagtgaggagtaggcaagtaaccaccataattatttaatctttgttctatctctgtggattcacagatcatttcacaagcaggcacttaagtacataagtggctcttcagtcaatgcatcatacagaactggatgaatattttgcatataatctttcccaggtgctatgagataattaaaagagaacactgtgcttggtgaaccctacctttccttaattcagaaaagaaataaatgtgtggcagcattttttttatcaagcaacataaggtagtaaaaagaaaaagtacctgggggaaattagatctgagcacataccagctctgtcaattaagttaatgacttccaggaagttctccctttccttgctgaaaagggagatgtagtaaggtttaaatgaaaaaaatatataaatcaacttcacacagaaggcatagaagaacataaaccagtggttgatgttatcattagtgattaaattcagtgtattagcttaagtttacttatctagccaacccacatctatggagactctgaactagatgattaacctgggaaaaatatgcatatgctcttaaatagtataaaaaatattcagagcctgtaaaagcctatgtaattgtcaaaattaatttgttctttgagtttctacaaaacggaagactctgtgttagttaatgacgccacacagagactacacgagtcttataaaacttgcatctagaaaagctgagctaagcattactatcaaatataagtgttataataggcagtctacaggagacatggaaagagaatctaatcaagcggaggagatggagaagtgaagtttatagagattcttgaagaaacagtagggaataggatggagaagtgggtgggggtgagaatgtttgtgagctgtgagatgaagggcatcaagtgggccagtggtatgatactccttgggaaatatataaagttgagtaatgctggaactccaagaatctgagaggtggaatggaaagagaagtggcaagttggcaaaggcagatggagattgtggaggacccggtgagccacattgaggaatttgggcttatcctaagagcgatattctaagacatgaacattcttcaattttattttcatattctagggtaaaacagatttttattgttaaagatgtgggaccatttcagaggaaacttgctccatatttttatgtcctttttattgcaagaagacagaggtatcattcagttggacttgaaacgagtcataatgattatgttaaaatttttaacatatgtggataatatttcaaagatgcataagatcttacaaaaattttgaatgtaaagtttgctttcatttccagggtattgtcattcccaggactttctgggtactggttatttgactcctgaatatggttgataattttgtttcattaggcacaatattttttgttttgttgttgttgtgcttgtacattgaaaagcaagtttaatgtttttattatggtggtgatcttctataatagactacaatttgttttagaaaggatcctggttgtagaagcacgtcttcgcttagcacaaaggattggtcaaatttcaggtttgagctttctgcatggggagtctctttgtggagaatatttgagcttggggggcaacaaaattttcacactgtgttactttgctacaatgccaggaaattctagtagtggagtgactcctttcaattaatgcactatgatttccaaatgcctctgttagcatacaagtaagtttcctgaaaaggataaccttttgagctcttctcagccatgaactactatgaattagtgatcagattgctaaccactccatcagtttggggacagaagggccggatggccatgtattcatctgtcttccctcttctgctgttaggctcactgtgcttcattcatctcatgtccccagcaccatctcagtacactgcatggcataaaacagcccgcaatctcttgtcctcaattccaaaactgaaaaagctctaggaatagcagaattttggtaactaatttgcagcaaaactgaagtgaggtgaggctgtttatagttttctttatttatcccacttagtgtgaatgttttgattgctacagaaatattaacgtgcttgattatggggtgcggccccaaaccctgctggaggtgttaacataacatatgcacatgttcaggatgccatattgcctttctaaaaatctaaaaaattcagaattctgaaatacatctggccctcaaggttttgagtaagagactgaaaaccttagagagtatcatagagtcagtcagtgctttctgtttgtttttttttgttttttttgtttttttttttttttttgagacggaatctcgctctgtcgcccaggctagagtgcagtggcgcgatctgggctcactaagctccgcctcccaggttcacgccattctcctgcctcagcctcccaagtagctgggactacaggcacccgccaccacgccccgctaatttttgtatttttagtagagatggggtttcaccgtgttaaccaggatggtctccatctcctgatcttgtgatctgcccccctcggcctcccaaagtgctggattacaggcgtgagccaccacccccggccatagtcagtgctttctaagtgacaagcagggtatgcactttatacatattaccttgttgaagcattcatgcagaggcagttgtcatggagtggacagggcagggctttgaaagtcagactacctgggtggaaattccagctctatcacttaactacctatgtgcctctggacatgcacctttccctctctttccctcagttctctcatctaaaaatggctgaggcgggcagatcatgagttcaggagattgagaccatcctggccaacatggtgaagccttgtctctacaaaaaaaaaaaaaaaaaaaaaaaaaaaaaaaaaaaaaaggaagatattaatagtaataatgtttccctagtagactggtagtaatgattaaatgattgaagagatgtgaagcacttatacctatgctttcacaggcttattattgttaattattgtggtaaaactgtgacattggcacagtgatcctcattttataaatgaagaaattgagatctgttgaggttaatttaaatacacatgttcacatagctggaaaatcattgaggagaatttgagttcatatctgtgaggttgccaaatcggcaattttggacattatactcttattagttttctatagaagggagagctttaatgaactagtttgaataaaaaggttgagaaaatgagaggctgttggaggaaggtcaggcagtagacactgtccattagggaaccctcagcagccttgaaggggaaggtgcggtatacttagtagtaggaggaagaaatcaaaggcaaagctaaaagtaataagtataacttttgctactctgcaatattgcttagaactgatactgtcttcatggctgtagatatgcagatatgtcttacacagacagaaagtttttaaaaaatgatgatttaagcattgaaaaaagccaaaagataatattagaagttggaaagcagtttattttgtgacaagagttaattattaaaataagaatggaaaattactgttttttttcctttcatttcaacgaagttctcaaccttgtacctggaatctaactaagttgcattttaaatgaattgatcttttagtttttttcttccatttccatgagaatcctagaaactagtttgtcaagcttcttacttttctctgcttagagattgaagattgtccattgagactctcttttaagtatttattttgaacactttactcaacatgttagaagttcaaatagtttgagaacaattctactttctactatgtgtgagtaaatcagaaagttgtgaagaaattgatttttttggaaaaggtataagttatcaaaaatgctaactatggaagacattgaaagttaccaaaaattacaccaagaattcttttaacctacttagttttatagtgggttcttttaaatatcaaagaaggataactttaaatatgtatcatttatttcacactgtaggaaaagattctttctaaaagctattaagtaaattttatgaaaatctacttgtcttgagtctgacagtaaaaattatatagcaaactcacttataaatatagtatgctatattactaaatggaatacttgcaaattgaattcaagaatttattaaaatattgatctaccaaaatcaggtaggatttaacctgttagacataatttaatattagaaaatgattattgaaacaaataaaatcaatatacatcataaggaatacacagtgtacgcaccatgaaattaaaagaaaaaacaataaaacttgattggaactaaaagtgtttcacaataaattgtgcatatcaaattcatttgttttccttatatcagaaatgattggtgataaaaagacatactttttacacaaatctaataggaggcttcatatatttagaaactaatggtacccattcaacaaacatttttgaggtcttagtatgtgataaaaatttgatttatacagaattaacaaaaccagatgtagtcttctcataaaatttgtagtgttagaagcagaaaatggtgtgatactaactatatgacataattattgtttaaaagtaggatagatatgtgccaaattattaacatacaaaacattgagcatttaacactttgaaatgtctatatttaaaattactatgttgacaatatattcctttgataataaagaacaacataggaaagaaaataataaattttggtgttgttaacttatggctttatgtaattttctatttttcatgtttagcacacagtctacaaatagatgatattcagtaaatgcttttttagatgattaagatacagtgcaatttgtagctttagaattgtacggaatgctaagttgaagagactgtgtgtcagtgaaatagtagcagaaatatcattagaaaaatcaatagttaatatatttttccatgacatattatttccaagatataaaagtagttttatatcttttatagtttttataaaagatataaaactagttttatatcttttatagtttttataaaagatatacaagtagttttatatcttttatagtttttataaaagatataaaagtagttttatatcttttatagtttttataaaagatataaaactatcttttataaaacacatttttatgccttcattctataactttgttttcatgaaaatatggagtctaacatgcataaattagccaaaatacatcagtaggtttcggaaataaaaaaacatgttgagtttatttttctcatataataagaattgatatccaatcacatgagatttttcaaaagactttgttcatttcttttttgttaactgatttaaggcatacttctttcagtatctatcaaactcactccttatatatttttgccaaaatgaaaaacaaagaaaagaaaattgagattgatgaagatgatagtctctttccaaggtgcaattgattttcagttaaaaaaaatttcgccctctgaatgtttaaagacaaataaaatactgtatcatttcctgcagaaagcctaatttttactagtgttctgattcaaacttggatttgaactgtttaattacatagttttatatgtatcaaatatttttggaacatgtgggtgaaacttttttagaatcatcagatttaacttttatttcattatcttttttcttttagtatgtttctgtttttcctatgaaccttgaaaggagatttccttctactgttttgtttgtttgtttgtttgttttctatagggaaaaaacattcaagctcaaagatagaacagtcatctactgggtagttattacctgatttattagctcatgggtcccaaaacttttctatgcatgattcccccacctctttgaacaaggagggcttaaatacttgcaccattacaaaatggcaatcttaaccctgaactacttgctccacgctggcaagcatggatttttctgtatcaaagacagaagtattttgtgctaatctatgttttgaatgttttcatgtgtattatctcatttctcttcactgcactcctgcaaatttttaaaaattgggggtgtacttttgttattgttttgatttaatccccatttgagggttacaaggatctgaatagttgtagtttacacagttggtaagctacaaatccagtttccaaatttggggttttgactccaaatctagggtatgtttcaatctacaatgaagtctttgcaaaattgttaatagtaaacaaaacacaattttaagaaacaaactttacacactgccttcagcatcaatagtgactgataaatggatttgaagtcaattatattaagagcttcaaaaatcatattgccatctgtgtgaatcaataaatttgattcacatccagctttccagtctgattcttacccaccttatttatattataacaggtctattttctaatgacagctagtaaatctatgcatcagtgctaatttctttggtacagtggaattgtattactaagcacagatgtacatgtcttactgtgagtcagacaatgactcactggttgtgatgaaagtagaagagtctcttgactatttcattagtatttcatgccaggacatgccttcagtattttcctgggtgtaaattataatgtgcaagttgagaggattaaccaatattctcactggccattccatattcaaaaagagagaggcatcaatggtaggcctggccactcaaattattggacaaggtatttgatgtctctaaatatcatctgttgggtgttaataagtaaagtaaggaagattgttattattttccacttttcttctttttaagagaatctccaactttgttgaagtttccaccattctttttacacagatgtatgtcttaaattatgctcatcccaacccacatacaatggtaggcctgattggtccaagaaaaatcccatttctcttgtaggtaaattgttcaatttaaacaataaaattttaggccaagaatccatgaaaatttttgaagaaatcattcttctaaagttctcaagaagagaacttaattttctttctgtgtatgatattatatctggatgtaataactaagactattgtttgactaaggatgaaataagcacagagtgttagagaagaacaattgaatgaactggccacttgctgacctagctgagccgataggttaatcagtctaacagctcctttatcctctgattttcataaaatttgaaaaaaaatcatattttaacctactttgagtcagtagttcttgtttattgtggctgaaagcatcttacctgacacaattccaaaagttccttccaattcagaaattcctagaaaaatgtaccttttacttaaacaatttaaaactattgggattctacactaatttatacagaattttagttatatttcctgaaccctgtgtttgttcataaaaatagcattacttttttcattgttctttttgctgagaagtagagggaatggatcagattttattaaattcattaacgtaaatcttcccattaagtttcactttatttcactaattatctagtattttgttattgcagccttagcaaactaacactccctaaaacaattgctttatttcttcccattttccaatatacagagttgaagtacagtgtgtgtgtgtatatatatatatatatatatatataaaacttgcagcatcacttcacttaccagtttcatgttgacacagtcttcttctttatacattttaacgagacgcaatagtccattcatatatttctgttttttactactataaattaaattattgagaacgctattgaaatgttgatgataagagcatatttgaaaatacacatatgctctctttttgaggtttttttgttggtcaaattcccaggacctggattactgtttcaaaggtcacagatattttaatggcctttaataataatgctatattcacctccaaagagattacataaattacaatatcattagaaatgaattattctatatgttcttaagcttaggtggcagacatgtattattaactgaaggagagaaaaaatgaagttcaatcatagaagactaggggtagagaattttcaggtggagagaagaaccacaacaaaatttccatgctgggagagtgtctagttcatttgaggaactgtgaggccatttggctggtacagggtgagcagaggggaagagtagtgaattaaatcggaaaatgtgtagggcactagatcttacagggcttgtagtccattgcaaggacttcaacttttactctgatttaggtggaagccatggaaaggttttgagcagaggaatggcatgatctggcttctgttttaagatagtagcccacaccagggaggacgttgtggaggtgagttaagcccaaactgcctctctagtccccatttcagctcaggagagaagaagggctggagtggatgacagtgcttagggcaatatgtagagtaatgagaatatataccaggatggaaccataggaaatagctaaatgtacaggtacctgccattccaggcacacagtgtttcagttaagttacacttcctgatctttgaacattcttctgtactttttggtctttggcccattgcctgagcatttgcttgcctttttcatctgtcaaattctactaataatttaaaatctacctcagataccactgcaaacaaaaatatagtacatccagttaaatttgaatttcagataaataataaatcattttttaggataagtatgttccaaatattgaatgttatgctattgttttcactatttacctgaaattcagatttaactggacatcccataattacctggcaaccctgttcttaaactattattgaatacttgactttgatgttatttcagttaggataggttgcgttatgctgcagtgaaatgaaactccaaagtattagtggcctaagataagaaagttttatttcctgcttttactacatgtgttttgtgggacagcagagaaggcttattaattacagctcttcagagactactgtttcaaacttaactccttactatgccagaggggaaaaaagagagctctgcagtctcactttagcaattaaatgctgtagcctgaaagtggcaaacatgactgctgcttgcaattcattgaccagaaatagtcccttgtacccatcaactaaaaccaaatgtacaattctgtcatgtcctgggcaagatggggattggagctatgtagagaatagtaccaatgatgcaatctttaatgtaattccccacatatataatctctactttcttgagctcccataggaacttatttgccattccctaatgatatttatctcattttaacttacacatttaaccactttctacttatttaatccatttgggataagaagcttgaaaggcatgtcctagaattttttttagataaagcagacccgcaatcacagtttgggctggaggctaatgcctctctcacctcattctaatcctggttcagtgtgactgagagattttgtcttaggggtgcttttggaagtttactgttgtggtctgcattgatccttcaggtacacaggctgtcttctgcttctctcttgcctagctgtcccctcctgttttttctttggaagttctatagagcaggcaggaagcagattccttggcatctggacactacagtttctctgttctctgcacgtgtttattattgctatcaccagcttggaggaattcttgttgtattaactgctttctcttagcctttttgttttttgctatcctttcaaccatgtcagataaatagatgtttgctcagataaacacatgcgttaaaaccatggttaattcaatagaacatgtaatgaaatatgttggcaactctaatgggagacttcttttgagtctattttgtatgaataacataactttggggagtttctaccagaaatagactccatttcttcttacaactcagaagacacattttaataagtaccagtagttggggaatggaaggacttttgaactccaagtaaagcctggattaaatgaccactttgatatctgaaaaggagtggatcagagacaatatgtgctctatgtcaaataaaattcatgtgttacatatggaacattttcagactatataatatgactgcaacatttccatctctctcataggtgaagagaggcaaggtaaaataggcatttgctactattttatattcataggggaatctatgtgtcatagagaataccaagagtgattaagatgcccattcaattactttacctaagaacatttgaaaatgagttttatatatcagcattcattttatgacattttagccacatatttagtaaattcaataattccgatcaagtttaattaatgatccagaatgttcaagtttgttatttaaaaaaataacaaacttaaatattttacaatcactgtgtaaaaaatacacggtgtaaaaaatacatggtataaaaaatacaccgtgattgtaaattaaggagccagtttgaaaaaaaaaagttagaactgtgaagaacagtatttaacttaaattaaatcaaaattcatatgaaggaaattactctgtttaaaatgacttttttgttgggaaggataaagtattatactaaatatgaaaaaaatcagaagatgaagaaatgacatgccatgaaatagattgtgttggaaaaaacctttttaaactgatttttaccttgatggccagtgaaaagaaagtacaaatgaagtttcattggtgaagaaatctatacagtgttttaagatcaaatcaaggagccgatttttatgcaaacttgaattccaaaggtttggaagtaattcgctattccaataacatgaagagtattgcagtaatgactttgtgaatttttttgcatcctgattcaaatctatttttgcattttgtgaaactcctttattattataaactttctgttgaaaattagttttaaattttaccctctaaatcctaatttagaatgtttatatttccaaaaggacatgtaattatacagaattttaataaagatggcaatcattggcatggatttctctggtgaggaaagctgagtttgtgacagtatgaaaaataggaagtgctttagtgaagaatataatattctttatacccacttttgttttttccttttgtttgtgagaaatgaggaactatggagtagtggaaagtgtagtttacaggcccaaatctggaagaagaaatgattcatgtgtagttctattttccatttaaattgttgtaagataatttcaattgtatctttagattagctctcagaaccactctactctgatgtgattcttctatatctctatatcagacatagaaatgcagaaccaagtaattttagaactataattgacttggatttaactaatctaatacaatcttgaagaaaaatgcttatttctagtttgacttctgaattttttctattgatatagtgaaagggagaagacgtaaattgtgattatggagtagaactagtaaataatttcataggcaaatattaaaattgtatctatgccaatattcaaagggatggtaattattaccatgagggtatataatagtaattatagagtatttgagtttgatcataaaatggatttctgtttgatctgggatctctgaaaatattttacaattgccagatttgcttttctcagaattctatctggctctctggttataataattataccttgttaaagttggttcccatcaggaagttagacagccctgaactggtgctttgggggcttagaaggaaacagctggcacatggggaacaaggccaagttgtgatcttatagaatagtagccttgcggttgcagcctatcagagaggaagcttgaacttggttgaggcatattcacttaagtgttaagaaaggatgtaaaaggctagctctttctaagctcccagttgccaacagctagcatagaatgttttgattaattttaaattgaaaaggtttcccagttgatgatccttgatgaattgacttatcagtagcttgtgagagatgcatgggctgatttagaaatagactaaagctctgtcttagcagctataagaatgaaagtacagggcaaaggtggatgtacttttttttttttcttcaacttttaagttgagggttacatgtgcaggatgtgcaaatttcttacataggtaaatgtgtgccatggtggtggtttgctgcacagatcatccatcacctaggttttaaggccagcatccattagttagtcttcctgatgctctcccttctccaacacctgcctccaacatgccccagtgagtgtccttccccgccatcttcccatatgttctcatcattcagctcccacttataagtgaaaacatgctgtctttggttttctgttcctgcgttggtttgctgaggataatggcttccaactccattaatgtcaggatgccaaataatacaaatttgagtaccacaaattatgtatgagctatgtagatggaagcctgaaacaggcttattctcttcatttgagcaatgtgacatcctttctttggggggtgagggtgggtatggtgatggctatttatttttatttttcttcagcttttaagttcaggggtatatgtgcagtatatgcaggtttgcagataacatccttaatagaagagaacaaatgataaagataatttaaaaaaccctttttaaagtgttttattattttttgttgatacatagcagctgtgaccatttatgggatactgatacttgcacacaaagtgtgatgatcaaatcaggttaactgagatatccaacactcaagtatttattatttctttgtattgggaacattctaaatcttctcttctagctatttttaaatatgcagtaaattcttattaactatagtcattctactgcgctgtcaaacactagaacttattccacctaactgtatttttgcaccaagctttcttcattcctccctccccactagcctctgatatccaccattctactcactaccttcaagatattaatttccttagctttcacatatgatatttgtcttgctttgcctgacttatttcacttaacagaatgtcctccagtttcatccatgtagttgcaagtgacatacatttattcttatcctgtaaagatgactgagaaaagcatgatttgcaattacaaagacttgtggtaggcagatttctaagatagcctcaaggtttcccaatcctagtgtacacaggctatataatttcttcccagtcctactgtactcagctgatataatctctttcccttcagcatggttgagggctgtcaatgggaagggatatttctgtaattaggttacattacctggcaaaggtgaagggattttgccgaagtaactaaggctcctaatcagttgagtttaacttaataaaaaaggagattatcaagggtatacctgtcctaatcaggtgatccctttaaaaaagagtctagaggtcagatacagaaaatgtcagagacattcaaatttagtaagatcccctgctggctttgaaggagtaagctgccatattgtgagaggcccaggtggttaagaccgaagagtggcctctaggaactgaaagtaacatcaagctgacagctagcaagaatacaggaacttcaaggaacaaaattctgacaacaatctgaataagcttggaagagtacacccgcccccaaatgagtatgcagcccagacagcctcttgatacagccttgtgagattctgagctatgctgtgccagaacttttaacttgcagaagctttgagataactattgggtgttgccctgaaacgtggagaagttcaaatatgggagctgttgacaaaagttaacatctcttggctgagaactctcttcctggaaagaaaaaaagttcaacatcaacggcatattaaagaaagaaattacatcattgtgacatgctagtcttactgattcacatacagttaagtaatgacaacattggagaagaaaaactaacatatggactgtaattaaagaactttttttgggtttttctaacaagtcaaacatatttagttgagtgaatacattcaggtattcaggtttttcatctgtaaattgagtgatttgaattagataacctatctgtattcctctgtatctagaattccatgatttttgattcagaggagtcctgaatcccaaagttttgaatgatagcttgaaaccagggacaactgtcttcctcttggtacatttgaaaaagcatctgaagagctagatttttgtctgggccactctgctatttctgtggccctgagcaaatcacttactccctttaagcctccattttgctatcttaaaggattactgaaatcacatgtgagaatgtacgaggaagagctttgtaaaatcataaagtgctaattatttttaagccattttcatctacttttttgttatattctgagcttggaattctagtgacttcaccttgagaaaagaaaaaggtagttataattttaaaacattgaaatggtctggaacttgtttttcttttacttagtcatagattaaaacaatatatgaaaagattaaaataagcaatttcccccattttcaaattttattgctaatgttatgtcgcctttcttttgcaggcctagggaaaaagtaatcacaagcaatcaggtccttggtttaaaaatcttctgatttcaacagcagttaatgacattctcataacattgatacctgtgaaaggataagagattccaagacactgtagcagagaaaaagatgtagatgcttgtttgcaaataattcactttatcttttattaatagctcttgttctctgagtctattttccccctttatttgtcaaatttctctaagaaaaaagagaaggaaagaaaagaaagaaaacaacaatcatagtaatttataagaattacaattttgaaataggtttttaaaatttactttgttttaaaatagaatacataggacattatacattaccaaaagtgaaaaagtaaattacattcctttttgctttcgtaggagctaaagagaattttcccgagggacatagtaatcttattatacaaccatcttcctatatctcttttgatttcataaattttaaaagaataaattatcattttgcacacttaaatgacattatcagtagtaatggaacatcactgaagatattataaactttgagtaacttgtactatttcattgaatattgttaattcaactagtttcagaattgctgtaattttatatctattttgtgatagtcaatgattcaaaaatgtttttgttcaatgctcattatgtgccaggtactgctctatgtgctaagatagaaatcatacctgggaaagaatctcaaggcctcagacaaaggcaatctcaactagctttatgtttgaaagtgattatttaattactatgatctaatgtttgtattagtttctgggcttcagaaaagaaggctccctgtaataaattacttagtggagagatgactgacaaaaaatgtttgtcctttccttttggcacctgtctaaactgaagactgatgattaaaaacatcatctgtctggctttcaaaaaggaaaatctttctcttagtattatcatttggattgtacttgtgagcaaaattgtgtaaataatcatagctatggcctaaactaaggaagagagtctttaaagttcaagtaaattttgcttccaaagatattgaaggagatttctattattcattttgttcaaattaaatatatttgaccagattctagtttctaagtcactttcatagactgatacattaattacaaccttcacagacagcaaaataatttggggttaaatttgacaaagaaataaatttaaaaacatatttgagaaattctccctctgccagttttggtatggtaagaaatagaatgcggttgtcaaaaaaatttttttaagttgttttcaccatttgtggttctcaaaactaacggactttgtttaattcttacttaattatattttccctggtaaatttatgtgaaatttattggcatatagaaactatgcaattgataattatagctttgtagttgggagctcagtctagacactaactttgaatctgcagcctggcagccctactttccagcttctttatggccttaggcaattaacttctctgactcagttccctgttttcaaaatagggctgggatagatgtttagtaaagaactaaatacaataactagcatatagacaagtgtttaataaatattccttattgttatatttttacagattattgtgtatacctactagactgaaacatagtaaatactcaaaaaaaaggtatttaaaagtcatagagttttttccagggcttgattgctttgcctaacatagtaatgtatttcggtttttctcaaatcattcattttttaaaaagttgcgtttattttttcagttttaggagggcaaatgatgaatagcaagatgagattagacatttaaagatagcaattccaaattacttggatattgagctcattttagtctctggcaatctcatattatacattttaagcaaagagttgtcattcaaatatagaagataaaatgcagagattgagataaaattggaaatgatgattgaagatttaagataaatttttaatgcattatagatcaaaggctatcaaggagtaagaaaatcttgagacattggcatacatacaaccatgattcaattttattataaaataggggttatacgaaaagaaaaaaaatgcaaataataaaaaaattattgggttgaattaagatttaataactcaatctttcttagctgtacttttgagaaaacacaagagccataaacacagagctcttcaaacacaatggatcagttacaactcagattggtggaagaaagccttccctgccaagtcagctctggttattagcctttatttatttattcttaatttttggattttataaacattaaattccaagttattttctttgtgcagttttctttctctgttatgatgtgtttacttatgactttcttttcatgcattacatctataagtgattcctaccttgtaattattactatttctaaagagaaaactgtgattcataagaagcttttattttatatttttgagaaaaatgctagattatttttaatccatctattttctctttgaagtatttacaaaagtaattttattttacaaatgaaaaaataaataagtaacccacacttgtcattagatagaaaccaagatgacaaaataaaattaaagataataaaaaaagaaagtaaaaggtcatccatatgtttgcttaaatcagttttggtagtttgtctatttcagtgaagttatttaatttgtcagtatatagttgttcatagtattctcttataattctttttgtttgtttgaggttgctagtgataccctctcattcctaagtttagtaatttcagtctccttcctttcttttcttttagtaagttcagttaggcttgtgtgttttgttaatcttttgaaaaaactaaattttggttttgttgattttctcttttttagaattctttatttctactctaatatgtattaacttctttcttctgcctgctttgggcttatttgctcttcttttcctaattcttagggtggaaagttatttatttgagagcttctttttcaatatatgtgtttagagctataaatgtttctttggggagagctgtaaatttatctaagaagttttagtgttttttttgttttcatttgttgcaaggtattttctaatttcttttataacatcttttttgatccattggttacttaggaatgtgttgtttaatttctgactatttgtgaactcttccaatttgcctctattgtacacttctatgttaattgcttgtgatcgcagaatgtagtttgtataattttaatacttatagatttattgagacttatatttcctctaccatatgatataacctggagaaggtttcatgtgcatttgacacaaatgtgtattctgctgatgttggtggaatgttttatagacatctgttaggtctaactttttttttttttagatcattcgagttttctctttccattttgatcttctgcctagatgttccatccatcatttaagtatgatattgaagtcactaactgcaattgttgaattatctatttcttcctttaattctgtcagtttttgcttctgtattctggggttcaggttcagatgcatatatgcttctacttatattttcctgatggattgactaaaaaaatccctgcactagatatataaaattatataaatttataaatcattttatttgatacagttataaaatgtttatttctctcataccaatttttgccttaaagtctattttgcctgatattcatagagcctctacagctgtcttttgattgctatttgcatggtatgtggtatatattttttccattctttactttcaacttttttgcttctttgaatatgaatatcttttgtagttgaattatgtcattctttaaactcattctgtcaatctctgtcttttggttggagtgttcaatcaacttacatttaatatagtttttatttacacacaaaccaaatctttatatcagtttcctcccaaataagcaatggctagcctgttggatttatgtagggcttccagatatctgttacttgaaatattagtatgttgttatagatgaaacacttaggcaaatgtacatagatatcaacatctatatacaatttactgttaagaaaaataggcttaactgaataatctacaattagaaatttcaagtactctatctttccactttctgtagtatgtaattttgatggacctaacacttaacattatcttgaatcattgttctccatatttagaagaggtagaatatattagaaaaataaatatgtacatgtgaatttgctaaaataatagaaaaaataacttattaaataagaaactaaatttatcagtaagaatctatacacaattacaattcactaatttatcttattgtataaattagttatcattcataactcatgactaactgcaattaattgcctattacatgtagcagtgactctgagataacatatgaaaatagaatgttttggattagtaagagcggagttgagggacagcatatttctttaagtgtatgattaaaaagtccactctatttagtctatacagtctgtttacaatatctaattatttaatgctcttttgtgcattttatgtatttacataaagttatgcatttgtatgcttacataaaatacacaaaagagcattaaataattagatatcgtaaacacttctaatcatactctaaaataaaaattgcctctatcagttctccttagaatttttcatggataggtatgatggatttgtgagacattactaaggaactgtaggtgatcactctcttgacatcaacaagttggaagcactaagaaataaaataggaattgaagtatgtacagcagccatggatttacttcctaaacaatggttataactggcataggttggtggacactttggtactaatgttaaggaagcacacacttggaaaattgacagattttgttaaacaggcttttgaagtaataatgaatattcaataaattttaattctattttgaataatttatgcaaatgcagaaagttttagttcaacgatttttgatttatgaataatacatagaaaactccaggtacctttccattggctattctcatagattaaatagatttggaaagagaaatgaaatagcagttgttacaggttagtgtttcagggactggaatttacttatccagagaacattcatgtccgccttgaagatgctcaatgtgtttgttaccagaattctacctggcagcagtttagtccagaggaatgcactccagctgaggatcgatacttgtgcccaaatgcattaagtgaaagcctgcaggaacagtggctactggcaaagtatcagaaatatgaatgttttctagaaattggaaatttccagttaatgtgcacagtagaatgtgttagactatgtatggagctgaggacacaaattgacttgtgacatcctgggatattcacatgataatgaaaccagagtcttcaaagtggatgatgatttattgtgaacaaaacacagttaatcaaattcaattttaggttagggtgtgttaggctggcagagtgaacatgggcaaagccgacacatacacttgagaacggcattgagtccaaaagattactcctactgaaaatgtatagaaaagtacataacaaaaaaagacataagaggctaatgatgctcggatcctgagtctgtattcttctcaaatgaccaacttgaaactagtcatggaacagggagcttaagtcatgtatttattaaaggtaactctttgaaaagagctttgagagctcctgaatccaggaaccattctggttcttttctttcatattgttccctgcaagttccaaaaaaggagtgtgtaggattttccccaaggtagtttgagaacacctggggtttgtttcacagtaacagtagcaaactttgcagcaagtctcatggcagtttcgaaatgggtcacagaccccatttcaagcctacttaacagaaagtttagcaagactgtaagtgttttaagataaacagttagcatttcaagtttttaggtttcaagaaaatcgctaatcttctcttttacataatctatgtttcaaaatgttgaaatcagtctccaagtgtagtgttgagattttcaacattgtgttggaaattacgtcaccagcttctttaaaaagaaacccaaaaatgattggcgtgcgtaagtagcaatagatattttttacgttttttatatatctgtctcatagttttgaaatttagcattctacaggaatatgtgtgtgcttaatgttgcgtttagtgcttagcagtctttaactgtaagtggctggtgtgaaaacaaattattagcgtgcagaaacttaaatgcatttgttccaaatgaaaagagttcttcaccatctggttgacttcaagtttaggaatcccatttaaataataagtttctctcaacaattttatttattctccataatgattccacaataatacctcttttacctggagataacctaatcaatcattttccctctggagtttttggccaagggaactagatacacaaaaaatgacagagattaaggaaataaaatatcagctttattaattaatgtaaaaacacatgatagcagcaacacacccttttattcttgcaaccatctctcctcccaatctccctctctctccccttacaaggctttgctgggaagcggtattactggccttaggacttagagcaaatagagcatgccatcttcccctgaagcaaatactgactcacatggtcaggcttgtctgcacgaggagagacagatctggatctgcagatccacttctacggtcaaccaaataggtctgcttagtgggggcaacttacaagaagaaagggcatcctactttaaagtacaggaaataaagaggaagcaggtcgtggtctaagacttttagatctctagtcaatagactgaccatgtgaatgtcccagatagatgctgctcaaaggagctgaaaatattaccttccactaacatgcaggtagggagaggggttaagttacctctctcaaagaatacaaccacaagaaagggaaaaatagaggtttttttgaggatgagtaggcagcaaagagtctgttttctctcttcaaaatctaattcttcacagggcaagcctctttttatgtagctttagcaggcttggttatctgattttaaatttgcatgtgatttaagatgtgacatcagtcagggcaaaaggatgtcatgatggtccaaataccaagacacagcctctgacagtctgacagcaatagaagaaagaacaaaactacagatgtaatctattaatcccaaagccatatctatcaggtgccatgttgtgtgttggcaaagagtcccacaaacctgaggagaccctgagctgatgactcagtatgtcatagaatgaagtcatgattaggttgaaagcaacaaccctgcccatttagaaacacttaaaaagcagaccttgaaatccatatagcctaaataatttataaataaagaaactaagactgaatattccatcaaagaaactgagttttcaataaattttaggaagatgtttatactacatttcaatttaaaaaaatatatcttgagacagtaaactcctggctcaatggaagacttgccatacagaaatgctcactaaagttgagagggatgagaggaaagagaggagggagaaaatgagaatgtgactacagtgtctttgtttatttgtttataatcccaaatagaacctcacttaacacttggctcttggtgggtccaagtattattggttgattgaatgggtggtatacatgttgggaatataagcacagaattcacaaccttgaaggaatttaagttgctttcagttatgttactgagagcatctttcttcctcaatgtgtcttcctatttctgcctatatattatttaattgctgttgctttttgtcatagtttaatgtctcataggaattcttcatggataggagaataaggctgttttttcttagtgagaaaattgagagtaaatatatatttcctagttaaaagcagtgttgcatgactctgaaggggagcaattcacattccagtgtatgcagacgacattttctataaatgggcagtggccaagctgtgctctagactgtaaaacttactgggccagaaattttaccaaggtgattagagtaattcttttcttaaaatttatgttcctagaggagaagatggcaataaagttctcttattaagatgaagctgggatggtttaatttcatgttgttaaaactttagaatcttattttgtaaaagcccctggtgctgggtaaagtgaattcctcatttaaaaggtatcaatcagagtgcaacatttgacagaatatgtttacatttctttgaactctgcttttggactgcaacttgaaagtagcttcccgtgctgctatgagtaaaatcagtttctgcttgactagatatcatttatattttaaaagtgtatttctagtattatatgtacagatgtttacaaaaatattttagatttaatactttagtttacttctgaaaatcctaagttccatataataattattattgctttcatgacaccttttgaaagaaaaaacactcctgagtttttatattaggatatctaaacctccattaatttttgcaacatgagacctaatttatgaaagtgcctacaaccttgagttatatgggctaattaaaccaaatatgtaggtttacacctcacataacctagtaataaatgcaaatacaacattctgttctggtttatttttattgtagtttctctttaagtatacacacaaaacacataatcttttcaatttgtttttgtctaatttgcttttcacaagattttgaagatttaagatcaataatatgcttgagaattatgttttaaaactttttttggtcattatgaactaccatacatattatatgtgaagctgtgataatgcacttaactgagatgttaaatacttgtattcctcttagatcttaattgagccttgagtatatttatctcatgatgtagcgaatgagaatctgaatacagaggatatcaatgcacatccacaacattgttaccagaaaagcatattgttttcaaacaaaccgccttcatctttttacagatgggatcctgttttagaaggcaagtataattctggatttattactataagtcacacatttcagtactgtggtatagaaagtaatttgtggagaaatcatttgagttatagaactagtaaacctgtgtttgaaccctggcctgggaacttactggctgtgtgattttgggcaaagtattgacatcattgcctgtttctagtaaatcctaatacttttttttctaactgtattagtttgctagtggtgccataacaaaatagacttgatagatcaaataacataaattaattttttcacaggtctggagactagaagtccaaaattaaggtgttgacaggtctggtttcttttgaggcctatatctttggcttgcagtattctcacagggtctttcctctgtacatgtccattcctggtgtctgtgtccaaatttcttcttcttataagggtggcaattatatgggattagggcctagccttacaattctgtttgaacttaattacctccttaaaggtcctatctccaaatacagtcacattctgtggtactgggggttaggccttcaacaaatggattttgtgagggcacaactcagcctatagtggtaactaaaagtgtttatcatttattcattcatttatatatttttcagttagcactcacttttatagaacctactctgggacagacacttgtgccaggtacaggggattcaaagatggtcaatcactgtccctatcctcaattaactcatagtatagttgcagtgatttgcaaacttggctgaactacagaatgacctaaagcactttaaaatatgcagactcttgagtgtgtcagaatctctcagagtgaacttgcaatatgtagttacaaaaaactccttgaaggaaatggtggtttgaacacctgtgattaaatggaaaatactagccatatatgtaagctgctttttagatagtttagctcttttgtgtttgttaaacctcctagtccagcgatgttagaaattgagtttaagggagtttcaagtgcttagtccaagatgaacacagctggtttgagtaaaaggtgggactgagccttcttactgcatttcccccacactgataaatatttaattatttactgatataatcttaaatcacttgacttgagtccctaaggttctgaatgcaacaggcagtcatacactgtttccaaagctggcagtagaatatttcctaagttttatcttaacttaaggaacttttattgggggagcagcaaaaactgaaacaagatccacactgttttgcagcttgcagctcagatatttctttttaaacattgtttaaaatttaattatattttatttttattatactttaaattctgggatacatgtgcagaatgtgcaggtttgttacacaggtatacatgtgccgtggtggtttgctgcccccatcagcccgtcatctacattagatatttctcccaatactatccctcccctttcccccccaccctccgacaggccctggtgtgtgatgttcccctccctgtgtccatgtgttctcatttttcagctcccacttaggagagagaacatgcggtgttctcagatatttcttaacagtgttacacacctatttagctactccttctacccctaccaagggcttatatttaccccacacttccatgccttttgtaaagacgtttttgtcatccctgttgcataacttgagcctgattaggacaagactaaattaaattttgttcagtattgactctataacttgattatattcaaagtctcaagggactaaaataaaatctgtagaagataaccctgctgttaataaaaagcctcttagatggcctttccctttgaagtgtaactacccagatccattttcagataaagcttctcagaaggttttttgggaaaaaaaaatcaaagtaactttgttggatgaagccttgttatggtttcctcctttcacaagaccctgtttccagtgctttaaaagccagattgatttttttgaataaatgtcatgggaaatgtcataaccatgaaaaaaccttgcttttgatttcaaagcgccaggccctcttggtaggaaaaaccaaaattacacccaatgtaaaggcaagagaatgtaggctgttactttgttttggttattaactaaaaaggtgcagctgttttcttttttctctcaagtgtatctaaaaatataatctccaggaatttaattaatgatttccaaatatatgtatggtttaattcttattaaaattgtccataaagctgtgcagataactgttttcctcccactcatggttagaagattagattctattggttctgaaaattagaacaacattttttggcttatgaagtaatgatgctgattttattactgttatatttcacaacttgagtttggtggatgaaagccttattcagaaaacaaattaataaactaaaagagtgatagaatttatcaatactaaatgctatgagacaacacaaataagcctcctactgacttctattgacttcaaatgtaaattgtataaataagggctataagattagattaatgacaaaattttgccaaatccaaatgcaactaaatcagtgacctgccgcaaatgacttaaatggccttgacatcaataaagactcctggccatttaatttaaccgttctaagagaaaatgttttcagaggaatggatgaactaaaggtttataaagtttgaagtttccatttaaaacgtatttaagtgataatgtcattgtatttttcatttgcggcatggagttcaagctcctagatcagagatgctgctaattaaaataatcactgtcagtagtcattcagagtctcattcagagtttagcatcttaaattccttttctctaaggaatgacatatcttatttttaaagctttttccatcacatggggacttttgatggccttgctcacatgaaagccagttgattatatgatgttactcaggcacaaatgactcaaacaaactcattaaaattgctaaactgtggtcttgatgtttaaagacgcacaggtccaaggaagtatgtggatcaaataacttcttgaggataaatctattagttagagattgaattttgttacaagaaaccaaaagacaaagcaagggctttcttttgtctgattcatcaagaaatcctgaggtagataattgctgtttcagcagctcaaggatgtcaaagcttaggtttctgtgattcttttagccttttcctcataaccacaaaatgactgctagagttccagccatgatatacagagttaagcaagaaggaagggcaaggactaaggacaaaatgcagaagggacaatccaacaaaaaatggaaagcttgcccactgaatttcatttactttcttattaccaaaatcatccccaactttaaggcaattacaaaatgtagagttttgctttgtttgctgtccttgacattgttgcttctaacaaaactgatgttctgtcagtgaggaagaagggagaatgactatttgtaagcaacatcaggctcttcacagagggataccagagcagtacttgggattgttcccagattatggtggggtctctaaatatttcttgaagtaagttggtttatagcgcatagtcaacactttacccagtgttagttatgtcaatgctaccctctggctcataaatacactagcttctttacaggaaaatgatactacgatgaattatttaggtgtgatattatttgggtatgataatgatataaagaaattctaaatgaatttttggagcccaaaacatattatagaaatggtaggctgcaaacttaaatagggagttagagttatctgggtagaatatctgtagctatattagagtatttattgtgtgaaagacactaggttaagtgctttagatagtttattgttttgtcttgcaataaactttcaacggtaggcatcatttaaaaataaggacaccgaggttgaaagaaattgtcttaagatcacatagctagaaaaaaaatcaagatttgaatttaatacctattgactttaaagcagggtcaatacactttttctgtaatgggccagacaataaacattttaggctgtgcgaggcatatgcaattctactagcttgaaagtagccatgggcattatgtaaaagaatgagcgtgactgcaaaccaataaaactttatttatgggcactgaaaattcaatttcagtggcatttcatatcctttttctgtgtcataaaatatttttctgatattttttcaaccatttaaaatgtatacataattcttatctacaaattgtacaaaaaaaaaatgtttcgagagtcagatttggcccgtgagtcatagtttgctgactcctgctctatgtcctatgtgtttgaccttggtgctatatctagctaatatagacacatcaagctgacatttccaggatgtctgcactctttgggctgtgatatctctactcttaaaagctctgaggtagaaatagacaactttctctcctggtgacctgaaatcagactgttggaaaattatttctaaacaatgaagcccaactccacttcctctaaagaaactgtgcctcattgtaggtacttgtcttttgtttatgcttctatatgacaatgttttctctctattcatgtacagtcccatttctttgggatttcaaattgtcatcccctgtaaataatacccattttgaagccttattgtgagacaaactgataaactgtatctaaagcatttagttcagtattttgcacttccttaaccttgtcattagtgaactgtgctctgctgctcttcatctgcttgaccaatgtctaattcattaattcatcttctgttctttctcttgctaagcaccctctctagttagggccacctgtagacttaacaagccttctcattttctgttatcagtgggcaaatgtagtacatgaactctaatagagattagatattaatttttactaatataaagtcaaattatcttcattttgtcctactcttgattcacaaactgatttctaaggaaatatgcattaattggttgaaactcagtacaatcatgcttgtactgacttcattctcttgaatgattgcaagtttatttttcttcttacttgttcctgacatttttttacagcttgttttgagactaacttttggggaaaaaattcctattcttagttttctttgtttctgctttgtttcactccaagttaaaagctaactcggagttaggttttaaatagtctagtgcttgagaaaacttgaattcatcacaggcatcatggaatacaatttactcagtttataaaatcaggccctaatccaatttgcacatccaatttatgcattgatggctatattgcaatatttgagccaaaaatttctgcaggcatggtaaagaggggcgtttttttttcttgggagagagggttgacagacaagattgaatctataattttttattttccctgtatttctgtgagcaccaaactgtttggtgatggtcatgaagtcctcttcatactaagcaggtagcacagtatatcagtaaaaaagtgtgttgaaacttgaaaaatacttttctataggctcaataaagacagaacagtgacagaaaaaaaattagtttttcaaaatgtccaaaaatgtaaaagaaatcttgcatggcagttgctgtgttgtaactattgtagaaagccacacgacttttatattatctatttatatgctgtgtatttagttttatagcaccagtaccatatgatttataaaatgacatcaaatgaaaatagctcagaattataaaagcttcatgtgattttcctttcctacttatttgggtgaccagctcacatatttcatgactcaaaacacttcattgccagtcagatttcttttttaaaatatgatggcatctatgtatgctgtagcagcacagatggtattggggaatttagtcagtctgatttattgtagcttatcttttacttgctacaaatgccagtggggatgagtcctagaagcctgacatttgccaaggtgtaaagactgcataaaatgaaatctgctgaacctccatgaggccatcaggctgggagtctagaaatagacaacttcgaggacaggtgtgatgatccctggaaaggagaactcaactaaggtttcctaaatctcagctgctcactctataaagccagttttgtatcaaaaatattgcttgtttgagatgccagtatttcaaatgctgtcatccaaatcttccataaccatttctcctgatacaacaaatgtgatagttgcatgctttgctaaataaataaatatcagagacaggagggaccccctaggggtcatctacttcagcatgctctatctagtcagtcctatcatgaaagcactcaatggaatagaaatatatttcttttttagagtcctgatagtaaaattttattaggagatatattgtactaacaaaagtgtgtaaaattatagttgactcttgaacaatgtgagtttgaactgtgcaggtccatttatacatagttttttttcaataagtacgcagaatgtgcctgcctctcctgcctccccttccacctcctccaccttttctgcctctgccatccctgagacaagaccaacctcttgtcttctgcctcctcctcagcctactcaatgtgaagataatgagggtgaagacatttatgatgatccccttccacttagtgaataataaatatattttctctccttcacgtttttcttaataacatttcttttctctggcttgctttattgtaaggatacagtatataatacatatataaaatatgtgttaattgttatcattaaggcttccagtcaacagtaggctattcatttttttttgcagaaacatatttaaaaattattattattattattatagatttaggggatacaaagtgcagttttgttaatggatatattgcatagtggtgaagactgggcttttagtgtagctatcactaagtaatataccttgtacccattaagcaaatccttatctttcagccccttctcaccctcccacccttccaagtttcctatgtctgctattccactctctctatccatgtgtacacattatttagctaccacttacaagtccgaatatgcagtatttgtgggagtcaaatgttacacgtaaattttcaactgcatgggagattggcacctataactcctggattattcaaaggtttgctgtatacacatactttaagaaaaatgataaaataaacatcgttgctacctccctcagcctgtgaaatagaacattacatgtaccttaggaacacaccatgtcttcttcccaatcacatgtagccatctcttattctattattccaaatggcaatcctaaacaatatatggtttagtgttgactttttgtggactttaagttaactaagtaatacagtatttttttctctgaatttacttcacgatacctaaaaattcatccatgtttattgttgccacttttcccactgtctccccttgtgcttttcacgtcgcccccaacccagtcattttgggtgaattgagtttttaaatttatgttgtcattgtataattcgcctctaattttcgaatgttgtgtgtactacaactgtttttctagtgattacctttgcacacatcatatgcataccttacttgaggcttccaaattattgagtcataatttattgcattgagtcttctccctgaaacaaatcaaataccttagaattctccaactctatggcccttccaacaacttatgtattattatttctgagaactttaattctagctgtttacttcccaccctaaatgaacatacgattagtcatttttactggtaagttatacgattaatgtttgtttaaatttacctacatatttaccaatgttcttattttccatcttcaatcttatatctggaataatttttctttgccttgaaggatataaataaaaatttcctttagtgagaatgtttttcattaactcttaataatcacttgtggaaaaatgacttaaacatacaaatgcttcaaatatacacatggaattgtatgttgacaattattttctctcagtaaaccaagggaaccattcttttttggtttctattattatttggaaaccagttgttttaataacgtgtttttgtttattttttgtgttttctttttcgttgattttaagatctttttattcattttgatactctttttttttactatgatatgtttacgtatgtatttatttttattaattctgcttgggatttgtagaacttcctcaatctgaggattgagtcattcagatcttctcctggaaatgtcattggccttactgtatttctttgaacagcatttgctctcctttctttttactgggcactttttaaaactttgatgttttttatttgtagcaattaattataggttcacagcaatattgagtgctttcttaacctataattatatatatataaatgtataatatgtaatatatataatatataatatataaatgtataatatataatatattatatataaatgtataatatataatatattatatatatatattagactttctctttgaccctttctactacattctaggtaatatctcagatgtttattccagttcactaattttctcttaaactgatgtttttagttgccctttaaaataaatttaaatttcattgtatttttaaatttctatcagttctgtttggttctttttcaaatctggttgattcttgataataccaaatgttgcctacagatctaattgctttaaatgtatcaaataagtagatgataattccaataatttctttcttttaaaatttttgtattatctatcttctctctctcacacacttacatgccaatcactatcctacattcttcattcttctggttctcatttatgatgacttggtttttattcaggttgtgaaatttgactgtgagctattcatttctcttaaaatttttatctttgggaattctttgaagtctgttttaaagttgagctgctccaaagaggatttgcatttttttctttgccagacaactggcagtgggccaacccaatttagctttagattaaattctccgaacgaagaccttgatactgtacaggtagtgtgaattccaactgcaaacttgtgtgaagactattctgtggttacaaattctcaggggagcactttatttttctcttcacccacaatcagaatctagacagtatgtttgtttgatatggaagggtttcatacaaataaagggtttgtttctcctatatttaattttctgtgcaaggtttttctattagttttcttgcatcgtgaaggctttgggctttggtgagcttgtatctgcaagcccgtccagttatcaaaatggaaattcaaaatcttttgacttcaggcaaaaactgttaagataaaaatcatttttgatatttattcctcttccagattttatgtagagcatataatccaccatactaatggaagcagatatcttaagtgttaattcaagaacatgggtgcatagaaaatggaatctatctctaaattttactttagagttttgaaggttacgttttacatagctgagttcttataataacattcattttattcttgcaacgatataaagaaaaatctagttatgaaagtattgatgatattcagaagagcattatttattaaaaataaatatgtgaaatattgccatatttgtattaaatgtaactataaaatcttgattagaatcatgtaatatttaatttctgtagactgtatttcatagtataggcagatatatgtttgagatgttcttgctttgatggtgctcacagtctagcaatggatagctatgcaataaaaaacaatataatgccaaggaagtattgatggtgcttataggaaagatcaacttagtctgcctgtgggagtcaaggaacccttgagagtggagtttttaagcaaaagtgttcatgattaaagaaagaaaaagaagagtggtcttgaaatttgtgtattgatagtcattcaccaagtaaataaatcaagactggtggtgatgatggttctagtctggaggctagactttctacaggaatggtagtgtgatatatttcacagaactataagcttactattattgaaaaagataaagtgtgttagtgtaacggatgagggtgtagtgaaaagtaaactgttaagcagagatcattgaggttattttatttttatgagtcatccaaattattgagaataaataggtttctgaatttttgttgtaataaaggaattttttgtgtcctatgagtaaagcttgtataggaatatgtatttagtagaaatgagttatagcaggctctggatagaggtgcagaatgtcagtttatattcaaggttgtataatcaaatgacttcaggagtcacaggcgatggcttactgcaaaataccaaagagttctggacactttggcaaattaaaatgtccatgcctaacctaagcatgttcaaatttagtatgttaaaagcactgactctgttggttgaatgaaatggaaatttttactgaatttgtctcaataatcctccattgcagcccttagctaagtgcccaagatttgagtaagaagatgttgaattttttcagtctaaatttaataattatatttacgcatttttattatcttccttttatattatcagataattatactagacttttttttttcaaagcaggtaattaagatcctttcagtgttactttaaattctggggcacaattcaaaagacaaattaaaacaaacattggctatttaacgtataaatgttgagcagtaatgaagattaaagatgctcaatataagatttgaactaaaatgtttgtggacagacataccacatccgctgatcatttctttcattagtgtggcttcttagaggactggcaagaaaaccattttctacagatgaggatttcagcttaacctgaaattttattcacatttaaaatggtatatagtttcttgatttttatcaggttacataacattttttggagggaaggcaaatatgtagtcttcagaagactaaaaaataatgagatggctaatatgcagtcttgattcatgaatggaaatttgtggacacaggattcactaacttttgcacattaatattaatattactgctacaagaggtagaataagtgggaaaactacaaaataaattacatactttacacacacacacacacagacacaaatacagagttcctccaacttttccaaaccattaactttttaaatgactggatagagatttccaaaattcagccttgattaattgagttattgggaattggccattcatcacttgggtttcacattctaatattctggtagatagtgataagatgatatcagttttcaatttcctctatgattctttttttttttttgtatatcagtcaccaaaaagatgctcacactcatttacatcaagaaatgtaatgtgacataaaaatgtaagaaataatgccattttaaaaaaggtttgcatttccagatggggaaatcctcaaattgttgagctgaaattgaggcaaagataaaacaagaaacaaaataaacaaaactgaattcagaatattgactaattacttttctagaaagatattaggtaatgtgaagccaaaaaagtttcaatgttctttaaagaaattggccaaagtttgatgagaagcaataaaaccacaacaacgcttagtaataggcattgatttatgtttttggttaacaaaaaagtaatgtaattttattttacctaaaaaatataacatgaaatacacagcatatatcttcttttaatctttcaaaaggaaatattgaaatatcatagtcaccaagctagcctttcttgttttaaattactaaaataagaagaaaataaataggaagacataagctgaaggaaaaacaaaagaaaacaaatatttccagtttatcatttatacagctaggggcaggcagacctcctgacctaaggatgcttagattaaaagaaaatcaaggcggaaaatatttcctgagagctcattttgaatgaatagttgtcacagctcccatgtcagccatggaagagcttatggttgtcagtttcgatggaggttatgtcatttattcttttactagtcatgtaaaggataagattaggaccatgtgacaatgaatcatagattgtatactttggaggacatagtgctgtcttttaaatttttattttgattgataaatgataattacatatatttgtgggctacaatgcaatgttctgatatatgtatacattgtagggaaaagtggatggggaaaagagagatgtactgtcttttatttacaatttggatgctataaattttaatcaatagcccatgttctttacttagtttttacacaataaaattttgctaattttagcttttatagtgaagtccaaactcctaagtctgatatttaaatgtatttgtagtttggactataatactttttatatttactcattgcctttcaaactctaaactttgaatgtttgccccagaaatatcttccagatcactaactgttgtgtaccttagatatctgaaaactaggttactttggtctcttcatggctagagcttggaaactgtaacgtctgagtgtggtgaaagaagccctaggatctatccatgtctttttccataaatactaggtttgtggtcttggccaagccatgtgtcatgtctgtgctttgctcagaaaatttcgtcttgcaggaatgacactttttccctatcctatttatttaagttttaactaaaattccaggtccaaatttaattatgtaaacatcttttctgaccaccttagatgatgactatagtttttatttgttttcctattcttttaaaacctatcacttcttggattgttttaattttattttcacattcaactgactttaagtcaattaggtcgtaagttggtctagtgaaaagcctaatattcagtgtgaatatgatggtaagaaagtgaacttttaagaaaacgttgtctggttaataatcagagcttcattgaaataatagattagtatgaggaggattgtcttctttcccacgaaaaaaaattctccatttatttgggtcattttttataatgtataaaatttcatgtttctgtctgtaaataccttgcacacattttgtttatctctaggtgtcttattgtttttattgctattgtcaacaaaatgtaattatttattttaaaatgttacaataaaatgaaaatgtttcatttttaaagggatggtaagaatttttgagtattgatcacatagctagcaaacttgctaaactctcttattgcacctaaaattgtgtggattctcctgtattttctaagtataaagtcttatgatgtgtaaatattaaggtttttatttttctttcagatccttggtactttttgttttgcttatatttattttctcatttttctcactcagacctcagcacaattgttcaaagactcagtgaaaagtgtttcctcgggaatcacattaaaccaatcaatggttacattatatacacataaaatgattaatacatgtaatgacactaacagttgctaagatgtgaggaaatggagattcttatatactgctggtggaagttaaaattgttacagttgctacacagatcaatttatcagcaatcattgaagttgaggaggcacatatcttatgacttagcaattctatttctatttctaggtatgtatccttgagaaattcatgcacttgcacaagcatggtaatggttgcactatttttaatagcaaaaatatgaaacaaatctatttcagagatggattaaagaaataaagtgtggtttacacatatactaaactattccacagcagttaaaattaataaaacagatctacttttaataacatgtatacatctcaaaatcaaaatgttccataaaaagcaatattcaaatgagcagccagagatgtcacttatataaattatttaagtcacataaaactgtaatacatattgtatctcttttattggtgagtatatctacatgttaaaaatctcttcatgggaatgaaataaaccaactataggatagtgattatctctgatgaaaaataaaagtcagtaaggttgttgcctgtaatctcaacactttgggaggccaaggcaggtggatcatgaggtcaggagatcgagaccatcctggctcacacagtgaaatctcgtctctactagaaatgcaaaatattagccgggcgtggtggtgggcacctgtagtcccagctactagggaggctgaggcaagagaatggtgtgaaccccgggaggtggaacctgcagtgaacagagatcgcgccactgcactcaagcctgggcaacagagggagactccatctcaaaaaaaaaaaaaaaaattggtaagactgtaagactttagttgtagctgtaacattttatttcttaaacaaaataaacaacaaaagaaaaagacctgaaacaaatataatacaacagtaatatatattaattctagatggacatgaaagtgttcattttaccatattctatatttttctatattttcaaaatatttcagttaattctcttccctacccaaaaaatcttagtacatatacgtagcactatttaccagaatatacaacaagaagacactagaaattatctttctactatccttgacactgattaaatgttttaaattattacccccagttttagcctcaatatgaaaataaatatgagaaaaacatgacagatgatgatcaaggaatggttgaacctgtatattaacggggtcatataaaataagattaaaaatgtagaaagactttgaaagtaatcattatgcaattcttacaaggataatgtctttttttttttaataaaagaaaagaaaataggatatgagcttaatgtagctggcttagacccagcatgtaaataaacagaagccaatgtaaaatttatagagctttatttatttattcatagagtgttagaaatcatttggcccaggcattttaaacttgggattgtttaaaatgctgtgctaaagagaacatggggaagtgttaagaagcacttgaatctcctgaaatttcatacattaattgtttgaggtactttttttttttggagaggatccaaagtttttactaagttaagacatagaccaaccctttcagcttgggaacgggaaaattgaggtgggcagataaatgactcggttctgaatttataactggcacacagatgttgcaaggctttagccttctggctcagtaatttttccagtaaaaagacacagaagatcagagcaggtctaaaatatcctcaatggatttgtgagaatcacattgctggctctataagcataatcccttttttccttttttttttactctctcatccacttgactgtaagtttaatgagatttggagttggtgaggaactctgactatttcgattatggaaagactctacttcctgagtcttggtgatataatgtccatgtcaaaaggaagaaaccattcaccgtagacaattcacaatttgaacaccaactggaattttgatggcccagtgacgttaatgaagtatttacaaggtataagtatttataaagttaggctataaataaggacaaattaaaatggtgaagaaactctggaatgtgtttttggtgtgttgtacatatatatatatacacacacacacacacacacaaaagtacacccacatacacaaaaatgtgtatatatatattttacagacagtcttcctatggttcctaggctggtctcaaactcttgagctcaattgatcttcctgccttaaccccccaggtagctggaactacaagcatatgccactacacttgcctatacaagcatactttggagttctagtggccctaatttagtgcagtagccaacgacttaataatttaatgaataaaacattaatgtactagtgggacaacactctactaattcactgattatatctgctctatcacatgatgtgaatgcatgataagcctaccgtgttgcattttaaagatatgtaaggaatatacccatgtcttccaataacttgtatttcagaatagttagtgccctgaggatgcttatgacatattaattttttaaaaaagataattaatttaaaaagtaatgatggttaatattcatcaggcaatacaaatgacgaatctatctttgtacaataaaactggtattctgcttttttccccttttggtggcaagtgaaactgtcataattattaatacaatgtcagtcatataaaaatggatgttcaccatgaatggtgatgttttcctaggtaatcttcactcccatgaaatgatctttaccttttgtgcatcatttttattatcagatagaggatatgtcagcagacatattagaaaaaatattgctgacacttaaattagttttacatgtctaattaaaactcccatccaaacaaattatacataataagagttttcaatctgagttacagaagattttgtgtaaggttttctattatttttgcaggtagaagcaaatgtcatggtgaaaaatacaactcactagatgttttttaaaaatacagttctagaaagggagaagcatgaagaataaacatgagaatccaggatcaaatgacagtgggaatttttatgtcataaagtcagggatttctattagaacctttttgattagatgaatgttaaggagagctcaagatcaaggacagagcctgttattttaataacaggcatgtagggcttgaatctgaagataagtcagaaaaggcaggggcctggaaccacatccagttcagttaccaaatgtagtgtctacctcgctagtcaggtgtggcagctgaatgaaagaggtacacttgatggaaattctggaaggcaggttgtcctctgagaagttgtagcagcaggtgcctactaacagagatgtattttcaggggcagaaaaattctgtttctggatgggcagtagagtatgaagtttgagacataagtacaggagaataggtaggaaataagttactttgatcataaatctcagaggccttggagatcgccgaggtcaactccctcacttcgtagatgagggaagtgagacttgtagggactttaattatataacaaattggttaaatctcctggaattagatctcgaatttcctaacttccaggatgatattctttcactaacatcatcatttctaaaggcctctgagacggacccattctgaggatgcagaactgcttgatcagggctttccacatcctcttggatttgagagttgggaatgggcctaaaattattaattggtgttaaatcatgaaacttttaaagtaaaaggagtgcgagggaataaatactttatcactttaacactcctctcttcaacaggtggtgtctgtgttcccttgctttggatatcagcaggcggacttgtggctatagtggtgtcactgtgtgacttctcaggttaggtcataaaagacaacctagctttaatgtatattgtcttgggatgctgctttttggatccaactactacgctgtgagacagcctaagcaacccttgtaggggcccatgaaaagaggagctgaggcccttagccaatattcctggctgactcccagctaacaatctaaacctatcttcaagtcatgagtgaatcttctggaaccccattcaaaccttcaacaactaatgccacatggagcagaagtggtctgttcctcctcaaactacagatctatgagcaaaataaatgatttgttgtaagccactaagtcttgcaggcagtttgctatattggacgtagagtgcctgtttaatcaatgatagttatcagtgacaccacttactcaagagggcttcaaaaactgtttagcacacagattctattgtttttattattattttattttcaaatcttcatttttgacttgtaaatgacaagtctgtctaaatagtataatgagaaattcacatttgcagatttgtgctttctgggaccacaattgtcttatctctttgttttgtttgtttttaatcgtgaagtcagactgtgttcaagtcttaggttagccatttaaagtaggatcttggacaaattattaatctttctctgctttaattttctcagctatgaaatgaagctgataactcctttgcaggatttttagtgacagttgtacaggaagtttatttaaggattaggtaatcagcttctagagtctgacctgaatttgaattcaggtattccctcttactacttgcgtagctctaagcaagtcacttaacctctctaagacctaatttcctcatttataaaatgagtacagaatgagtgaatactaaggcagtatatttttgtgaggatgaaagaaataacacataatttgcttagcacaggatgacatacggtaaatgctcaatacatgttagctattgtttattgtttgaatgacgttagatgatgcttcaaagcatgtaaaattttttactctggtacatagtaatactcattaaagagtattgttcttctctcaacccagtctcaggaccacatggcttatccaatacattatactaaatttatattagccacaacattactcaaacatggaaacatcgcattgaaagtaagaagatggattcaaattctgaatgattttgataaatgaataaattttttaaaatggaatgcttaaatggaaatcattgattctttctgaataaaggtgaagaagagccagcagtcagtgtgggttagagagctacatattagtcagaaatgtgtttctgttaggaaaagtgccagcacatagtatttaaaatcaaagtgtcaaataattactatcactactactgtaattactacttgctattttatactagttactgttttaagctcatttaaagaaactttatcgatttatttaatcctcaagataatctaatgttgcagaggttaactttgcattatagttttctccggttaatcacaacctaggataaagaagcctcactccctagagatgggtattgacattgttgagagaatttagaagagtgcagtgaaagtggttgaagggtttgaaaataaaacatttgagggacaggttagaaaactgcaacttagcccaaagaagagaaaaataagaggtgtctaagaacagccttcaagtgtatggtgggttatgcaattgtgtgaagagagtaaccagttttcattcagtttgcctaaggacaagagcaaagaaaatgagcccaagttttagcatgaatagcagaagttagaaacaagaaaggtatttcccacagtgagaatcattgtttactaaatggtgctaatggaagagatggctttttttttcctccacttttttaaagcataagtttgttttttgttttttttttcttggcatgatactaaatggtgttctggaggaaatagaaaatctctcaatttcttttcatcttcctgagtctatgacattaatcgttacattaaaagttttataaattatgcatctccacttctaatctttaattcactgaagtctatgattattcttcactttttttttcttttttggtcattatatatcagatattcttttttgtctgcctgcgttttggtttttccatttattcatgagtagacatgtatcccaaatgtgtttccacagacataaaccttgaaggatattttttaacgtgataaaatttaaatcaatcaaatttattacatggtagcaaacaagatcaatgttcgagggagggaagacattgatcaacttagttcaaatttatttttataattctttactattcttacttttactattaaattacttatatttgtatgattctttgccatttacaaaataattatcatacacatttgatagattgtaataataatggtccctgacaaatcacacctatctatccacatttttgtgtaatctccttgtctaatgattttttttttggccatccgacttactttggccagttggatattagcaaatttgatgcaaggagaggcttgatagattcttacatgatgtgacttactctcttgacgtaggctggagaagctatgtgaagaacagaagtgcccagaaaaaaaagtccagacatgtaagtgagaacactgtgcccaaccaagcccagtagatccctctcatgactgaccacaggagagaccattaggggaatctctcagctaaacactgtccaaattgcagaatccctagttaatatatgattcttattctgatgcctatattttagggtggtttgttattgcagcaataagtaactgacatacatattgccctttgatgcccctatcaagcctatgaagaaattagggaagatattgttgcctcagttttacatatgtggaatttatggctgaaatatatgtttgctcgtagtttttcttccgctgcaatactttattaattcctccgacaggtttagaagaaaaacaaagtctaataattaatgttgtcacaacgttcttcagaaatttaaaaaaagacaaaattataaatcatgctttcaaagtcaactattattttattttatagttgaaaacatggctttagcatatttctgcttagacatctccttggtgctggagaagagttataatagctaccaccagaaaatgtatttagagaaagagagagaaaggctgagtcagggtaatatttatggatatggaaaagcagttagaactgaactaaattcactcaaaaattcttgttcacataagaaaatttcatcctcaaacgtgatctccatttcagggaaaattttgcattcttcatgctggttgccaaattgttatttcactcgctgctgtttttaaagcagagcatcgctcacagttttatcggcttatctttagccataattcacagcttccattgaagaagagataaaattttggttcatgttttattctttttcacttcctttccaaggcatggccttattattatatctgggccaagctggatgcttgaagtgactgctttttttgtgcagcaaaatgaaatgaaatgagttggttattttaactcgaaagagagcagaggcagtcaggctaatcttaaagatgtagacagtaaataatgtgatttattaggtccctgaggtctctaggacctcatgctagaatgccttcaattctttggcattttctcaggtgagtattactggcaccttctctaaccggtatcccattttctttttcctttttttctttcttggtttttttttttttttttttttttttttacacggagtctcgctctgtggcccaggcaggagtgcagtggcgcgatctccgctcactgcaagctccgcctcccgggttcatgccattctcctgactcagcctcccgagtagctgggactacaggcgtccgccaccacgcccagctaattttttgtattttttagtagagacggggtttcaccgtgttaaccaggatggtcttgatttcctgacctcgtgatctgaccgcctcggcctcccacagtgctgggattataagcatgagccaccgcgcccagcccggaatcccgttttcttataggtaaaacatctttgacaacctcttctgctttgaattccttcttctaatttcttgcccaaagtcaactcagtaaatacaataaaaacataccttgttctcaaactttagtgtacacaaggatcaccttggaaggctattaaaatatggacgtttgctctaccataaatattctattaaattaatttcctggggtgtccagaaatttattttaaaaaatatttatttttagttctttaagcactcaagtgattctgaaaacaggtagtctaaaaacacactttgtaacctcaggtctacttgcattctttttctcctgttccaactggtattattaattaacatatatgtataaaaagatattttaaggctgatgattaagaaagtgagaacaatcagtggtagagctttttgtagtgggtacaagatgagcaaatggttctgtttacagtggatttttttcccattggcaaaagcaaaatccaacagcaaaaaatgcagatagttgctgtgctctggtgtcaagaaatacttcagatatgcaatcctcctaaaataaacattactttaaaaatgaagttagcaggattctgtttatgtccaggtcagtgagtcagtccatgtgagaccacagcatgggtaactgttgatcaatgacaatccactctaagcagccactatattcccatggtgggctttcagaaatgctcattatcttgttgaattagatttttctctttaggaaatgaactcaatgctgtatgttcattttggtagctattaaaataatgtgaactgctaacaggcacacttcttttgtatcaaggttaaatcagaggtactgatgcgctgttccttcccaggctgaagaattgagaatatttgatggtgatgaatgtttcttaatgaaaatgtaaactgagaaagggaatctaagctgactttatgttttacttatataatttttttgttttaaaggtcatattgactgtaaagcttttctcatgcggaaatatggatgatctgtatagaaaggttttggcattaagatatatgtacagacaatgcacatgcataatttgggacataatattttggggcaaaatattaattataatacagctgtttttaatggatgtgattatgtcattatttcttttaaccattttgttttttaaaaaatctttgttagtccatgttttccatggtctgatgaagaatttggttatatgacagatgaaaacacaaatatgtatacatatatacagtatttgcagctgttcatagaatcctggaactttgggaagaagccaggaacacagatgcagttgtaaaatgtctttattatgtgtataggtggtagttaaaaccagtaaattatatgagatttcttagagcagagtgtaaagaaaaaagagctgaggatgagatccttgaggagttggtatttataagacaaaaagagaaaaacatctactgatgcatacttaaatgtcaatgaggtaggagagaactagttgagacagtattttgagggccaaagagaagagaaaagagaagccctaaaagtgtctgttagattttgcaagagatggtcactggtggatttggcaaaggtattttcaaaaggtactgattgtagtgagttgaagaagagttgggaaggaataagaggaaaatagagcaggttataattgcaaatttgacaaggaaagaggagagagtgtggcaatggattgggaatgttgtggtgggaacatgcagagtaaagcaaaggtattgcttcattttaaagaacgggagggactttgttgagtccttgtctagctttggtatcagggtgatactgcttcataaaattagttagggaggattccctcctccttgattttttggaacagtttcagtaggactggtaccagttcttctttgtacatctggtagaactcagttgtgaatccatctggtcctgggtttcttttgttattgttgttgggagatttttattactgattctatcttattactcattattggtctgttcagggtttatagttcttcctggttcatcttgggaggctgtatgtttccaggaatttatccatttcctctaggctttctagctggtgagcgtagttgttcataatagtctctgaatgatcttttgtgtttctgtggtatcagttgtaatttctcctttttcatttctgattgtgtttatttgaatcttttttcttggttagtccagctagtggtctatcaattttgtttatcttttcaaagaaccaaattttattttgttgatcctttttcttggtctcagtttcacttagttctattctgatttttgttatttctttttttctactagctttgggtttaggttgttctcgtttttctagttccttgaggtgcagtattaggttactgatttctgatttttcgattttttagaaaatgtaggcatttaatgctataatgttccctcttagccctgcttttgtggcatcccagatgtttcggtatgttgtgtctctattttcatgtattttgaaaatcttttaaatttggtgttattgtaggctgtagaggaggttatagtggacagaaaggttaaatataccaagaaaaaaaggataatagagctgagtgtttgacatatttgtcttaggtggagggaaatttttctctgacattagagaaaaggagttggtaagtgtggtgtgcataacacagaattatcaggtcttcctcagtagattacagacttgtcaaaggggaaaaccatgctaaattagaatatggccatgctctgggtacacatagagtgacattatacatagcacacaattaaagattagaaatattgacttataatgaaactgtattattataaatatctaagttagggcataggtatgaagaaatgagtgggtagagatcaaatctattgtaatagtcaccaattcgatgacatgtggaacaaagaggtaaggctgtttttcacagaaccaatgtagaatgttcttatactttctatctttgattgtcaataataagctttcactaaaagttctggaattatcagattttgcggtaacatcaatattatctactagtttgtagattcctacttggactaaaaatatttgtcttcaaaacaatgtctgaagtttgaatataagcatgtatttatttatctatctatctcttatattttctctggaaataatttaagggcatcattaatattaggaaagttggatttttagtctgcatgcagtatgtatttgaatgtacaactggaataacacagatctgccctgtagcaaagagagacacattaatttaactaccatcattatcacattcacacagagctgtgaacttgtgatggtcagggattcagtggcttttttttttcattttacatttttgccagaaacaagcacttggaatgttgcctaatgaaccctgctattctccatctgctttgtcctgaacttattcacatttgctatgtaactgtggatagggattctgaaaggaacaggaatttgtaaccctgggccataagaatcaataaaatcttggcttagtgacttgggctatgtaacatttgagagtataaatacgaaaatattttgtatttatttaaagtaaaaatgatctgatattgattatgaatgggtttactaaaagccgttcctttctgtgagtgtaattataattatataaagcctgtttaatcagactagctatggagataatcagactagctatggagataatcagactagctatggagaagcataatatgaatcagaattttagagcatttaaaacaaatatgattttattacttgcaaatgcacattgtattttatattaggctgaaagtgttttctaagagtaggctttaagatacttactctaagtataattttgtcgttcattatctatgaatagatatttccagaaagactgaagactattttaaaagcattttttatcttagaggcttgcagaatccactctaactctaacccaacatttcatggatctatgaaaggagaataataacttctttttttttttggtaggtctgtggataggatagtggtatatcaaaacttctttcaggactgaacttacacacttaatcaatttaatttatcacaaagatatctctgcttattttcctgaaatttcaatatgacgtttaaaataataatttctgttcaattgaactgtattgtttttgtttcagagataaatatcatgccttttgtgttataaagaagcatgcacatatgtattaatcatgtgcttttacagtatgagtagaatcacaacataattatatccttgtagtatcaaaatattctattcaacaactattcacttaatgcctattataggcagttcactatgctttaatttttttaactttttttattatattttaagtactatgctctaattttagctatacatatttaagtggaaaataactgacctgtcgggtgactctgacatttgcccaggtgtattttaattatcactggataccataatagatagattgcttttcatttgtgtgacatgttttgtttcatgttttcagacatgttgtatatcagaatacaattttgagaaatgtagaattaatcagtcaatgcctcctgatatgtgctcttatatcctcctacccctaccagttgccacttttttcttccttttccttcttcatctttttttcgtgtatctttattaactgttcatccctgttattctatttaaagcaagaccgtgtctgtttgtttcatcactctcttgttactgcctagcccagtttgcacaggatatatgttctataagatactaaatgaatgaattcccatctcatcaaagaatgaattacatatattgcatctgcatataaggcctagattctctatttttatataataaatttcaaaaactatatcagacttagtgaaatctgaaagttaaattttgccattttattcatgtaaggccactcttatgaaatgccactgctaaatagtaaaaattttatatatggtttgggcttgagggttcaggatcatgctaagatatttgacttaattggaatcacttgccaagtttttcctaaattcttaacccatctataaaaaacttaaattaaaatccttggttataggtagctaattgttttttttttcagttctgtagtattgttttccttttaaaatttttatggatacataatagttttatatatttacgggatatatgtgatacattgttacaagcatacaatttgtaatgatcaaatttgggtaatccataacctcaaatattttatcatcttttttgttgaggatattccaaatcttttagctattttgaaatatacagtaaactattgttaactatagtcttcccattgtgctatcaaacactagatcttattgcttctaactgtatcttgaatccattaaccaaactctctttattgccctactctacaagtagctaattattaaaataattattaaatatttggtttctggagaaaaactagggtataatagagttgataaagtctatcatcgatttttatagtcactttatctgtctttagtaatccagaatttatagtgattcaagattcgaagcaaccttgcacgctaattcatcaaccagaggatgtaaatgtaaagatgagaggtagtcagtaaggaatgaatgaaagcagtgtcgagcagcaacaataatccagtgaaatgtagggaacctggagtagtagtggagctgtcattaaatgcagtttacatttcttcagtagtgttatagaatcacttaaatttgatttaatcaatcaattttaagacatacaaatgtatcactatgaaaaattattaatcatgtaagaaaatacaccataaaaccctttattttgtattgagagtttgcatcctttatataatttgattctcttaacaaatcagagaaagatgggctagagaaagccaaagaaggagctatgactacaaccaaggtttcttctcaaaagttgcaattttgccaacaatatgtttcaccttaacatgtgtccttgccctaaaatccctggtattcatgaattttgttttgttccaatagttttatagtaaaaattgtcaagcatacaaaaatattgaaagaatgttacagtgaacatccataaacccatggcctcaattctggcattaacactatattatgcttgctcttgcacatatctattcatttaactaactttatttctattaatcaatccacttatttttggtacattgcaaaatacattgcaaagtagctaaaatatacatccagctagatatttccacaaatacatttgattttcaatagaaatagctaatttttttatatttattataaatatcatataccaagcactatgcaaagctcattacctgcagtatctcactgatagcccccaaaaggctatgaggggtatattgcttttattaattcacctttccaagtgaaactacaaaaccttaaagtggaagcttgactttctcaacattatactcagctgtaaaatttgaccaacttgtgtaaaattagtaaattttctgattttagagacaaggcttctccattagttttctgtggctactgtaacaaattaacacaatcttcgtggtttaaaataacatccatttattatctcacagttttgtggggcagaagtccacgcaaagctggctcaacggtattccttcctgaaggttttgcagggctgaaatcagagtgtcacctgggctgtgttcctgtctctaggagagattctaccgtgaagctcattcagatgttggatgaattcagttctttgtgcctgtagaactgaggtccctctttccttactagctgtcagagggccatcttcactcctacagggcctgacttccttgttatgcttcctgggtagccccctccagcaacaatgtgttgagttcttctcatcctttgaatttttttaacttttctttctgccacatctctctaccaccagccagagaaaatgctctgcatttaggggctcatctattagattgaacccacccagataatccaggataatctccctatttaatgtccataaccttaattatatttgcaaaatcccttttgacatgtaacataacaaattcacaagtctgaggacattatttgagggcccattctgcctactgctataagccactgctttcagtagttctttagttttaagatcatccaacaattttttaaaagcatgcttttgctaagtgtaaggaataaataatgtaattactatttgagaataagatctatcataaattattataaagttcatatgtacttttttgatttctgggtagattttgaaaggcaaatttcaagatgccagtaaaaaatgtagtcatctttcctgtgaaatattttcttctttatgctttgagtcactttgtaattagttaaggcattttcgctgacgtgttacagcatgtatgtgaaaatttatgatcatctagttttgtttattttggtggataatttgcaaagtaccatgactactcccaagcctcaggccttttctcaacatatgtttattctagttatatcccaaagggtattctacacatcattgcattggtgcacccaaacaggaggcgtaacagatgggattgatttgtctgtgaatggcagatgttggtcattcactcaggattgccagtgagctgatatggattacagggtagactaaatctgagcttccctatctgtctttcctgcctcattttaccatgcccatgtgcattgtttttttttttttttattactaggagtcctttcacaatatgtgaaaacttctgtatgattttaaaatgtgtatatacccaagtcaaataaaaaatccttgtcctcacaaatacggataacctgtgattttaatatccacctgatggaaatgaatttgctgttaaccacacccttataataatttcttattgatgtgttcatcactttctatgttataataatttctgtagcctcattcagagcatgatttaggttttattcatctttacaaccgtaacatttcctattactggtgctagcataaagcttagttacaccattcattcatttgtttattttatatagagctatgttgtgttgtgttatgtagtttaggccctgggatgagagagataaatagaaaacagattctcaaaaaagcttatggactggtagaaaataaaaccatgtacataaattattattatgccattataaatgttataattgagagtatgaaagaaacatagaggagacagacctaatggaggatgaagaattgaaagagatataaatacatgtgtgtgtatatgtacgtgtgtgtgcatctttataaaattatatgaaataagactcaaaatgtgttatgattagtttctaatctctttgggaaattatacatagatagtttttagattggggtacaggacctgttttggaatatcaccttagaaccaattaggacagttccctacacttaaaacatggcaggtgaccctgaagggtaaacagaaaaagaactattttgtagattgaataaaggctggcatattatgggtactatacagaattcaggtagtgttatatggacctaataatctttaggaaactattcatgagatttctttttgcatgtttctttagatacttatcaagtcaaccacatacctaaattgccatgctgccataaatttctcagccttctaaaatggattaaactacagtaaagtcataggcattgcatcatttcatgaatgtcttattggtatactgattattatgggcattcagattgttttgtttctagcactctccatctccatttttttttgcgtgatatccacatcatgaaagagatttcagaaaatcattttatttcttcacccagtacagtttctactttctcatctcactttactcaatttcaacttgtgtatatgaaatacttcttgtatgccaagtattgtggtatgcactgacaaaggaaccaaaagaatacacacacagccctgtgtgtttacaaagctagacacacagccctacctttaaggaagttagaacgaacaagataagatttaagcaccaatgaaagcacaatgtgtacttaatacttagcacttggtacactgaatggtagggaagttacgagctcaataaaagccattttatccataaaatataaatcactggatgtttgttaatttattaccaggctaactggcaatcatggtagagttggttgagggggcaactcttctgcagcctgttagcgtcatggcaccccggctccctggctgtgcaatgtacttgaggactagttcatctggtggttagtttgtttgcgctgatctgccactgttcctttgcccttgataccataacccgtctttataagacagtagcttgagaggagttagggatgaaatgtataaccaagtgatagagcaactattactagctgacaaggatttcaagttggcaccctggtaacctcattatgaaccatgctttaaatggctatttggcctgtttctccaacatgaaagtatcttggcttgtgaaagtcagtaaagaatatgttcctatttggtgacagcctgaccttagtttcagggatcaatatcaattgaaatgctgagaagcatgaagccattgcatctgattagcatgtgagaggctaattgcatcttctctagagaaaacatgggaataaatgaagcatgaatcaagagacaatggggctcaccactggtgattatatgattgtatgcatttctccatccctcctatatgaaattaatgagtttaaagcttaacctttttttttgactaacataaccaggcagtgaaaaccattctgaagcttaaatatctgttttttttcctgttgtaggatttgaagaacaaaaccctaagtatgattttcttttcttctgaacagaggagattgggtatggcttgtataaatgtaaaaatctaaaaatcctgatgtgcaaatatgctctgctgtctttgggaacaaagaattttttgacccgttttgttttatttaatcccttctttgagtaggttcttacagttaaaactatgactttaattctccaagtattgttttttataacaatatttaataggagtatttgctgactcggtatgttaactaattttgtaaattgggtgttggaatcacgaaataatgagtaatttttggaggtccacatatgctaatgcaaacttcttgctctttcctggtaggtttttaaagcatatggggatgtgaggctggccagttaagaatttacacctccaatttttacactgctttggtcatggacaattttctgcagaaataaggcttatttagatatttaaaataatttcattttatgttgaatatatttctacttctgagtgaatataatagatttccattgtgggccatagagaattacatataatttgagttattatttttcattgtataattttgtgattattacatggaagatttttctttatcattgccattctcatttgaaatctattatgtgaatattttcaggtttaagatattataataagaaaagtagattcatttggagaaaaagtaatagaaaatagattgcagaggtagtctggtaataagatttttccacaatattgcaactgaaactgggaaatcctgttacattactagatattttcattgctatgacactttaatattaaagaagatgttcatcattatgacctttattagtggttgtggtgtgatgctctttcttagcttggagaaaagtctccactatgtatttttatatggctacagcctttgtacaggtaaaaaccatgacacattttgtgtctctttcacctgcctcctcattttagagaaagaactgtttgctgccccacatttacttatctaccaagtctagtttttattcttctcagttctaaggtcaatgcctttatttgcctcctggccctcttgaagctgttcagtttggcaatgggagtctacatgttttgcttacctgatcaaactagttcccttcccttcccttttatttatattttcaactgacatgttcaattatttattaattccaatcactagaatgaaataatacagactattgagactgcctgttgtctccgtagttccataaagccataggcaattttccttaaatatcaacctcctttttctcttcttgtcagcagctaagaactgacctttttctctgaaagcaagtgagggatcctgtaattttcaatgttgcttgaatttaatttgagctacattttcaactagcaccgtcatgtaactactaattctcgctttgttaaaatgtgacttttgcaacagtacagagattgttacagactgtattctgttatttccaccttgagttcccattcataactctttgagacaagtgccaaacccaaaacactaactgagacaaactagaaagcaaagatttttagaaatacacaatacattaactagaccagggcacatttaacacagcactgttttagtaggcatgatggaaagctcgaagcttttcgattattatacgtaagtttttcttttaatatgccagtgtcatgcctggaaaattacagataaaagagttggctctataccatgtgatttaagaaccctaggaagtccttcctgccccaaatgcttttctaaaggcgtgtttctaattttctttactgctagaataatatttgtataacaaatatcttatcctgaatgttcttgtttataacttttgatgggaccctatagtgtttaagataagatttaaaatcttaagcttaacccatgagacccttcattttcagactcatctttgtgccagaacgattctgaatgtcttgttgttccttccacgtctcatgctatttctaccttctttataaactcctaagtgcctggaacattctccccctcttattaactgccctttgtttccataacatcctgtggaaatcctctttttataatttatcacactatactgtaatcaatagtgtttttaagttttctgttacataaaatccttagggatataaaaatgctttattcaagttgtattcttagcaccttgtacagtgtctgacacattgtaggtagtttagtaaaaatttgttgagtaaatatgtgcgtgaataaagagatttcaatgttgaaaaattcattttcttatttaaaagacatagtttaccatgttattctttttaaaaatgcaaatattatcagggagataacacattaactgactattagttttaccatcttcaatgtagcaaacatgcatttgaaagtaattcatgtcgccctaggttatgctataaagacaaatttgtttactgctttgtgtagtagtaagcacatgagattgagagaagagagactcgggttttttagttttgctcataagctcatcagatatccatcttctggatcttttgttcttagttacctcattgtttaaaagaaagaaaataatatttatagtatggtgttattataaaaaatgagataatatatattaaattgctttataaattcaaaggataatagtcaaacagaattttatatttgaccacttgattccccaatggatgagcctaggtgagagagcccagaattctgatgaggaatgaggaagagagatgaattcagtttgaaggtgtgatccagtaatctgagtgtatatagtttgataatggtacacatgaaaaagaaaagggaatccaaaaggtgagtttggcacgtaaattggcaatgaccatgaaatgtacttcacaattcttctcatgactgaccctacaaattctaatagtgctagctaattacctcgcaaaaagtgatatgaaaacagaaggcatagcgcaatgtctcatattcagaatgatcactttgtgaagtagaaatatccaaacatgaaagatttcaccattccataaggatatgcaaatagagcagttaagacacccatctgctcctctgtttctcacttggtttggatcttctgctgaaaaaacacagttgattaattttaattgtgggtatattgaaaagtttctattaaaaagaatgacagtataatcatgtggtcctaatcattggttcataagtcaaaagcggtttgtctaattttgattcgagtttaagacctagagattattttcaaaatctgtatttgtgcttttgtatacttttttgatctatttattatccacccttgtgaacaaattggtacaggagaatggtagcctcatgagttttctagttggtataattattcccagtcacggtagaacatgtgtcagtcatctgaacctatttgatgttctttgcctgcttggttaccatttttgcccagaaactttgattaatttttttttgagacggagtctcagtgtgtagcccaggctggagtgcagtggtgcgatcttggctcacttcaagctccgcctcctgggttcacgccattctcctgcttcagcctcccgcatagctaggactacaggcacccgccacaacgcccggctaattttttttgtatttttagtagagacggggtttcaccgtgttagccaagatggtctcgatctcctgacctcgtgatccacccgcctcgacctcccaaagtgctgggattacaggcgtgagccaccgcgcccggccgataaattcttattaaggtatactccacacaatgaagataaagaaacaagctaagaaagtaagaaatatatcaagaatgataaattttggtgggaagattataaacttttgtacagaatgttataaccactaataagaaagcaaattttttaaaaaaattttaaattttatgagtctggtagcacattgagatttaatcacaatggcttgaatttatatcttaatccttctttaatgtatataaaacatctttatcttcaaagactcacctgtgccatggcttatttctgcagaatcatacatctgcgagggatatccagagcccattattttgtttctctgtatgactgcatacttaaataatctcagactcttaatccttaataacccattaaagcatattaaaagtcctctctaccaagagttcatgtttttatatcattaaatccctgttattgcaatcggccttagtgaaagtattaaacagctggttagctgctgggtagtaaattttcatagagctaaagattttgatcaagtaaacctggagccttttaactttaaaaaacatacagtgtaaaggtgtttaggggtgaacaaatcccctagattaatcatatgtctgttcttctttgaagcataaacattgatctgcagaggacagattgctttttcctctggagttatatacaatgtaaaaatttatttagggaaagcaagtggcttcagcacatacagaaccaaaccctgaacacagaagatcaagtttcatgcaggaagatttgaacgctttgaccttttttaagaaatgtggtgagtttttttaagttattttaggtaaaattttatttgcttgattagatgaatggggaacatataagattttagaaatcgtagtgttgattgaagaatggctgcactgtgttgcaaaagtggtattcaattttggcttttgacaacctttggagaacttcctctataaccaatgtatagagttttggctgattttgaagtttctcctgttttctttgattctgtgtaatgctcactgatccctggggttcctaagagaatcaggtctccaagttttccaccgtggtaggaaaaaattaaagaagagaagatagtaggatggtgcatacctcagttgtggtggtatactcagactatactgggttgtactctattggtttagaatcaggacgataaagtttgtcctcagacacatttgggatgttccctaggaaaaaggagagaggatgttgctctattggtttccttgacagaatgaataattagggaagataacatagggcagaattaagggttagaaactgcctgttcagttctaaaggaggcatttgggaaagtggttgcttaggatgacgggtggataccaaactgtttgttttgctcttctccttaagtgtatttttaaaacatttaattagaagagaagtattttattgtatctatttttatgctattaagaatagaactggtttcaagcaatactcaacttagatttacatatcattaattctaagccaattaaactagctgagtctttaggcttaatctatgcagtaaaaacttccttgaaaacaattattttttcatgcatgtctcttctgtacctgattttgaagctgaaacttaaagtggcatcttaaatttatgtaatgaaattagagaaaaatcatcttttaaaggcctatattccaatctttatttcattttatttatttatttttaaataaaatttgtacttactttttaaaggaatatatttaatttagcgtaattatttgatctggttagatacagattttatttcacttagaattagctaaaaactcaatttaaacaatataaaagtggataaaatagccttgtaaattatcaaggcagattggcataagacctgaattaaataaaatagtctcttgtgaaaataaaactaagttacaaagaatatgttgttttggtaaaattataacctttaccactttctgatatcttttccgctttccgatttttactagtatctgatgtttcaatatacagccttagcaaatactagatgataatgaatatttcatagatgaacaaaaacatgtttgtacttgctggtttgctttgatgtcttttaattgtaatagtctttatttgccctaacagaccaactacgaaaattctataatagattttcatatgctttgacatgattttctttgattctaaagccatgtggaggagatgaattctactttccttatcttaaatgtaggactacggatcagttcataggattaatgaatgtctaagatcacatattcatagatgggaagagttaggactttagccttactctttgatctccaattctgtgctgctttgattatatgctcattcttatgttactcacctacatgagttctgaaatgggctcttctctttctaccttataaatagtgctgggactcagtttctttgtgaaatgggaattatagtgcctactcataagacagttgtgatatttgaatggccaattttggagggtacctcctgtcatgcctggtacaaaacagctcccatttcccttctccccaacacaaacaaatgaactctgttgtccatggatctataagagggcagagatgtctccactgttcttgtaagaggactgagagttttgtcttggtggtagtggatgttgacctgtgatttctccagatggtccttctctttccttgttccattcttctaagtactttggctaggtcactgtatggtctaataggtaagtggtgtcagcagtggcctccaagtgaggattcctatcactcacacttgacactgagtccactgagtcagtgttcaagaagctgataaccaagagttctgcattcttgaacttgcagagatctttgggaaaactcagtaataaaaagggcctcacttttcttttctgtaaagtagaggtggtcaaggatcatggtgaatgccagaaacagaatggagaactttgctctgatattacaattgagctgacaagtgaataacactcactttaatctatccaatatgcccatgggaatgattgcttctattccataggaaatttcaaaagaaacaggacttagctctctctgcacagctgcagagtatctgaatcacatgctgaatattaacccaactaatacaacattctgctttcaatagctaatcaaaatgcacaattaaacaaaaaagagtgattatggtcctgtgacaaaggcaatcacttcctcagggaaacttccttttctgcctcccacccctatatttattttcctagctcatatgaaaacttacattttctagttatgtgtgtgattacttgtttagtatccattccttcttgagggcagagatcatgcctatttttcactgtattgtctttagtgcttcacactatgcttggccctgtgctcactaattgcagaatgaaaaagaggacttagcaaattgtcctaaatcagctgacattggaagacagaatgcttggtttctttatgagacccaaaagggaaaatttgaaaacaaagcagctgtaattaacaggaaattcattgaaatcaaatatgtatttaagagccaagtcaggaattcaatagcactgatcatgaatattcgtagcattaggaaataggagtgagataaactgagaactggaaacattgtaagggttaggaatggaaacacagagggtaccaaggccagtcctagcatcatggataccgtggtccagagagagctgtatacagacactgtgcaaatggtggctattggaaagttgccctatattggttgcagagggaaatgaaatggggatacaatatagttacatctgttattaaaaaatgtatagggttaagtcttttgttgattcatactcagagctctcacttaaggaaaaagtattgcaatggaaaaagaaatgaaaagatgtaagctgctaataatcaagagtacaatctcaaggccctctgcaaaacatactatggagcccctctcaaataattcccatatctcttcttacaagaaacacttactaaggtccagcaactgcctttcctgggagggtaattaataatcacatgccaaggagtcttttgtaagagcctctccttgttgccagagtcttccatcaattttagcacttctgtgtcagggacaggatattcttttcatggctttggcttcagttgtgatcttactccaagcagcttcagaagttcaagagtgctagtccctaggatttagagatagcatatggattttttccagcagtataaagaactggctgggcttaagaaatggcattacaaagaaatgctgctatgtgcaataccagctgtaaatcttgccagatttagaatatagggttgtggtatgccagcagcggggagtctatgactcctggttcaaggccagggcaggaggctttctgccaagcctcaatgccaagatgcccaggaatctgtctgtggtctatactgcaacataaatcagttgtgaatattgacaagacactgtagctataccgtggaatctctgcaactattaaaatgatagagtatttggggataatggaaaacgtgttgttctatattccccttaaatgcaaatgactagaaatatcaaactgaagctcatgagagacttagccttctgttttattcattctgtatttattgcatttgaatccccagtcttatattaattataagcgagatggagatgatgggctggaaatcctcttcgaaagctttatgcagagcatgataactctttgattcacattttgccggatttggttttatagttgtattctaaagataatcagaattattatcagatataatcagatatctttattcagttgaaagggtcatctgtttcttaaactaccatgtatttagttactgttgttgaccaaaatattacactaaactttttgcttatgttgtcttaattctcaaagaaaatctttgtggtggaggttgttattaccattttatatatgaggaaactgaaaactttcagatacggaaagctttccaagtgaaggagcagagttggtgcacagaacaacctcaaagcctatgcagtctaccctggacctatgcagctctctggggcaagagtctttactaaatgcaaacaatgcagaatgatagaagtaacatgaccttgaaagttgaactggtttcaaattctggcccacttcacccgttatggttaagttttcatggttaagtcaccagtttctctgaatatgtttattcatctgaataatgaagataacaattattataatattatattacagtgttattttgaggatcatgtgagacattgtaagggaaagcacttaactaacccttttcacgatctctactagagagaaaatatccaccttcctagcagtgattagttttgggcaaagccacattttaaacaaaacctacattttgaagttacctatgaatgcttcatttggcagcctctgcatgctgtttttgttatattcctgaaaacaagagtgagcagcctcagatcccagtctgtcagttaccccattgtgtataatattaatctatttgacagggccattttgtgaaaaggaaatgacttaaaggataccatggaagggggtattcagcaaacacattccatgtaccatttcaattaattggttcgttgttttattctttgtaatttcagtgtcccactatgatttagatggattctcaccaggcctgttaacttaccatggagttgatcaaaagtaaggtgtaggcatcatacttgttttgtaagcaaatttctccttttccagtgtagtttcctctgcctataaaccgtgaaagcataaaattcagggatgtcagatttaatctctattatattctgtccggttagatgttctgtctcttacagtggtagaaagggatataatacaaaacatagtctctctcctggattactgcactaaatccttaaccgatttttctgtcactttgttacctcacttactccatattagctgcattaagttttctaaagtttaaattaaatctcactgcttcccttcttaactagaataaaatctgttttctttaccatgacctctaatgcccagcctttccttctgacttcttcctaaaaactactgcttcctcacagcattctggccccactggtcttctttctgctctttgccagcatgcttcaggtcttgagctttgactttcttctgcttgtaatgcttgtcctaattcttacatgacagccctcagcaatgaggttgaaattttcactctttagaggggcttgtcccaagtacattatataaacctgccacccaccttattgtcttcattttgctaatttgtaatatctgaagttatttaaatttatttgtttacctgctattatctgtttctctccattgaaatgttagctattctgtagtatcgtgcatgtattgttctcagctgtacccttgaagtctggctcattgtaggttattctgtaatggtgctcagtatatgctcatttaactgaaagaccttaattaagtcacttatactctctgagacttggcttcttgatttgtctaaatgagattgtaatttctgctctatctaaattttagagatgttgtgaagctctaaaaatgccattgcttacctttgaaggccttgtgttaggactgagttacaaaaatgaaggatgagtcttgttttgagacagtccagcatgatggggtagggacatacatagacaaataattttaacatatattgattactatgcaggatgactgagttgtacaactccaggggaccaatttgtggtatgggtgagtagtaacctctttagttgtgtaatgcccaaacttcattgccctaaattatggcatgcattcttttaaacacttttaagtattacctcatatgatcttcgtttaaaaacagatgaagaaggcattatagtttccatatttacatgccattataaatgttaaagagtgtgtatatgctattatatattattagaataaatatgtgtaatatattattatttaattgatttaaactttaactattgccctctccaccttatccttccaaacctaagagttctaatatttgagtttgctcttatgtattgctaatttctttttcttaaaaaattccctgaatactctctacctttgttaaggagtaagtaatgatgaaaactgtagcgaagtgactgggatgtggaaaaatagcttttgactataaagccatttattggactcttcgagactacccatgagactaacaattgctacaaaagaaagtcagtgttgcagtctttttggggggacagttgttttatagaaaatttatgtaaattgtctgctatcccattggtggttgtagtcaagataataaaagaaatgcaggaccagcctgttgacagtgcagcttgtattttttccagattttctcctttatatattttgaaaggagcaggcaaaatgaattcaaaacaaaacttctcaaagcgtcggaaagcataaaaaacagtaagcctttaaacccagaagcttctcagtgtacagagacaaatgtataattaaatctggaagttatttctttctttttgtcttctctttcctttattttttttttaaaccacaatgcaagaaagcccaattactggtgataatgagagtcagggagtaactgtgcccaaaacagaagaaaaaaaatgtgttgctatgtgaatggaatcgtaggaagaacaattgtaagggaagctttcttatgctagactggaaatgatagctagagcagatgagatgctaccctttaaagtgagatgatgaacgcaaagctgttttctttggaggcaggtgggcagcagggaattagttgcatcaaccatgagttgcagatatgtgtgtgttggcccgggggaggagggtcagcatatggtgtccgttaagaagggtgggtacaggctacaggctgagactgccaggacagagaatgttgggaatggcatcgttttaatcagcctttcctatgtgacccttttgttctacttttaaatgtccttttgttatttagtgatctgaatttcaagatacaatatcatgttttgtcttttatttccactgctcctatttagctatttttaaatgttgttttgctattatagtatcttcctctattggaatatgtatattcagccagttttctcagaatgttcatttcatttgaatctgaataagaaaataatgttatgtgaattggaaggagaattaataacagcaatttttagtagctgcttttatagtcttctttctggagtctaatcgtatttcccttaactttattattattattttaataataacaattccaacaatatcactaagagtacattttcttctgatattctctttgaggcagagtatgagatttcccagctgagttcagctgtctttctggttcccttcggaccctcctttgaaacatgtaaattcaggtcctgcaaccgtctttggaattcattgcttgatgaccctcaaatggtgatgctgaaccattttgtgctccctttgtaaaggtataatcccctgatctttggttgctgcaaaatgcatacaacatttttattgaaattagatgggtttatgctgaaaacctatcactttaaaaatataaagcacaaggttccttgacaggccagtcacttagtatttattcggcactgttccaggcactgcagggagctcaagaaaaaataaattatagttgctgcgctcaagcaacctgtaatttccttgagtagtttaaataaatgcattcaaagcagggagtccagagatgagtttcaggtatgcacaatattgtaattatattcattattttggggggagggtgtccagagctctcattcttaataattttgtttcttaaataattttgtttaaataattaaataattttgtttaaaaaaagatacgaagaatcacacaagtagagaaataaataggtacaaatctctgcaattctgattccaagtgtaccagtttagagaagatgcattgacgtgacctgaactaattcggaaaagtattctaacatgctagcccctgaagactttgatatgcagaggagaagatgaacagaattcctggcaaaagcactaataatcatctggctcccaaacttggtaacgagacatgggacaaactttgtttttgatatgggagcataaataaataagtaaataaacaaaatgaagtagatgaaatttagagttattcaaaacagagtacagattttggatttgccatttaatagatgtatgatcagcatctctcagaagctcagcttcttcatctgtaaaattgaataaccatgcctacctcatagaagtatcgtgaagataaaatcagataatgtgtggaaggattactggctgagatcctggttcagattagaagtttcataagtatcagttttctcttttagattctaagtgcaatgacatttggtacagatcacagtaagtgaatacagagctagtcatcaaaagtagaagttgggcagggcgcggtggctcacgcttgtaatcccagcactttgggaggcccaggcgggtggatcacgaggtcaggagatcgagaccatcctggctaacacggtgaaacccagtctctactaaaaatacaaaaaattagccgggcgtggtggcgggcgcctgtagtcccagctattcggcaggtgaggcaggagaatggcgtgaaccccggggggcggagcctgcagtgagccgagatcgcgccactgcactccagcctgggtgacagcgagatcccttctcaaaaaaaaaaaaaaaaaaaaaaaaaaagtagaagttgaatgttgactggagcttttggagaaaggactaaggcaacacaaataactccgtgtattctaaaagacggcaggagtttgaaggcattttagggagagaactataaaatagtatgatgtgaagtagtatttgtgaacctcagtgaggaccccaggtcctttgcacatgtgtggaggaaggctcagttccttacatcactcaggctttgatcaactgctacttctttgggttgtaattcccataactgtagtaacatcttctaacatttcctttccccgatatatttttctttatagcccttactcgtagcagcagaacattacagaatacaggctcagggggccaagacttaaaggaggccaagacgtagtccattttgcttaccactatgtctctgttactagcatagtgcttggtatttattagatgttacatatatatttgtcaagtaaatgaataatgcctgcaagatgtttggaaacaagaacccaccatatttgctgatagatttgctatagggtacaaaatgaaggaagcgtccaacctagcaactgtctgtaatctaatttttaattttagatattttttgtttagcgatagcttttattaaaatatacctatccataattgtttctgggtctgtaagccaaaaagtcaaaagcactctcatgttggttgaatattttatagattccaacagattttgagagtcattccacttcaaattaaaaatttagttgaataaaattaaagtataaattagattaattaaattttctgagtcttcttttgatttatctgaagctatggtctatgacattaaactttcaataacaatgtgtgtgtgtgtatatatgtgtatgtgtgtttctttgggtaaagatataggcttacaaataaataagccgtaattaagctggattctaattgaagacaaaactcttttttttccctggagagattgaaagtggcctgaaactctgtgtggtagtatcagcacagtattcttacaatccacggctgaaggacagaccaatgccctgtaaaggacatggacaagactgcacttcagaatcaagatacaaaatagataagaggttctactcccctgtttctctacctatattgtgagcttgcaaagatggacttctgagatttaattgacagtttcttatagtgggcagcccatgtgttcttagtctctctaaactccatttgaagagagggtgggtatgacatttggaggtgttggtatggaggctggattgcagaatgggcatgttaacaggccagaattctgacacaggatggtattattcctttataaatataaacctacatgtaagaatattttgaacgatgatactgaagagaattctctattttcattttccttttatttttttctgaaaattacaggaggaaatagtggttttaaagttctaatggtcagaaactacatatttaaatgactgatatatgtgaatcaaggttgagaattcagctttcaagagatagtattgaggtcttttattatgaaacttaagtatgtttaccttactggtccaaatcgcttgatatgaacattgtgattagttagtacattaattttaaagcatttgcatttgtcaaatgatagaccccattatgtatatatcttcactttgaacattccagatgttcaaatgttggcagatatataataacaagcatcagtttctagcctacaagatgcttctcacttttgatgtcttctgaattatgttagattacttattgcttatcctttgagttacattgtaaattaaattcaagtttcctggttaaactacatttattttgccttgcatagatttgagaatttttatgaagttccattttcatattatttgaacatcaaggcaatgctgattgtcaagaaaagactgaatatttgcctaccgtaggcaattgtaaagtggcacctcctatattttaaagtttttagttttggcatggtgactttttaatcagtgtttatcctttgtatggttactattaattcaaaagtaatgtacttaatatgtctattagattattggtttctttaagctcaattatatggattttatgtattttgatggcttgttacattttttggtagctgattgggcctaaattttgggaatatttcttactaatacagttcaggcttaaatttatcaattcaggaacattttggtcttacagaaaaatgaagacagcaagtagaaatgtgcagcttatgagttaagaaaggaaatactggatcagataaataagtaaaaagaagtaaatggagagaatagggacgcagtataattttttagataagataaaataaaaatggagtgactagacctcagaaagtgataacacacagaggcagggaaattgtaggaagagttaagaaaaaaagcacagaacttttgaagatttaaaatttcttctgcttcttagaagtccttgaaactaaatgtaatcttcagtggtgctatcaaggaggaattatctttatacttaattcagataactcaacttcaactgaaatatttttttctttatatttaatagttggagaataatttgtgaattctgaatgtttcataagcatagagtagaactgtaactcttcttaaaatgttagtaatcttttgggctaacttatcttttatttttgtatttttcacattatataaagtgatagataaattatagttaacaaaaaataaattgtaacagacattttgtattttaattaaaaagatatttaaaaattatttacagatacaaaatctagtataaactgcatagagtatttgttatttttattgaattttttcctattgaattttattgagttttcttcattttttaatagaatatcttttcttaatcaatgagaatatttaaaaattattgaatttttcacacaacactggtggaatagcttgttgaagaaactttaaaaataaaatcactgtgttagctgtttatatgtgctgtaattctctgtgttcataaaggaagataatatcttagtgtgcatgtattcttcacccttccttcatcctcttctagtctatcgattttgaggagatagcttaatatttttagtttcagacattacattttctattttaatgcatggcttcggatgttaagaatacttaatgaaaatgtcaaaacttggcaattttcagcagaaactcatatattattggtaccaataaaaattggagaaaaaaatcactttgaaaaaaaataaacatttggtatcaccttgtaaaaaggatacttattgatatacaataagtcagtatatttaattctactctttggcatattctttagagaaactctttcaccaggaaatgtgtacacaattgttcataatgataccgtttgtaactggtaaccaccaatgttctcttagaggaaaatggataagcagtgcaatgggttcacgcaatagattgttaatagaaaaatagaaaacttaaaatagaaaaacagaaaacttaatgtctgaaatcaaaaatattaaactatctcctcaaaatctacagactagaagaggatgaagggagggtgaagaatacatgcactctaacatattatcttcctttatgaacacagagaattacagcacatataaacagctaacacagtgattttacttttaaagtttcttcaactagctattccaccagcattgtgtgaaaaatttgataatttttaaacattctcattgattaagtgaaggcaaatcatctataaaaatggatttcatggacatattattgcattaaaagtaagttccataaaattgtatatagtctaatgacagtttttataaatatcaaaaacaagaataacaaagcgtatttttaagatgcataaattcagggaaaacaagagaattttagtggccacttcctgtgcagtatggcagaggggtcatagcctagtgtcaaggcgttaggacaattaggtagttgtttggctcctgaatatttatcttcttttttgctttacaactttataactttaatatatatgtatataagttatatatatgtagaaagtattttataattaaatacattacattgaaaagacttccaaaaagaatccataattagaacaccacatatcaattgctatccccttcatggagatcatccatatagatctacttatgtgctttacaaggcacatggctcagccctcttttgttctcttgtcaccatttcctattccaagatctccggtcctggtcagttgatatttgttgccttcttacatacttttcttaggtggaaacatgtggttgatattctcagaatctctgcatatccagagatatacttcttttatttcccctggtgataggtgtctcatctggggatgggttcttgactacagtcctctctctcaatgttctgtcaatattagcttctatctcttagtattttggataagttctattgctactctgattccttttatttcaaaagttacctactttgtatagatgcttacaagggtttacctcatttaaggaattcagaataatttaccaggatgcatataaaatatgttggttttttttcccccttaatcctttctgggacatggtgaaccctttcaatctgtagctcaagtgtttcttcagtttagaaaacgttttgtctattgttggcttgattattctctttcctccatctgttccttttccttcatctgaaattcttattatttgcatataaaaccttctgtatttttccttcagactgttaactttactcccatgatttttttatattcttgtattttttctctgtgttttgtgatattcctgtccattgatttttgccaattcttaaaagttgtcatcttctctttcatttcctctaccaatttaaaaaaaattagatttttttaagatctagagaatatccttacataatcttattgccttttattcatttcaagttatcaccagacttctctatgtgaactatttaaaataaaagccttcagttctgggtcttcttggaactttatccacagttttctgggttccgtggcctttttgtagacaccagttcagggttttagggtcctgtatatgctagacaagcaggggagggtaaaaactcaatagaattttgttcctctgggacacaggtgaatagacaggggacttaaaatcttatgatcacgatctgcacaaaggtacttctctgatgctccctgatcttctggggtgcagcgcaagccttaatatttgtttagcatcaaagacagttaacagtatagccccagctgcagctctcctacaggttctcagatcccacataaccatgagctccctaaattaactcaagatctttgaggcaaaagttatctttgggtgccacacggtctaaataatcacttcaggccccttgtttctggactgccatcaagcgcagaggtgagcaaacatcccgtgtttcttctttggttactgtcttaaaacagacacagagaaaggatgatgggggcattaaagtttaagttcaagacatgttgtcttttggaatcttcaactttttctgtaagattataatcgggtattcataagagataataccatttctgggatttcctatgtaacaagcagtatctactttaaaataatcacatgaatccctctagatatatagcaagtgtcctgttttaagtgaggaaactgagacttagatacataagcagcctgcccactgttgcattaggaaatgtctaagattttgattccaatttggcaagactctaaggtttgtttgtatcttctagtatataactctcttacttttcaacttaccctgagccttattgcagagaaattatgaaagttgttataatattccctcttttccttccagcacaaatgtgaaaatattattttggaataatatttcctataaagttgaattgctgtgtttgatagtttgaatctcagctgaactgcccagggaaaaaatgcttaaatattcctgaacaaaaaaactatcttagccttgaaactaccacacgggattcatgaaaacatattttcctatttggtttagaatggatttaggcaaagataatccatttaagagaagctctgagggcttgaggggagcaagtggtaattgttgggtttatgaaattcaacagctgttttggaatggataaaggcagttaaaggcttattcatggtaaacagtagtcccaattctgaacttgtttttaaaataattgcttctaagacaaatggttaagcaacagtattagagaattttttctagaggctgtggagggttgaaaggagaaaaatggcagggtcttctcctaatctggcaatgcaaggtaagttgctaatcataacatcataacatcagctatctcatttatattgttgcagaccccttgcctacatgctttaggcatgttatcattaaattagaaatatctttctcctattttctgtgtgtagaaactaaagatcagagaagttaagtagcttgcccaaggacacattagtatagtgcatatccattactgaaacatcttgagtcaaaaactcatgctgttaattaatccttcttggatctatttagttagctttggagagttcatttcataaagtggaaggtggaaaataacccaaaatgtagcaaatatctgtttgatgtttatttattaatgtattcaacaaacattttcttactatcgattgaagtaatgtgccagctcccaaaggtcataggcctaaggacgatttttgtgactttttatttttaaacactgtacttgttttctttccttttccctttccctcttttttaaaagtcttttataatgtgaatatagaatttgaaagtaaattagatgtatatgcaggattctacttgctactttcagaaagtaagagtgtctggagagctccaaattttcatatgcatcaggtaaaagcaattcttttgcagctcttcctgaatattttagaaaaagtaaaattaatgacttaggaattaattttctctgtttgctcttagagtttactcaaacattgatttttttttcagttgccatcaccacattccttttactcttttgacgtttaaactcgaaatgtgtaactgtgttacttgcgagtatttgcaagaaatacattcaaataaacagatgtattttatgttttattctgctcttcaactgaaaccataaatctaacaaagatatcaggagactgattggtcataccattaatggaaaattaatcttcgagaaatcttttctgacagcggttagtgaatagagtaaacatttcagataacacatagacgctgaaaaatattttacttttattgtttttaatgttataataaattataaatttgttataattagcaattatgcctactctttcaactccatatccccatgatattgttattgttattattattgccattattatttatttttttgagatggagtctccctctgtcacccaggctggattgcagtggcgtgatcttggctcactgcaacctccacctcctgggttcagacgattctgctgcctcagcctccagagtagctgggaccacaggtgtgtgacaccacacccagctaattttttgtatttttagtagagacagggtttcaccatgttagctaggatggtctcgatctcctaacctcatgatctgcccccctcagccccccaaagtgctgggattacaggcgtgagccaccacgcccagcccccatgatattacttttgactgatcttattaatattaaagaaaaaatgaatcaacattaaatttgctgatagaaagtagtgttgattctaaaaatattattcattagtatatatcaatgcttgactaatattggctttccctaaatattaacatgtgttaaatctaaaaatatttttgaaattgaatatataaattgtgccattgcttatatctgctttctccatagtagtatagggataagaataatatttaaattataagaggtattaagacacaattaatagccctggctttatgcttgctacagaattgatgctctattaataagagtggtggtggtgttttttatttaccttctatcttattgggaaaatagtatcaatctggaagaaacctgtgtatgattctatgtatctatatgcatccattacctataccttcatcctttgattttctcctatttctatgaatgaacttttcctctccctgcaaggtaataatgcctccttttgctcagtaagtcctattcatctcatttccttagtgacacctccccagcagttattcattccctcttggggatcatttctttttagcttaccaccggaataactcttaacagcatagaatcatatggtggttaattctagccaccaccttatttctctgctctcttgtacagaaaaaacttttcaaaagagctgtccatatttcctctccacattccctgtcctccaagtcttacttgaacccaccactctctggtttctaactcccaatttcactgagactgctcttttcaagttcacccatcaccatgacttagctaaaactaaggttaaatcttaaatccttgacaacactgagattcatcaacagcatttgacacagttgatcattctttcctgcttgaaacatttgttttttcagaccgtctggtttccctttatcttctgtttgttccttcttagtctcttttactgttttttcttccacagtatcctaatgattgaattttctgggagctcagttcttaaaactcttgttactttgtctctctcaatctctctctctataagtgatctccccaagtctaaaaaaaaaaagaaagaaatttatctctatgctgatgcatatgaatcctcttccccaaaacctagattcttatattcaactttaattgacatctcctcccagttaccttatagctaccatttcaaacttaacatgtcccaaaacgaaatcatggtaatttctaaaccaactcctccaaaagtcttccccatctcatgatatggcaacttgattcttcgatttgtatgggccaaaaactttcaagtcaagtttaatgctttcccttttctcattctttacattcgattccttaggaaattctgtttctatgccttgaaaatatatctagaatttaatacttcttttcccaagtccaagcccatatcatttcaccagtacttgttcagatgtagctttctaatgggcctcctgccttcacctttgtcctcttaatctattcttaaacaaacacatccttcacctgaaaatacaagaatggcttcctattattttcaaagtaaaagccaaagtccttccacagatctacacaacctactgaagtttgtctctgacttcacttgtatcagtttgtccctttgttaattctgtttctgacacactggacttcttactatgtaattcatgagttaagcatttttttttcattacacttgctgttccctttgctagagttactcttttcccaggtatctatatgttttacacactcacttccttcagccttttccttatatgtcactctgcaatgaggagattaaaaatagtaaatcttcactccctgtacatctagccatttttattcaacttctttgctttattattatccaaatgacttacataccacatattttacttgttgatatgtctttgtctgacttctctaccagaataaaacctctctgagggcagggacttctatattttttgatctttgcttaattctcaagtgcctaaatcagtgcctaacatgggagatactaaaaaaatttgttgaataaatggactgatataattgccactaatattaagaaaatgtttttattacttaaaaggaagtgctgccccagtggtaatattcctgagtctggagccatactgcctgggtttgaatcctgactctatcatttacttaattgtgtaactttgggcaagttacttaacttctctgtatgtcagtttccatatgcgtatctactatatatacaaagatgttggaaaggtaaataaattgatatttgaaaactatttagaacaggtcctggaatgtataaattctaggtaaaagtttattattatgatggttaaatttgtgtatgaactagtaatattttaaaaccatgctcagaattaaagtatattggcggctactgaactcatttgaatatactcattaatattgtttctcttgggtactgttttgggaggaaatgtgctgtactgatctttatacaatagccctcccttttccatggcttcactttcggtggttacagttacacccagttagtggtttgtggcctgaaaatattaaattgaaaattccagaaataaacaattcataagttttaaattgtgtaccgttctgagtgacatgatgaaatcttgctccatcctgctccattctacttgggacgtgaaccttccccttgtccagagtattcatgatgtagatgccacccgtgcttttgatcattgacattgtctgctcctgacattgtcatggctcgatgatccgggatcatgcaaagcagttgatcctccttctgacgcatcatcagaagatgaatagtagcctaacactcacaccacaatacctatgccactcacctcacttcacctcatcatgtctcctgacattgtcatggctcgatgatccaggatcatgcaaagcagatgatcctccttctgacgcatcatcagaagatgaatagtagcctaacactcacaccacaatacctacgtcactcacctcacttcacctcttcatgtaggcatttatcatcttacatcactgcaagaaggaaggcaagtacagtaccatagatattttgagagagaccatttcacatagcttttattacagcacattgttgtaattgttctgttttgttattattgttgttaatctcttactgtgtctaacttagcattaaacttcatcatagttgtgtatagaaaaaagtgtatatagggttaggtactatttgcagtttcaggcatccatttggagtcttggaacatatcccccaaagataagggggaactactgtatatgagtataaccttgtataatgagcatgggtttttgcactcagatttgtagccccaggtctcctacttgctggctttaagttactaatgtgaaactttattcacctcatctttgctagcaaataagcaaatgaggtaaaagatataggcatccagcaaattggttgatattaagtgacaatataaaagtacccctggcagtgaagaataagaatcaattatcagggcatctaagtattgcccttgcttctgtatcttatacaaagttactggtgaactattatgaatggctgatttttcaggcttcaagaaacggatgacacatcataggttctccttaacaattctacttaacaaataggggggtaaaccccctaaagaattgggaaccataatagtggatatgtggaacccacgcatatagtctgaatcatggttggaaatttccaattccattcatcagcttgtttgttttgcatgttatatttaactcttttaattatctttagttggagatctatgatttgtccttggagactattttgcaagcaattcggcaccttcttagagaaaactggaaattgtcttcatcattccaaatatctactcttaacatcttctgtttgtcatgcttgcacccatttgagacaccccaggtcctttctcctactgtgaaaacctgctctgaggaaagtattagttacagttttatatattatatgagaaattcaaagaaaacactccattccatgcaatgctatataaaacaaattatcttattgtaagattgaaggcatggtttccctgttaaaagctctattattaataaacgtgtgggtgggggggagatgtattctatgggcagtggcactctctaaagcccactcaaagctcactatgtttgtaggaacgtacttttttctatactgtccttgattagctccattaaggcacaactgtttgataataaaaaacataaatgattaggaattacgtatgcatatattaattagaaatatgtgtgtgtttacatagataaatgtataattaagaatgttgcttgcctttggccattggcaataaatattatgaaaggagttcttaaaaaatacataccctaaataaatatgcagataacatttgcactgctgtagctttttattgagggtcatcttggccactggcttggtttcttcctggataataatgctactgagcctctccaaaaatagaggtatgtaaccagtgtagatgtcaccttagtcatctcatttgcatctaatgattatatttgaaatgctatactaagtgatggaattttcctttggaaaaaaaaagagtcagatttactcaacatgattctctctttttgtccttacgtagtgtgcaaaatggctcattttccttctctcctgattcttatgcatacatagaaatatgtctgtttaaacaagcttccactactggcttgtttcagggaaactacctaagtccttcttccctactggctgaaaaggaaaatccagtttgttgcctaagagtttcatacactctccactgatgaaataatcctgtgtcaaagcatagcatcagagcaatgcatgcaaagaaattattcttgacatatcccttgggccgttgactttcttgtgttaggcagtccgccgagacatactattattatttcccatttgattatgtatgtgcatatgctgtcagtttgcattgctaggataagcagtttgaacttgatgatttggtgatctaaatgtagtcttttcctcttaaatgaaatctcattttctagcaatttcaaggcttgctaaatttagccacagaggaatgtatatatgcaatttttgttttccttttctgttcttaatctcatcctttttcactggtgctgagaataaggaagaaccctatagtattactagtcttacacccaaagctttgaaaaatctatattaaagtggacaatatagaactctcattcttggtcttttttatttcctaaggcagaagtatatttacactcgttagctcttagaaagaaaaagtgatctgagggaccagccaagttttctctttttaagagatgttctttttgtggaaatcaaggtttctttatgctcttgcactgaatcaactaaatcttttttttgttgccatgttaaattcagagctgtaccctcaaagtgtgtaacagaccaaacagccaactctgaaacaagatgtggcttcttagtaaatcacatcaaaactgcttttaggtattcccagaatagttccaacccatgaaattgccctagaatgaattagcacatctctgaacaccatgtaacctgaaatttaaccattctcatcagtgtgaaaagaagtttaatggtcatattttttatcaagcaaactgcctgcttttagtgtgctggattggttttttgaatggatatatggaacctgggttataaatctccttagttaaaaagcttgtctcatcaattttgtataataaatataaggtttgaaatcccaagacgggaggcctaaatgtgtgtgaaaaagtctcatgtccaaaatggcaagtgagtctgcaattaaagtatcaagtcacagttgaaacttactaatttaaatttatcaatacccttgtaacagatatgaggacatgtctcacctttcaaatgtaatttctttcactgaaagaaaattaatgtacataattcagtgttacaatgcactaataaatcagaatgtgaagatatctctcaataagcttcactttggaggctaatttccttgtccaatacaatagaaattagtttattatatacgtaggcaaatctagctaaatctgtagaaatataactactgttgtctagaaaattcaagaaacatcataaatcataacatattgacaatatacaggatgagtttactcttccttaacctattaactagtaagttctcactaataagttacattgatgaatagatgaatacatgaagttaaaaacaatttttagaatatatgatagtaaccttgtgaaccttttagaatatatgatagtaatgtaaataaagcatttgaaaagttaaaggtttataaaattttaagatcttcttaatgatataatttaaattcaatgtcataagtggcttggaaaattacattttcttccttttcatttgtcatccaataaaatcagatattttaacatttaaagagcctttaaaattaagtgccattgtggtgaattgatttggtcagattcacagagataataaggagttaggtctcctgacatccatttagtattattttcatataattttccctgtggccagacccaaggttagaaaatctataaataagggaagaatgagggatggatgcaaagtctgaggcattcaacattttaggacaaaatacacaataagaagaaccccattttctctgagatatgaaaaagactatagaactcgcctactatttaatgtatttttagaaagggaaacatttttattaaactaaatcttatgatgaaccccaatagtaagaaagatacgtacagagctattctggtagaaagaggagtaaaagccccactcaggagaactgtatttcttcctccttagccttctctaaaacattttcatatagcccagaggttctgaaaaaacaatgtaaaaatctttgatttagtctaatcaagtgtttgatttttacgtgcaaaaatgaaggcctgtctagttttccaagtcataccaccattttgtatctgagaaagctcatcttactctaatccattgcttcacttttccatagctcacagttatttggttcactctgacaaatagtataggtcatagaaatgtggctttcttttttggaatatattttgtttgtttattaatgtgcagttattcaatagagacttgaggttaaaatgaggataatagaaatcttgtatttgagcaaaagctgagtttatttccctcaaatgattgatcattcaatagctatgtaataaaaccataagattgaatcagtattgaattcttgtaaacaccatatgtttgcataaaattatctaaataatgtctcctttgtaatcttcaagctcatagtcagaagttttctgtatgaccttcaagcaaagacatgtctaccatttttagcaccaaaggaaatagcaaaagtacagaattccactctcacagggctgtggtcaagaatgactgatacacagctgggcaagcagctgggcctttcatagacagaacaaaaagtgtgtggaactgagctttatttgaatgtgaactaaattcaactccaaaacccttgaatgcattatacagttgagggtttgtgcatgaaatattcaagtttttactctcatttgaatcttagaaagtaaatttatctgagaacaaatggcaccttgcatttgtgccagccctttagacgctactcataatttttcaaattattgcatttcagttttctgtttacaattgcataaataatagtgacattttacattttgtagcaacactccttttaagatgtgtgtttttagataagattattaatttataaaccatcattaaagaaaatagaagatatttttgctcacttgccacatgcagtgaaaaagagtccttgggcaaggtcaaacaatgaatcagcagggcatggagaacagaaccttccaagttctctgagggcaaagcctcacactgcatgtcagcaggtctctcgtggtaggggtgtgatgttcctgagtccttttcagataacacttcacttgtgattttgtatagcttctgagttcttccagtgtgattgctgagatatcattcctttatttatttatttatttatttatttatttaagacagagtctcactctgtcaccaggctggagtgcagtggcatgatctcagctcactgcagcctctgcctcctgagttcaagccattctcctgcctcagcctcccaagcagctgggattacaggtgtccaccaccatgcctggctaatttctgtaattttagtagaaatggggtttcaccatgttggccaggctggtctcaaactcctgacctaaggtgatccaccagccttggcctcccaatttgctgggattacaggagtgagacacagtgcctggctagaaataattccttttaccagaccaacgcaatttaagaattccacggagaaaagggatttacagtaggtttagaatgtttgaaaggcttttctgcagtcttctatggaaacaaaacctaaatcaaccaaccagagtaatgtgaaataaatattttacaaatagcaacagatagcacagtaatataagtgcctaataagacatgtgagtacttaagggctgttcatgcttcttgttaggaaaagcaaaagcaaacttctcttctattaaatgttgataatgtgttttaacataaaatattcacaggataatcatgttcttaagttattcttatctagccgagaacagcatctacttaggaagagattcagattggagacttattgctataaattcacctttttttaatgtttgaaaatgagccagtcatattaattatacatgtttataataatgtaaataataagctttattacagagttctcatagagagaagggagtgaatttgtactaatatttcagtttgaccaaactcataacttgctactgttcttattttcctaacaatagaaggacattgggtttttaaatatttcacattgagaaaaacaaacatagggatgtatttacgaacactgtctctatttcataaatgatgaaactttggttttgagatgttaattttttttcccaaagtcaaaaagctgataagcagaaaagcttaaattaaaatgctagtctatctgtcttcaaagtccttgctcttaaaaatcatggtatatgtcttctaatacatttttataaggtaggatcacttcactagtatacttttgtcttctcattccttttttgtaatgggccttttagaaaatagaaaaatagaaaatttattttttgtaatgggcctttatttatttaccagtttagatttacagtaaaactgaacagaaaatacagaattattatatatgcctttatgttcctcctcccattttcctctattatcagcatatagcattagtgtggtacatttgttacaattaatggcccaatatacatacattattatgaaccaaagtccatagtttatattggggttcattcttggtgctgtacattctatgggttttgataaatgtataatgactggtattcacaattacagaatcatacagaataattttaatgctgtaaaaatcccctgtgctccacctatttgtcactcccttccttctgcaaacccccagcaaccacagatctttttactgtgcccagttttgcctgttccatgacttcatatggttagggtcatacagtatgtagcctttttggattgccttctttaacttagcaatatacatttaaggtcctttaattttttttgtggtttgttggctcatttccttgttatcactgtataacattccactgtgtcagagtaccacactttgtttcctattcactgattgaaagtcatcttgtgggcatccaagttttggcaattatcaatggagtttcataaacattcatatgaaagttttgtgtggatatatctcattcctttttaaaaattgtgtttctataaattaaactattcctcatgattttaaagtagaaatttcttaagtgcttaaaagcaataagaatatttatgggctaaaccttatgacctgcttgattacaagctattctgtcttaatctctaaatttcagggtttgtttcaactgattaaatatgaataagcttatttcctaagtgcttgaaggtagtagaatagtgtaagggtgggtatgtacttttttgcaattgtttttattcctctgctgtttattaccatgtctttgtcttataattgcctaattacctgcctcttactgtcactcagtctttcttctgaggaaatacagtttctctgtgatataggtcctttgaataacaagttgtccatatgatttttcctatactcaatgaaaattatttatttagaaatttagaggtgtaaggaaacttcaaccatttttagcagaagagtattttttaaaaatgttataaaaatcctattaagaaggaagataaatgctatagcagaagaaggagaatctactgggattcctttctacttttcccacttccactaaagctgttccaaaatattttttaaaaatcaagagtttctggaacacaatggaagacattcatctagttcattcgcctgagttttcatgtgaaaattgaatctcctgtagttgtggggagattgaattgggtctttgtttttatggagaaataagattgaggtgagctgtttgcagttgacttgaaagtggcataatgtaagtgccaactgtggtatttgtctgttgtaatgtatgaagaaaattaagaaatttgatcaagctgtaaatgacctgtgacagggaaagagtggaagctgaattttggagggtcactagtagtttttcaattttaccaaagccattctaaattacaaatgtaagtaaattgaatctttggccatagccatcttacttgaaatacattcctatggttgataaaatttgatataaagtacctgtccacattattctctaatgaaattagaataaattattataattatggtatgaaagtcaagatcaggaaaatttgaaaatttatttagtagatttagtaaacaaatatttaagaacatgattaataaaatttattcatttactcaacaagtatttttaaggtgattgttttcctgcgtattaggtggctttagataaaaggaagagctgttcacccaatttaacaagaagagaccagagttaatgtgggtataggtgtaaataaagttattgggtatagttgtaggaggaagtgaaaattttcttttctgtttttattttctgtagtaaaataacatgtatacccaaatcattaaactgagaacaagaaggagagggaacactggaggaatgaaggaaaacaagatgtgaaataatcactaggaaggttggaggagcgtaagaatgacttgactagaaacagggaaggcaacataatttgcagggccggggaaaaatgcaaaatgtggggcttctattaaaaattaagaatttcaagacagcaacagtgggagattaaaccaaatatgggacaattctgtgtgtgggccctgtgcaactaaacccatgaatttgatctaactaagagaatataatagagttgcttgccagtactgaggaaccacttgaagataaagatcatagattgcagatgaaagcagtagcatggtggtgtaattttatgtactaataatcagctgtaaaccattctccattcttcttcattcttacagtttctctgttatcagtaaaacagaaaaggagtaagcacagtcttcatccttcagtatttcaatgagctgacaatgtgtggtcctttctatgtgaagaacaatgccttcaagccttattcatatcaaagggacattagaagttgttaatttattattttacctgttgttactttaaaaagatctaggtgttcttagacttccatggtctatttctaagcagtagctaatgtgttttctaccttattgtgacatcattttctgtaatatctttgcaggagggatttgagtttgagagaggcagtaagtttttgtcactgccaatttctgttgatagagctttcatttgattattgttcccaaatcaggactgtcatgaggacagatgtagctaattaatccttatcagctctgattcaattaaaaaattcctgaaaacttctcagtgtctgctgaattcttcttatggaaagttgctgttagaaaggtcaaaattcttgttaaataggatcaaggaccttacaagtcaagcatttcactgggtggcagaggggctatatttaaaaattaatttaaaggaaaatgcaaaatattactgaatataaatttgatggagtggaggagaattagaattttgcttttcaggctcagcttttaagctaagagagcatgagaatggatgtacttgtgtataagcatacaagaacagaatgattttgctatatcactctatcacctttcatatatcagtctgttactctgttcagtttgagaataataactcattccactatgtgttatcttggtaaaggaatattttatggaggtccatttctaaaatattagctgatgaaatacttgatgttagtgtatgggcagcaggtgactttttatttttaatatatcatttgtatatgtttaaattttctgttattggacaatcaaaaggcaactttaaaagagaatcatatttaactttactcttaacaagcagaaagttgtacgtgccaaaatggtgaaccagtatctaaatgtgcaggtctaatactctgaatctcaacccaaaggggaagcaagaatttgccttttagttaagtggaaagttagcaacaatttaaaaagaaaagggattagtaaagtactgttccgagcctatgcattattattaggttggtgcaaaagtaattgctgtttttgccgttactttttcaccaacctaaatataaatcaaaatgtattaaattcagctctgtaagtgggaccttctagtgaaacagtctcacgttacctcagttttcttgctggtcagtagacctatgtttcttaattgaaaataataaagattttagtcctaatatttttgaaaaccttgaatcttctgtgggtgaacatgagttttagctgccattggccatttaaattgaagcaaaattagtgaaataagcacaatgtcacattatgttaagatcagcatatctaaatgaaggcccaactgtaaattaagcatctttgaccacttcataaatcctttaaatttaagggtacttcaattttaatatgttgtgattaataccgctagacaaaattaatgcttcatttatgaataagctgtaatggagcttcgggtcttttaatatcccattgatgcatgggtggtcaattagtggtgaatatttcttattttcaacaaggagggatgttgcatctcagggaatcaggtttgcaggacctctagcttcttacagagattgcctttccatagccacatgagggtaggaacacgttttgacaaatcttttctttttgtggaattaaactgatcttgtaacatatgcgaagttgacattactaagaccattgacattgtgataaaggagaacagattctaaaagatgttcctaaatttaatctactttatgaattgttgccattctatttgaatatgtacatttatttttatgtttatggttgccagaatattttgattctatgaatcatgaattgattaaaaaatttcaatagctgcactggtttctttccactctccaccctcatttccttggaaggttttagatatagaagaaacagatagctactcgaacgattaaaaaaaaaaaaagcctaaaggtcaaatcacaatcacacactagatttattgcattttaatgtcatagtcatccctgtgataaagattagtgatgaacagattgaaaaatagatgcaagaatgacttctactgcaatataataagcttatccacatattaggcttaattttcagcaaagctattaacttgttctttttattaaaagaatattatattttggactgaaatgtaatacttcatatgtgtgttattcttgtattagggattttggcagaaatatgaagaggttgggaaaagagaagattgacaattattcatttattttttaactataaaattttaatgtttttgtgttgtttagagttttgtacaattgagtatcataattatcatttacccaggggagaatctcattcttcaggaatagatgtctttgtctaatttgccttgaagatatttatataagttgtcatcagtgaattttaatgaaaacttgagtaaaatatgcttgaatatatttgcaaggcaatgaaaaataagctttttattcccccagagagtgttacactgattaagctatttttacaaataattttatgttagccatataagcattagtctattttgctatttaattatcaaaactttgtcaagaaaatttgaaaatcagatccattatcctaaagagaaattatacaggctgatattctctacttctaaagcaaggattttaatttttctgcatgattttgaggagagaaatagagaaattctatgtggcctttcacgtggctttgactttgccattcagttgcttttactttgttcttaagtgcagtgttcttaaatttttagtcactaggagttatataggggatgaaaataaaatgcagatgaggtttcacaaccaaaagtcagattcttccagaaatctgcatttcaatcaagcatctcaggtggatctgatgctgttggcccagaaagtacattttgagaaacatggttataatagaatgatcctgatatttaagggaaatcagaatatagaaatgaaacatgtatattttttatcttcaatcaactaattaccataattgagtacttcattatttaccataaattagaaaatagtttagatcttataagttccaacttacatccaaaatgtatagtatttccatatattatatcttaaagcatacacttttatctttgcctgcaatccttatagtattctattgtctacatagatttttttttaacatagcactgtataggtgcctactcatttgtaggttatttttgagaactataaatatttttcccatcaatgagataaaattccccacatattctaacaacttctaaactgattttttaaaaaataaactaaacaaaaacctattttgcatcgcagagagtaaagactttctaattagagcaacacaatacccaactttcccgctaggtttcgtgaggataaaagtactattgttttttccaagctccccagtggacaaaccacttttcaagcattattttattgcttctcaaaacagaactatgtacgaagaaagctgaaattcaagattgacttgccagtacaggctcatacagatgttatgatcattcagcaaattctttgcttttgctaataacaagttgccttcatgaggccaaaaggcagctacttcaatgacatattggtcctaccactgttgccacacaaagagctgaaaagaaaaagttgaagaataaaaaaaattcaaatgaaggataataaaaattgagatgagcattatagtaataataattcaataatttctgtttagtggaaatagaataacatcaataactgagtagctttggtattgtaatatgtctggaaaataaggcatgcagactacaaatgtgatctttgcatcaggagaagcacaatgaaaatctatgcactaaaatcagaaatcatattaaaacaacttaagattatgtacagcattgagatgcaacagccactcagtagcttttagaggtaatgagaaggtaattaaaatcctaaggctacttcttaattgatgtgattggtcatggcaagtgaatggtgcattggctgacccatttttcttcaccagtgaaataaaacataagggtctttattaatttgtctattcaggcatctttgagaatgcagttagacacttggaggctagagtcaaatgatgatgatgatgatggtaatgaggatgatgataatgatgatattaacaacaatttgctacatgctttaattataatttctaaactattcctgacatcaaatattctttccttcactctatatatcgaggaagtgagggtcacaaagacatggatttatattcaggtatttggaaaaggcttctaacaattggttcattgagatttcttaaaaattacaactgtagttacctaggcttgtaaggggtcactggtggcaggggtaaaggatcctgaaattccttaatgctgtgctaagcagtttgaacttcattttgtagttagctctgtcttctaagttctaagaaggctgctatagcttttgtttggaagatggattaaagtgagaaaaagaagtcaataagatagtggcagtgagggtggagaggaaaaaaaatatctggtgtaaaaaagggcataatggcctattaaaagcatgaagagaaggaagaggaaaaagtaaaaaaatatgattttgaagatttattttgagataggtggctaagaagataatagatctgtaaacatcgataagggaagcaagaaaacagaagctttggagaatatgtggaagacatttagcatttctgaaagtaatgtgtttagcgatatgtagaaacttactgtagagatgccatctagactgttggaatgataatttgaacttcttataagggagcacccccaaatcaattggtttgttaataaaaatgatatattattttcaaaatttcctaatccagcttattggaaagtcttaaactggaccattatactgtacatagagcaaatcaaagctggaaatagcttccactaaagcatagttcaaggctgtccagtagaactttctggaatgatggaaatgttttatatctgcattgcttaatacgacgactattatccatatgtgtttgttgagcgcttgaaatgtgactcatgtaacccagaaactgaattctaaattttattgaattttaattactttaaagttaaatagtttctatagctaagggctacaaagatggataggacaggtctagatattttaatctgaaacaacacattattagcagtttggagaccataattccatttgcaataattccatcaaagtcctcacttgtaaagaaaatggaaaaaaattgtgactaagtataaaactgttaaaagttgcatgttcttttaactgcatattttttcattgatgttaatgaaacatgtagataaaacaatattcaatattttaaaatttataaatcatatgttaaatataggtggattgtatttttatttaaccggtttcactgtagacaagataatctttcaaagaagagcccaattcaattacttgtggaacaagaatctattttatagttatattacacaggcttctaagagaagatattaattcaggagtattacatagtgaatattgaggatacaatgacactttcttatttaacataaaagtttatgtattaattgactgcagattaaatacattactttagcgcattacagtagaattatataggcacttaatttttcatagaatattaacagagaaaataaatcaccaggctgtacctaatctgtttccattttttctttagtaattaacatacatatatgtatacataaattgaattctgatatataagcataaagatttattcttaatttgtgatgctcttttgttatgaacatttgtagtcaatcttccaaaattaattcatagtattttgagcttaatatttaaacctgatatgcattttcttgttcacttgatctttatattatcattgttttatggggctgtggaggttatcacctagcaactgaaagcaagaacctctgtttaagatgcatttggatttgtgattcagcactgttgttttatagattagttgttttatatatagatctgttgttttatatattagattatatataaatccacagcatttctcatcaatttatgtaaattttaattgaatgatgaaattacattaataactaaaacttgcaaaaacaccattggaaactgataaagggtatcacttttgtatggtaagggtacaaatcttcaggcagggaagaggcagggaagaggccttccaatgtacttaaagggtgaccatataatttatcacccaagtttaaatacttgtgaaattaaagagagcataactatgactggctaagacaaactaagatctatggttgctctatctagatggtatctgactagctgttgtgtttggatattttggacgacagttcatatgttttacacaaagaatagaggttttgattaatccaggtagtcaattaattgtaggttaaaataactttcactgtaactttatgtttgtacaacatactaatagtttgcatttattgagcttgcattgtaggagagacaagttaaatacttacatgcatggcctcattaaattatcacatgtttatggaatagattatttttatttctatttcacagatgaaactgaaacttaggaagtaatctttgtaaaatgtggtaaatcctgtctattttactacatgccagaccctgtgctaaatacttctgtgcattgcctcatttaatccttctaattaccctaaaatagatagttttttaaacctcgacttcacagatgagagtaaatatgttgctgaatgttatatagctaatgagtttcatagaccagctctaaaacaatatctgtcagacaaaaagtctatccctcaattattaggcattttttttttccataactgatatccattgccatgaaatgtatgattctgtcacttgggggcagttaagagcttgagaagaaaggaagggtacagtactgggggccaaagggtttcatttgaaacacataagcctgtgtcatatcgagattcttctgcctgaagatgctttttggaaaggttctttgaatcagtttccagatcactggggtgaggaggcagctttcctccagcctgtgctcatgttctcaggcctggcctctccagcctgtgcctatgctttgcattttcaggctctacagtactgtgtactcacagataggaatctgtaaattaactagcagtgtaggcctggaattctcccaaatttggttgaatgagattaatgtggatgagggaattaagatcatgagcataaaaaatggtaattttcttgactgataaaggtcacgactctcaaaatagtgaaaacactgagaaagattaatcagaaaatgtatcctgtctttacaagattattagaggtttaaacattgctgaaatggccaagcataggaataattgcttataagattgctaagagcatcaacagatatttctctgcttatctaaaacgatagccaaagcatgtataaatcaaagcctctagaatgttatcttgactaactggaagaggtagcatgtactaatgctaaggtgagtgattagagataggtatcctcatcataactgctttcaatgagttctgaggccctaacaaattcacatcataccccatatccaatgctacctttaatacaaggaggcaactgtgaaccacatttggcttataggaacagtgtaaagataaaatggtttaatatttttgaaatttctatctttatggaatttctcatatagagttatcattaattgtttatgtatctttcttctgaagctctaagttccataaagacaaggactaagaaagtataattcaattttgcatcctcagtacctaacagagaacttggtacatagaaaatatttgatgatttattttttgttgaataactacatgaataaaatgaagtgagtcaaaaagtgcttttgaatttacaaacattgtaaaaatatgtcatagctattcaactccagtttcctagttgagtcaactaccaaagaaaccctcttaactcagaatgtaacatagaagatgtatacaatgctgtcctgcttaatgtcagaaatttcaaatgttcacttttccttcattttcttgaactatgtctctgtatttatatatgacttaagataaatatgtgtgtgtatatatatatatatatattttttttttttttttttttttgccaaatgaacttgctttttatgggactacattctactggcttgaaggtgaactaaaaatatctcttatccctgaagcctggtgctgactcatggagcgtgtctactacatgaccaaatgtaggttgagaacaaattagaaacatctgacttattcacatgcattttagtatttcaagaggagacacacgaagaaggtaaaatatagcaagcaaattaacatacaaaactgcattttattttttatcttagttaaatttgtctgataattcttttgttatgcatgttcttgcaccttagccaaaactgcacattggcaaataacagggactacagatggctcaacagccaggaaccatttgtggttgaacaaatttggcacactgtcttgtcttctaataaccagacttctgacctattgacccctccctgattcttccctccacaaaccaaggaaagcccttccaagtggtttttagagctaagtagtagcttcttgaattttggtatagagaaactttagagtcatcattagtgtttcctacattttaaatatttcctagaatatgaatagagcatactatagtatgagtgaaaacatatttatctagaaaagctgaattacattaaaattgtcagttttagaactgacaagggcataggtccgactttcaccttcagcagaaaaaaaagtgtactgagaaatatttaaagggtgggaaatcaggtcttttgtatattaacataatgtattttcatcactaccattgcattaatgacacagctctaaagtcatctttaattacctaattttcttgttctttatattttgagaaatgagtcgttatttggaaggttactaggaaagtaaacataatcagttaaatggtgtgtgtctctggaagtactattgtgaaagaatgaagtaaaggcctataagtagaggccaacaacaccctagagcatctattttccatttgagaaataactatttaaatatattcattcattgaagatatgtgtgacctaagagaattaatggagctttcaaatatgtcagcccgcctatagcagttaagagcaaaggctctgatgttagattcatggttctgccgcttcctaattgtaggagacttaagtgatgctctcattcataaaatggggcctacaacatagttttgtaaacattaaatgaaataatcaatataaaatgcatagcatagtacctggtccacagtatatgctcagcaagtgacagctactgttgccattattataattctccccctcttcctcttcccccattctcttcttccttttcaaagtaatggtagtgatgataatagtagtggtggaaggtgaataatagaaaggatgctctgatacaagatatgtaacataagataatcaagatgaagaggttactggtaataatatgaaatccactaatttagacatgaaatacaattgcaagaactaatctgacagctaaacctcttggtaacaagcagctcaagggctactgcataaagcctaacaagttctcaggaatctgattttctgtatatagcagaatgatgcttaatcaattaaaaaatactagaaataggatgatgtccttttttttgtgaattcctatggcatttgggggaattttaagtcctttactgatttgcatttttaactgatctctttggatagatagatggattataatctatatttacatatagattataaatatatatataaaatctataatactatagataatgctacaggggagctgacatatttgaaaagctccattaactctcttagagcatacatatcttcaatgaatatgcttaaatagttatttcttaaatggtatataaatgttctaggtgtctgtagtcctttatctaaaggccattacttcagtctttcacaacagtactcccagagatattgtattagtctgttgtcatgatgctgataaagacatacctgagactgggctatttacaaaagaaagaggtttcattggacttaaagttccacatgtttggggagacctcagaatcatggcaggaggtgaaaggcacttcttacatggtggtggcaagagaaaaatgaggaagaaacaaaagcagaaacccctgataaactcatcagatctcatgagacttattcactatcacgagaatagcaccagaaagactgacccccatgattcaattacctccccctggtccctcctgcaacacgtgggaattctgggggatacaattcaagttgagatttgggtggggacacagccaaaccatactggacacataatagtatatctatctatctatctatctatctatctatctatctatctatcatctatctatctatctatctaatctatctatctatcatcatcatctatctatctatctatatctatcatcaactagattatgagcctccagagaacaagatttttattttataccgatagaggagatggtccttagatacttttgggataaattaatttccttgacctccacatttttcaactttctttttgaacacacttgaagtagtttaattctagaatacttcaagaggagtataaggctctcaaatcaaaaattaaacagaagattctaattaagatgatgtatccaatttagaaacatcagtgctttcacaatccacttcatagaagaatatagaacagagggtataaaactactgtatgtattccttgagtttattgaaagttattttcttttacttatcttgatatttatgagtttttactaattattgtatagtacatttctttataaaggagtaagaaaacttcagaaatcatgtatttattataaaatatctttctaaaggattaaaatgttgagttaaacactttattctgagttacaaatatggcaattcatttgagttgccaatttcctgatttattttaaaggataataattctactatcttgcttatataaactatagattttatgatatcatcagattctctattcaaatatctctgttaatgttgatggaaaattatttgtagcccaattttatgtgaagaaactaagatggagatttttagtaaacattttaaggattgacgcctggtaactggcagaactgggactgagactcttattttcatgttttctaatgtgttattctcttttggctttaatatgcacccccattggtttcatcaaattcactgctaaataactacattcttaatcagttaaatgcacatgggatagttgtttccaagagtttttatgtaaatctggaaagttttaaatatgttatcaattccttaccaatacaattaacgaactaattagattattattagagaagactaatggggttttaatattttcttcctgttatgaattaaaatagcaaacagaaaacagcagtagtaatgttattggtacaattatggtgatctttattttttgtattttaaagtactttttttaacaaaatattaaatatttattttagaaaatttggaaataacagataaaagaaaataattttaattcttactaactataatttcttaaattttttgtatatatattcatatttatatctctttacatataaatatgcattctatctccactgatatatttctattactctgtatagatgcctctatctctattttaaatctccaagtttaccagtatagggatatctgtctttgtttttctcaatctgtctccagttctatctctatctgtacagacttatttctgtctctataggtatctccatctctagatgcaaaaatgaaatgtatgctatctttatgtaaacataaaaatcatccttaatatttttgtaaccttattgttttcattcagtttgtgaacttattttcatatcattaaatatttttcgagaaaataattttatttggttacaaagtagtttagcatatttatgcatcattatttacctaaattattcttttttccctgggtattgaggttacttccatatttttactgtgaaaagcagcactgcagtggacatttttatagctaactttttcaacattatccatgattaaatgttgtaggcaaaaaaaaaaaaaaaaaatctcgtgggtgactttgtagaacaatttctgaatcaaatagaatttacattttcaagattttagggtcatattactaaattaatcttctgacaaccagaataacaaacatctttgaattttatcaacaccaattcatatatgcatttgattaacagcaaatgtcaggtgcagaaatctcacttgacactgtcattctataattttaagtaaaattattattacctttattgttattattattacttcatgaattttatagataactccaatcccttcttatacatctttaatttccaggatttaaaacttcctaagttaatttgttattcctcaaaattggagtactttgtgtttctatagcactagcacttctaaaagttgtcagcaaacagtgctttaattgatattcacaacatccctgtgagataatagtaagaaatacgtactattgtgcctcttttgcacatcttgagtaaacttagcagaaaggcaacttgttcaagcttagacagaaattgtttctcaagagattgtatgcatacaagtaggaaactggaatcatcttttagttctataagataatcattttgaagactcttggtatgagttgaaaccagaagaaaggctcttgtagatttggtacagtttaggtgtctaggtaacaatcagttgtaccacaaaatgtctactaatatgggtgatgcttgttttctaaacgtagcagatgttcatcacgctttttaatttctgtgtgtttcctttgaagcatttatgactttttttctgaggtacaaaaagttagtatatttttcttctattttcaaattattacataagtatgactctattatctggaatggacatttttattgctaacattttccagggtagctgagaaaatttattacaagaagtgaatcaggctgtttgctgataaaatatttagcaaactatacccagcaaccaaattattatgctaagagctgtaaatccgtagaacaaaagtattttgaagttggtcaagtgagcctcagatcttttattatactttattgtgtttatacagctagtcttcagccacaagggcatcaaaggcaaaaaaaaaaaaaaaaatgaatgtttaaatagtagcagttcagaaaaaaaaaagaatggcagtgttaaattgtgcctccactttatactactacgaacatattgatatatacaaaatccaaattgctaggaattcaatgtgacaaaattaactgagtattacaattttttgatgtgccagagccctgatatataaacttttatttagaatgggatttggttcagtttgaataatgttccaagaagttgaaaggttattgggaaaaaaattgctaaagaaacatctctaatatgttagatgaatactgaggatatagttagtgtatagcgttacaggaaggctatagtacataaattacaggaaatagtaatgcattctgaaaattgtaaattttatcctcggctagcatatattactatttccagaaggaatctgtgatgagaagattaagaagccataattagtttccatcaatctctgtcaataaatatatgggaattctgatacatgttgagcactgcattatgtactgagggctatgctgtcatagagtggtcatataaaaactcgaatgactatctaacaattaaatctagtataggcatatcccatcacggcacatgcacatgtgaatgtgtggtgggcggagggggagagagagaatgacgtggaaagaaaatgtgtgctaagtgactggcacactgctaaaaaatagagaaagattctgtatgctaaaggggccagattcagtgcagaactgtcctttgagttaatccctgaaggacaataacatcttgaaaataggtctgctacttgtcatttggtacaattccagcccacttcagccttttcgctacagagacattattttttgcacattcaataatgctttgttgtttcttttgtaaattaaatctctggtgttgcactgaactctatgttccctttatgcatggctagttggtttataccaagagatgacttgaatagtttcctggagatggttttttttttctccttctttttatactttttctaagttatcacttctggaggagcttatgcacgaatgtggaaacacattctctttcacatatttaaaacaaaacagtttctaatcctcaaacttgatgtaaaaatgctacaaagagaggattatttgagcagtgcacctatttctcttagcaagttattttaattacttttctacatttgtgattaaaaaatatttccaatgaaattcttagtatggaaaaatgatttattgccaacagcactgatcatgagattgagccagaaaacaggaagaaaaaagacaatatattttgaagttaaaaaaataaaatttttctgtaatattaaactgggtggaagaaagtcttcactgaaagaccagaacaatcatagagcaagtcttcttccccctcagtcactgccagattcaacatcgaaggtattcctttttattctcacttctgatgaaatgtgggaaggactcagagacattaacagggaatcacattgttctcccaaaaggataatatccatgaagataatgttttggtaccaaagagacatgctatcttttttgtctatgtccaaaatgccaaagtgtatgtctcagaaaattatcgtagcttttgattatttggttattttatattgagaaaccctaattaagagctaaaaactccagctcgcaatttggttgcttagatatatccaaggttttggtatccagtaactgagtttttgttttattttaccttagaattctggccttttgtagagactgttcatattcatgatgtctgataagatttaacttgtgggcagttatgatgatcaaacagtacataagcatatatgcacacaatgaaacgtatttacatttaaaatacacaaatatactagcaaatgaattcagactccatttatccatttgctcattcatgtagtcaacaaaatgtgccaattacaattaaaaattacattcttaatgtcttaagatcttagattgtttttcacagctgaacttttttctgttgaaattgaaattttacatgtagtctctatatccagtggtggaggaaacttcatctcctatggaaggtcactggagaatttctgggaactctagggcatttggggatgtgttcttatgaaagatcaaaggttcctctttcttcatgcttaacaattctcctcaatggaggaagaacataccataaatagggtttaccatattttcatgttctcttactaataacaccacaaaattttcttctaagatgcataccccatttggtagtatcttctaaaatctaagttaaaacaagcaattctacttcttctgaccccctaaattgttttaaacttttcataataaactatgaagcttttgtgttttaatatttatttatttgactgaagtaaagaaatgtactttaaataattctctctgtccttaccttaaagtcaggtacagctagaatctgaaggaatttatcctaccgtaattaaagtattcttgagttatccccaagttagttaatttgatgtcttcaaagaacatcttaagtgacaaaacactgaaactttaatagagcaagaatgtagattacattaaaagtatattcacaacaccttcaagtcatttattttccttctcaaattcactctcgttgttaatctggaagcagaccaacttgattggaatctcagttctaccacctattatctatgtgcccttaagcaagttaagatctctgtgcttcctcttcattgataagatgaagaaaagagtagtagacactaaatagggtttctgtaaaaatgaaatgagttcatacatgtacacagcttagaacagtactatttgtatagtaaggcctccctataaatgttgactattatgatggagaagacataatactgaaggaaagagctattctattcaacaactctttctttattctctactcctgtactacatttccttgacagtcattataattacagaagatggacttacatgaaaatatcaaactgaatgttgaaacacatgagtttgaggaaaggtggaagttaaactactttataaagatgtatcctgaaaccctgagtcataacacagtgccgtcccaccggggctggtctcctagtaccactctggtcttctgtcaccttgaagaaacacacacagcatttttttcagttttcatttggaccttctctttgcacttatttatagttatggtgtcttttgaccaatatttctaattcatattataaacaaggtacccaggaaaagctgaatatattttattttattaaaaatattcacacgataatggaggtataagagtaataacacaaagcacaaaaacaaatgacaaaagaatatatcccgagaatttgagtcctgaggtagaaagggaaatgtgacaataataactatggatttcctggtagaactcagaatgactaaatatgtaatatttagggttttttttcaataccactctccttttgggatgcctgtataccatgtgtttctacttctaaactttctcttcctcttcctttcttgtcagagttactagacaaagtgagaatgaactcatttgccccttaactgtatctctgtataacatacattggaggttttacgctatcgtaacttaggtgttctaacaaaggacattactcactgaataggtcctacattgcttaggtctctcttctaagattcttatggtcatcaagtttattttaagataatggacagatctatagctacaaataaaggtatatcttggagtcctttagaagagagaaaaattttgccctttcaagttatcctggaccaaataaataattaaaaatgagtaatgccaagaaatgatttgtatcagatactttaccttgtttttctcaattatggttttgaggaactgtgaaatatcccattaggaaacaaaccaaaatttgcacagacagcctgtgaagttatattactgaaatgaccatgtgtggaacgtaattattgtatgagtcattcagaaccataaaaataggagtttattaaattttataaaattgactggattttaatgaggttttccagatagaagtggttgtattcttatttaagtaataatgccaaaagtgatttttcccccagaaaatgctcatacaactctagcactggcaatgctagtcctcgtggtgtacatgaggactaaacttaatgaaattatcttgtattagggaatattgttaaataaatagattttagttgctcttgttccctcaaaaagcaactatgtgagatgttgaatatgttaatctgctttactgtagtaaccattgattagctgtatgaatcccataacataatgttttaaactggaaatacacacaataagattttttagaaaacaaacaacaaataatctactactaaaagttgctgaaactaaaatttttgtaagttgactgttttctccattgactagattacatttagaaatattttcaaccagaaaagatgttcccaaactttattaacacccaattaataattcttataaaatatttgtatagatagagatagatatatttaactgaaaaccaagatactgaaagtaacatttagcaaggcaacaacttgcctgcagaaaatacagtagtgtgtattggggctattgaaataaatacgtatcaagaatctaatattctagaggagaatcataagtaaagcatcttattgacaatacctaataataatggtactatttattataaagacatgtaagttgattgaaaactgactatataaagaggttctgaggccaggcgcggtggctcacgcctgtaatcccagcactttgggaggccgaggcgggcggatcacgaggtcaggaaatcgagaccatcctggctaacatggtgaaaacctatctctactaaaaataaaaaaaattagccgggcgtggtagcgggcgcctctagtcccagctactctggaggctgaggcaggagaatggcgtgaacccgcgaggcggagcttgcagtgagtcgagatcgcgctactgcatgggcgacaaagcgagactcagtctcagaaaataaataaattaattaattaaataaaataataaaataaaataaagatgttctggcactgttcaagaacaaattctggcataagttatacattttgatattcttaagtctgctgtaagttagtagaactcaaaatgtttaaatgagtaccaggccttctatttgtgtggctttcataaaattactctggtattcttttcggtttgtttgtaagcgtgtgtgtgtgtgtgtgtgtgtgtgtgtgtgtgtgtgtgtgtatgtaacattaataaggcattaagccaagatatgtatacaacatttccatttgaaaaatctttggaccaatagtttgatcattaggagactttaccattgtttttgtagttcagaataggtcatttgccaaattaaacagaagtattatctttcttaaggcaggtggagataggaatttatgaatttattcaggtccattctaaaggaggcattgtaaaacaatatcttgaaaagatcctacaccttctttccagatacacttattgagtagctaccatgagtaatgatgtatagtttcttttatttagaggaggaatacagctatgattgcatttatttataaactattaagtcagaaggttcaatacttaagtccaaggttctaagattctagaaaaaaataatatgaccatgtcatctgccttctacgcaacccccacagattcaagaataactatgtaattatcttctcaaggggcttccactaattcgttttcaatcatcagattagaaggtaacatgctgtagcaatgttatttatatatatatatgtgtatatatatatatatatatatatatgtatatatatatttctctcctgagaattggatttaatatttggagacattcaacttttccccaaagtagtaaggagattattcagctccttaaggggtattttttttctgaagggataatgcaaaaaggaatcatggcatctcttgattggagtaaaatgtaaccatcaacattggcctggtgggatctgagttatgataaatggataaaacaagattaagttttttaaaaatgatgatgtatagctatttcacattttaatagaattctgaaatatagatttgaccccatcactttcttgcacagacttccaatattgtttttaaggataaagttcacggtctacaggttaacattgaggtttttaaattatttttgtctaatttttctagactcacattcctctacttctccacatgaaactttcatctgataatgcaacacatcttgctgtttcatatttctgtcccttttccactttctttattccgggaaaactttcgtacttctataatctgaagtttgattcaagtaagctcttcctcccgtttagttagataagcctctttctgtgttttcataggcacattgtgtttctctaacacaacacttattacactgttatagcattcacttacttgcctctcttgtccagcacttcaggtgtttttgaggcaagggaataagttagattcatctttgccatctcagtatcatataatgtttggaacacagtagatgtataataaatatgtatgaaataaatgagagctgagcaaagctcagtttttaggccaggtttatatttttaatcttgaaagtggtctctaagatcatgtccaaccactgaattacatgcgggggccaagaagccaagacttcagtgacagatcaagactaaatgtctaagtgaggctaaaactgtcaaagttaatgcagtttttgctttgaggaaacttgatatgatgttaaatttctaaaagggcaaggaaagtagaattgatcaggtagcagaaattttacacagttttggacatcagaatgagcatcctaagaggagtacacaaactttgaccgttttcttctaccctcttcactgcatgggtctcaaatctggccatggactcctctagactttctccttgggaaataggccactggtgagttttgcagaatttcaacagcaactttacccaaatggccaaaaaaaaaaaaaaaaaaaaaaatctatgagtagtcttagatcttctttcctagcttgcagacctcctacttatttttcctctgactagtactgtaatagaatattttccttttttttacttaacatgctcttaagacaatcctaaaaccaaccatcattttaaactctaaatctactttttatttattattctttttatgacacaacttttcctctcaaaatgtttataatttcaataggcagacaataggcaaaggcataaaagagaatgatcaagtgatgatcaagtgctactgtacgtggaactgacagaaggaaaagtcacttttccagcatatttagggagaacttcagtacaaagcagcaactttaattaggttaaatatatatctagttttatttggattcattgagttaaaaattataaattgagagacatggcaatataggaatgataattactacctagaatcagatagcccataaatttatgtgatctgtagaattttaaatcacttccatggcttattcaacaaacacattcaaaaatcatctatctctgtattttattttatattcttcccctacgaagcagatatcttaattgcacatagtttatatgaataattcacagcctcctaaacttaagtgcagtctttcaaattgtgcagaatattttaagcaagaaaacaaacaaaatatccaaaatactgtcttctagtataatattgcaactgtatagaagaagtttttattaaacatgttgatgcctcttcattgagttatttctttggtttaattttttggaaatcttacctatctcaagaagtgagaagatacaaaattacaaagaaaactggcttcataaattggtactgaaagttgcttttactttgaaaggctttttgctgtatttcccacttaacaatcaaaagttcctcttagcagaagttagccaaccaataagttatttgagaattaagtttattttaaaaagaactgaatgctatacattattatcaatattattgttattccggcatgataacatttgtttcagaacaacttagaaagtcatacagacattatacacttagactgaataatcaaagaaatggcagtagctcttttatggtgaaagaatatcaggcctcaacagataaacaatccatgcagaattatgaagcctgggaatgagttctgcaattctcaatttagtttgcttcagtttagatcagatttgggttttttttggacataaatagacatttccataataagggatgtattcctattgctttgaatgggcaccattttgcccacttcagtgaaaactgtcttatcaagagagcctaaatcccataatagttggcaagttatatttatttggcaattttgacagatttatgtcttaaaatcatgtcagatcgaaggccttttaagatctttagttcaagaacctttactgaaatagcattaaatgtctgatttaaactgacaagagaaagaaaaatgcaagttaagactgtcattcccaggcactcagcaagttctgtagaatgttttgaggtccataaaagagctcctgaaaagttaatactaagtgacctttttttttatatgggacttacttgatttttctttttctttttttctattttttctttgaaatattctaatatttaatatctttgactttctcaaatgttatgtgtttttaagacttcagttacatagaaagattaagcatctgtaacacaatatttaatgacaggactccctgaaaggtctgagacatatttctaaagtataatttttttaaataattgaagataaaatattcccttcctttcaatgtattttttttaaatttccttaactaacagtttgaataacctgtattagatttacttaccagagattagcatctttttaaaccttaattgaatcaaattagatatcacatttgtcttcacacagtgctcaaaactgtcaaggcgactttagttcttctcccttttgattaaatggttagccgtttagtaacagctatgaacagctacaatggcaggcaacacaggcagcatcagaaagacaaagagagctttgtaaaacttcacatctagctccataacatattgattctatgtcagcataattacatatatcaaattgactctatattgatgaacacttgcatttgaacttgcatactgagtgatttctataaacagattttctgtatctggcattctattagctcactctcgcttttatgaagagttaactctttttttttttttttttttttttttttgagaaggagtctcgctctgtcgcccaggctagagtgcagtggcgtgatctcagctcactgcaacctctgcctccctgggttcaagcgattctcctgcctcagcctcctcagtagctgggattacaggtgcgtgccaccaaacctggctaatttttgtgtttttactagagacgttggtcaggctggtctcaaactcctgacctcgtgatccgcccgccttggcctcccaaagtgctgggattacaggcgtgagccaccgcgtctggccaagagttaattcttccgtcaagagttagttgttcttcatgatagtggccttgtggaattacattattatgaaatgtctgccaaatcagaaaaattttattgggtggggtacagttttagtagaaagcatagtttattattctcaaattcgttgaaaacttataatatgcatagggatataggataattatcaataagtataagctgtacacaaccatttaagattacaaataatgtgttgggtttcctcctgaattgcctacattaaagattgtgaaaaacaaaattcccaatatttttaggatacccctttattcgtgaagctggtatgtctaagaaggagagatgaaacataagatttatcttcaataaataagtaaggctgtcatgtagggttttttttaattgctaccaagccgtctttaatgctacaagagacgctggcattatgtaatgccttttgcatacatcaggtcatttttgagaatcaaagagtaactatataaagagttccattatctctgtccttaatgtgggacacaaatagaccaagtaaattgtccagaattacacatatagcaaatggtgaagatatgcttcaacgccaatcctgcaaaatatactttctactataccaaaaaaagtaataggtacatgaaaataatgagaaaaataaaaataaaaaactgagcaagataaataaaagatttaatgtgaaaaatatgtctgccattaagaatatggactattaattttaaaagaatgtatttttaatgtgcaattttttcttctacatgtatatgtcctatgtgtatgaattaacatcttattctaaaaaatagtttatcgaaatatttgtactctttatttcccacaaatgctgtcctaataaatatttacaatttataaagttagtgtctctaaactaaaaagatataaattttataaagggtgaatataaataaaatatattaataatgcatttatatgtttataaaatatcattttgtagtaaatgtatttgagagtatatatatatttttttaaagttctgtttttatctcaacctaagaatggagatgaaatggcaatgcaggtgtcagacaatgtgggaagttttctttctacatactgttatttaattttccttgaaataatttacctttgcatttttttaatattatgcttagagtataaaaagtgacttttttttttttttgagatggagttttgttcttgttgcccaagctggagtgcaatggtgcaatctcggctcactgcaacctcggcctcctgggttcaagtgattctcctgcctcagcctccccagtagctgggattacagacaggcaccaccatgactggctaattttttgtatttttagtagagatggggtttcaccatgttggccagactggtcttgaactcctgacctcaagcaatccgcctgcctcggcttcccaaaaaagtgactatcttgtacctaaatatggatcacaaaatatttcttgcactggtcaacacaaactaggcagaaaaatattctcatttatcaatattcttttattcattaagtgcattttcttaagttagctcaaatagcttagctgatgattgttaacatccacatttctatgcacaagtaaaggaaccagagagataaatctcccacttttcatgacatttgttgcagaggagccaattcgatcctgttaattggtttctgatttgtttcgatgatgatgtacagatggagctagtgaaataggctttactacatagtaagttgaccctctgagactcaaacttacttccctgggtctccctagcataggaaaggtgaaaacagtgtagctggggcatggggacaatattaactctgcatcaaattaaagcttcacttatccccaaagtttgtatgcttagatctgcaagaagcttctactcagaggttgaaggtgaggaagggcatgctttccttttcttgatatacccagtaaaggactttctttccttcttttaaggtaatacaaaatagttaattgagctcagttatgcttagatagaaataactggagtaagatctctataaaccaccaaaatttgtctactgaaatgattctgtaagagccatatcgtatggtgaaatcttagtctgccggaatgaatcaatggaagcagcatgctatgtttgagatgaaaattgttttgactttaagattatataacattgaggccgagcacggtggatcacacctgtaatcccagcactttgggaggctgaggcgggcggatcacctgaggtcgggagttcgagaccagcctgaccaacatggagaaatcccatctctactaaaaaaatacaaaattagctgggcgtggtggcgcatgcctgtaatcccagctacttgggaagctgaggcaggagaatcgcttgaaccttggaggtggaggttgcggtgagccgagatcacgtctttgcactccagcctggacaacaagagtgaaattccgtctcaaaaaaaaaaaaaaaaaaaaaagattatataaaattgaaactgttttttagtcctgtgccatgtttctgttttagctatgtttaaggtattttcacatatgtgtgttttctcttgtatcttcaaactctccttttccaatgacttctttccttctaccatgaacatactcaaatatcttctgctgaaagaggagcaaaaaccaagcaatgacaacagaccttccttctatcgtaaccccccttaagactttgccttgaatttgtcctgatgttatggtaaaacttgtaaagaacagttagtcctcctttcctctaccctggtcattcctgaacctatcacagtttggttctgggctcaacagtctcatgaaaggaatttcatctggtcattgattacttcccattttccaaacccaaagacctattttaagttctctttgacattcccctgatatttgcaactgttaattgtaatcaactcctcaaatcccttttttaatgttcctggaaattaagctttttatcagtccaaatatgatctttttgtcagtagacaattcctataggaataagacacctttaatttgtttatgtagctttactttttgtcatttctaccttctactttgtataaattattaacctacttaaataattatgtacacaacatagccacacacagtgtctgttttacctcagaaatgtgtcttgaatctgtttcctctctccatcctgatggctgctgccactgctttgactcttgcccttgtcttctcttgcttcgctgattgagatattctatttagtcttttctccccaaagtcctttcgtctcattaaaacgtatacaaaaacatagaccgattttgtcactgccccacttaaaatagcccttggatacctgtggtggtcagaacactgtgtttactcagtagttattatggcattggtggccattcccaatttggactcaacaccacactcatcactaactacacaagcagcatgctcctgctttccacatctgggtctatccctccagatgtgcatatttgtcaagcttttccccagattgattcattagagtcttttacaacactgtaccttttacaaatgtttccttccctggaaagttgttttcacagtatctttgcctaaaagataaactccatgatcattccaaaaaacgcagtttactttagttcaagtaaagttttataaggggacttctacatgcacaagacggagaacataaaaaaagtatgttttttttttgccctaagagttcatagtctgtaaggagtgggggaatagagaatgtgatacactttgacaaattaataatatattatgaaaacagaaggaggcaggtaaacactgacatcattagggagttacagcgagaggagctactgctcttgaacacattctccatattaatactttttaagacttttctacacttagagcaggtagttaaagggtaaaacccattttcagtgctgccatagaagattttggatattatttttcttcaaacacagcaagccatgtagaagagagtcagggaagcctttttaaaaagtaagtagagttcaatatctcctccacagagaagcctttccatattcccccaggaagaactcatattcttgtctcttcattctcataggactgttcatatctgtcatgttcactggtctatcatgggtattcaataagtgttggttgaatatatgtacaatgaattttttaaacatgaattaatacactataatgtattataattgatctatctacttgtttgtaaaattttaggaagaactgcatatgaattccatggtgaattagagactttgccacaaactataaaggcaactctaaacacgtgacctaacttcttaggctttttttgtttatttgtttttcagttatttttgtttttttgttttgagacagggtttcctctgtcacccagactggaatgcagtggctcaatcactgctcactgtagcctcaaactcccaggctcaagagatcctcccacttctgcctcctgagtagctggaactacagatgcatgccaccacggctggctaattttctattttttgtagaaacagggtttttccatgtagcccaggctggtctcgaactcctggactcatgtaatctgcctgccttggcctcccaaaatgctgggactacagacgtgagccaccatgcccacctaagcttttttgttatccccaaattgaaagcattagattaaatgatttaaaacattattttacagatctaaaatttccttttctactaatttgttataaatcaaacacagttggaatacatttattcagtatatttaaggtaacaattatcactttaaaaccacgtcttgttaaatgttgaaattctttatttatttgtaattcattagtaagaacaagaatttacaaattccaggctaaaagtgtattggatctcttgaaattagtatttaaattttgtttattaaaagctgaatggattacttaagatgaaagaaaactggtttaagtttagcccatgaaatatatctacatcatcccagtagtaggaaagtgctattcatctcagtaaaattaacagaagttaagttgattgatttagctattatcaaaatcttttatttttaaaagcaaatgatttttttcagatgaacagcaattatagccaaaaggtttaaattatctaggaaactttaatttagtcatagatagtgacatccatataaaccaaatatataagtgacctgctgtatttgaaatccttaatattacttccaatgctgcaaggagcactttgtatagctcaagctttgagtgtttgtaaaaaatataaactttgaatctattagaaatgatataataaaatttgagcagaacataacaaagcaaaaagaaaattttattgtgacactgtgaacattggataattataaaaaatagtgctaaataaatgaaataatcagaaaatgataaagaagacggtgaaaaatattgctatcataaatttaggtgttcttgaattattctacttctataaaagaagaagaatgtctaaattttaatagacgtatatttgatattttgtctctctagatgaagttttgatagtacattttacatttttttagtggtacaaattggatgtgtagcaaattcaaaatatgaatgtaattttacttaagaaagtcaagggaagccggatcatactgaatgctgtctttaagcagttagaaaattaaaattttagagaaaactaataataactggcaatattataaatatttgtaatgcagtcatgtattgcttaacaacagggatagggtttgagaaatgcaccattaggtaatttcattgttgttatgtgtgaacaccccagagtgtactcacataaacctaggtggcattgcctactacacttctaggctatatggtctagcctaatccttttaagctacaaacctgtacaacatgttattgtattgaatactgtaggcaattgtaacacaatggtaagtattgcgtgtctaagaatatctaaacatagaaaaggtacagttaaaaacatggttttataatctcatgacaacactatggtatatacgatccattattgactgaaatatcattatccagcacagactgtattctaattacttttataaaagttatgaacatttaactctaagttaaaaatcatgtttattaatttcaaagtgatgttaaaattagataaaactgacattttatttgaggcataccaatacaccaaatgactacatactcactgctgttaggggtcttttgaagaaactgaatgaataattgttgtgattgtttgagtctccactatgtgattcattgaatcccagtgattctgtcttgtgttacccttgaaatccatttttcaaggactgataatcatatttaattttttatttctgtttttataatgttaatgctaacttataaggaaaccaaattagtaaataaagattatggaccatcaaataataaagaaattcactgatacttgtttctccttccacctatttagttgcctatattatttgggagaaatatagtcacagtttcataacttttatagaagttttgtataatctttatataatatttgttggtgctatgctacacacacacatatgtagtagaatgtatatgtacactctaaagtttcaaataaagcatactaaacgatttttcttgaagtaacagttgtaaacgttatactttaattgagttaaattcacaaaatccaagtattcgaaacaataaaaagaaaatattttctgatcaaatttaaagttaaaaacaacatactctctcataagaaataagcttggacatgaccttttttagcataatgactactgtcatttcaatgtcaacctttgaaagcatccattcttgttaaaaacatttgccactgctgacaatttcagaacaaaagttaagtgggaagaaacttaaatttgtcttctaataacaataccaacaaataattagtatgcaatttttgttcttctctataatccacgtgatttagagaaatatttattcagtcttcctgccacaattattggaccctgtatacttgctgatcaacagaattcattatactcagccttgtaatccaaggaagtaaaaatttgtaattatttaaagaaaaattagaacactgtattaaaacaatcacattgataacatggacttacatcatgaaagatagaaggtgttatagggaggtgataatatttatccaatatgtggggagattttggctttagaattttgtagagtcaaataagagagattataataatattttatagcaacttagagtagtgtagcaagggaataaaagaataaagtagctaataaaaagtgttttaaaatagaacttaattgagattacatgacatgtgtgttaacttttgcttttcagtactcatctatttgggaggagtctgattttagaaacaaaatcaattttcaaacccaatgaaaatcagcatcttttcattgtattctcatttttgtcatttatggctaagaaatcatttttgtaacaccaacaaagggaaaattacctgattttttgtggtaaagttttaaaatcatccaagttaatgtgaataatttgttgagaaaaataataattgattgtgaaagttaacacattagcaaggtaaggaagtgctggcatgcttgagcagtcttgtctttgcatcttatttttctcatctgcttcttacttgcctaaacatgttcatcagaaattataaaaggatttgtcctgtctctggttcatatgcatattttgctaccaaaatgtataagaagaaacttaaagatctcaaacactttattgagtttactaccaacattgtcattaactgtttattgaatgaagtacttgaggtaatttagttcccaaaatgacaacctattgtctgtcctctagtaaattctgcctattcagctctcccccaccatcaccctcaacacactgctaacaccaccaatcactgccctgcttctctcatttctggacattgaaaaccttttttatatgtagaataatggcttttccggggtgagataaggcaggcagtttctctgggaaggctaataatttggcatttgaataaatctttaactcacatgttgagtcttggattgaatcaattcaatccaagtttaacatgtgagtttaacatttatcattgaatcatatgttgagtattgattgattattattgattcaatccaagactcaacataggagttgaacattttaactctgtttaaaggaaatttttacatatgtaaaatgaaaatcaacaaataatgttggatgtacaatatctattaaagatccttatatggctgatttgcttggtatctctaaaattcactccttacccaaacatagcaaaacagaaatgacaaagcagaataaaaaaaaatgaagcctatatataattctggctcttgcctaatggttgaaattttaaaaagataaagtaaggtgataaaaataggacatgaataacatctcgaagaacaatccatagctgtcttttttccaattaacaaagagctttcagcacatattttaaaagaaatattttacttttaagaatgtagtcattgaagctgtggatgtcattttagaggatgatttactaactgcatttttaagattctacatgtgaaaacgaggcactttggatttccttctaagtcagcactgtgcaagctcaagagaatattaaatgtagtattttctgactccattaaatatttaatagctttccttctgttgtctctatatcaaggacaagtcctgtaaaccttgacctgaaagccctaaaatgagttaaataatctatgaaaacaatcatttaaaaaaaatctagctgaaagatttaaaaatctgggaaaggaagcactcagttcatatttgtccatgcatgcaagtttcacaatgtttcagatactttagtcttaaactgaatattcactttattcaaataataaacacatttttaaagcctaatacttatttgcatatttctctttccttgtgtagaaccagcatttggatgttaaactatttattttataaggatcctgaaaaaaacactatatataaaaatctagaagacaaatgaaaaataaaagttaacttcattctcctggctttattgctcttgcagtattgatgaccagagtttagcatgtatgcatgttgtgttttcatgcatgtgtatgcataaaacactattttatcagtctagcttttcttttctgagtctttctgatcagttgagttgaagattcttgttaaacaaaggcccattcagagaagacatgtatgttataaagaagagggctttgactccagtctctaagcttcagtttgcttttctgtaaaatgagttaatagaatctactatgtaatatgttgttaagattaaataaaaaataatttttaggacagatgaattcactgaattttatctattagtgttattattactattgttatttttggaagaaagcatacgttttattttttggagtcatgtcaaaggtagcattgctactggtatcttaaagctattcctaatttctctattgccacttatttatcctataaaactgttatcagtggcatagcccttaatttcttcctttcctgatgcttctcagaacaacaggtacacagttactttttgggaatagaattagttaaaaacaatttgtaaaaatcatgtagttatgatggcttgctgattggttaagagtaagaaaagtctataaattagaaagttttaggattagcattcaggaatatttgacgttaggactcactgttaagccctataaaaattatgaatatttgtgatgacctctatggacaaaattgattttccaccctcatgatgcagtaatttctgtgttttgtgtgtgtgtgtgtgtgtgtgtgtgtgtgtgtgtgtgtgtgtgtgtacttgtcacttatatttctcagcacccagtagtttgttaatcccttgagatggattttttcctatttctttacttaaactgcttcatcataggaaactatgtggcctgattatttcatccaatagacgtttttatcttctctgaattcagcataaattgactgctaatctctccaccttgaagcatcctctttcctttacatctctcacagtaccctactcttgtcacacaagatgacaatctattttctaatttgtcttagtttatatctttcttcctattctgtttgttgttttcatgaaccttcttaaaaatccacttggggaaagtggtgtaaataaataaaccaagattgagttaaactttatgtttggtatggccataatctttgccattatgccttcttaatagttactaagcaccaaatcaatgccattaacataaaatctgaataaaactctctgttacaagcttattttctatcaacggagaagaaaatcaaatattacagaaatgaggtaagtgctatattagaaaactgaaaggaagtggttaattttgaccagatttcaaggatttgttaaaagactgtgtgattactgagttgaagtttaactacttagtagttctttgccagactcacaaaggaaaaaggtgaattttagacagaaggaactgcatgtgcaaagtcattaaatagcctggtacatgataggagaggtgatattcatatcagaaaaggtaggtaaggaccacattaagggaattcttgaataacatattaggaaaattctatgtccagatgcagtagtgcatgcctataatcccagcagtttgggaggctgaggaaggcagactgcttgagctcaggagttcaaggccagcctgggaaatatggtgaaatcccatctctatttaaaaaaaaatacaaaaattagccaggtgtggtggcacatgcatgtaatcccagcaacttgggaggctgaggagggagaattgcttgagcccaggagatcaaggctgcaatgacccgtgatttcaccactgcactctaacttgggcaacagagagagaccttgtctcaaaaaataaaaataaggtttttaaaagaacattccatattatctagtagttgggagccattaaagtattttaagcaggtgagtgccataatcacatttgttcccctaaaagagtgcttattcccagtaatccaagaaaaagtaattaaaagcatattaaaagctaggctgctggccctgggaatgaagagaagggagaaaaatgctagaggtatttagagtctgagagtccacaggattcagcgattcaatggatgaaggtgttggggaagaaaaaggattcttggtaccaagttgtttcattgctaaatgatggtccaaaataacagaaatatataatggaatagaaagggcagatttgatcaacaaattgggcaagtgtaaattgacgttctcttgaaaatttcaacaataatatgtataatagctagtattttgattgcctttattgattgagattgaagagctttgtgtatttcggaattactattataaaacgccaagaaaaggcagagctggagatgacatttgggttatcattgatgctgtggtggcaggtggattcatggaagtagatgagattaccagattttaagacattccaatatttaagcaatagacctagatatttatgattattgtagatctctatgactattgtgaattccttagggtagaagaattcataatattaaaaaatttatttacatagtaaatgcatagtcatatttattttataatctagtaaagcagccaattgtattgaagattaactttgagactttgtggtcttgtatagaatcactagtttgtcctgttagtcatacataaaaaggctaggagacacctattttcctggactgggatataaccaagtgatatgagctaacattttaatgaaaaataaattgtgtgaaaggaaaatcatttaaaagagacaaaaataaaattagaagagtggcactgttttacacttttgcaaatctcttttatatcttgcttaatagacaatgggtgatttctcctacctgcttctgcattcaatgagttgagagaccacatgtcatgtagcctctagagaactccactgtaaacaagtgagacaatgagagtgaaaaaggcaagaaatattttagtattactacaaaactatgcttgactatatggaccccagaaaaggcctcatggctactaggagtccctagaccatgatgtgaaagcagttgatatagttaacttgttaaggcatgcaacactaaagttcattttattgtacttccaattacacagccaatcaatcaatctcttatagattttaaatatggtttccttgtttctcataaccaaattgcaatttacacaggatcttttagtgtaaatttacctctgctctctgggaagagtttgcaagtacttgtaaaagtgctcctcagacacaggaggaagggagactctagtgtctgctgctcatacatctgaataggaacacctgctggagtgtaccagataggattggaggggttctgcctaagctgattagcaaagaggagcagatgtccactaaacaaagatcttaaggaagaaaaagtactacagctctaacttaatatgtaatatggggcttcattggagctacaggtgggtctagctcccatagctggatggaaattggctacctggggattatgttatggttttagaaaaaaattactgagcaaggagaataaggacagcaagaacaataatatttgagactgaggttttggggaccctttggtttacaggtacctggactaacaaaggtggtactgcagggtagacagacattggtggcactatgtaagatgtgctttaactgcagtgccatagtgctaaaagaaacagacttttctggatcagaacatctcttcagcaggtgtttgtaagctagttacctcccttcacctccatcactttccattaagtaaaaacaaatatttttggataatttattttgggacatgattgttggcttcaagaaagacatattgggactcatagcagataaggcttaataatgtgactctataacactagatggtggtagagcagttcatatcataccaagacaaattaatcatttaaaaataaatttatattaaatatattaaagataaaaatattagggggaattttaaataattgcaattttgaaattacaattctggtttatgtcatgaaattgctatatattgtccattatcattattaagagtgaaaagcataaaaattttcttcagtgtaatgaaacaattataaaaaacatttttataaaatatggtaattacacactttaaatttcatcatgatacttaagaaagcaaaatgatactatatgttcataattgatgacttttaattctggttacctaattttgtacaccataattcattgtgataataccaataacacatcaagcctttctttcttgtatcccagaaaattacatttttgtgtgaatggataggccttgactctaaacaaacaattacaattccaattaaatcaatctgtgtcctcaaaataaaaatatagaggaaggattgtatatgtacattggataaggatataaagaaaacatggtagaagatatttatcagggaccacatctgtctcagtggtcaatagtaattttgggtattttttttatgttagaagtgaatgttatattgttttatacctatttctataacaatctttataatatatacatgtttatgtataatctgtacttaaatatttatttatacatagaaacactttatgtggatatagatataaaaatctgtaacgtgtgatatatacacacatttatatatagacacctgaagtctaatcttttttactgatttccaagcttggtaattgtgtatagtggtttcattgaaatgccagctttcttcaatctaattcaataccataaatgtggtaatgtttgtggatctgtttttaagtggtaaaacttggataaaaaaaattgattttatcaacagcctcagaagaaactgaattaattctcagctctgcatggaaccagcagaccagacagtggaccctacttgttcctacttgattggcctttaaggacagacttagcaatgaaagagatttttttctctctatagagaccaaagttctatgaacaacaaactcgttaattatggcaaaattagtgtataagacatgaatatacacaaaattaagaccatcagctgagtttatggtgctgtaaaaaagaagaaaaattaaaaacttccaatttataagttctatgggttaataaaatcaacttaatggtcattcagaataatcaggcttaaccttctcttggttattacttactttgaattttgttttaaaattaaacctagaatacatgcttaaagttttttgtagagaattttaacttttcagacatttatggaatgaattaggatttctcattaggaatacctctgcttaatgccactcttacacccagctataaccactcctaaaaatatagtgtttctgttcatttgctttattagttgtatgtaatgagaaaaaatgagattacattctgcatattgttgttctgcagtcatttgtttttaacttaacatgattccttggagaccattccatgtaagtacatgttgcagtatctaattccttggaatgctatattacagacataccatcaattcagagacagacatttttattttttaattataaataatgcctcattgaatatcattctatttgtctatccttgtactttaatgtaaatttttttacagtaaatttctaaaagtggaaattttggatcacaggattacatgaacttctgatacttgaacatttaaaattcttgtaattctttagtctttattttattatttaagaaagaaaagcaacaggagcataataggcatgaagtattcccatttggaaagataatgtccttagaaatacaaactaaaaataatgcaacttatgtaaaattataaaaatggaaattccttagtattatattttaggtagcttattttcatgattttcccatgatgttaattttcaaatattaaattatctctctgactttcatttacaaaatagagatgagccttatattttttaagtttttcttcctttatattttatagtataggctgatttttctattgtaaataataggaggatgaagtaacttttaaaaggcagattctgtgttggctccagtggaatttttgcataccaaatcaacagaattttataatttattcttttactaatttcacaacaggggctgaagacctacttcttgctttaagtcatggtcctggggatagaatgtttaagtctctctgagcaacttgtggatatgtggaattattaacaaaagtatgtgaaaattgctgcaatattagtgatcctgggcgagagtagcacagagaaaggacacagtctaggcacagttttgaaaaaatgaataagcatttgtgaatatgttatagagctcaatttcactcattttaatgataacaagaaagagaaaatgaggaaaataaaaatataccccacttttcatcactttctctctgcctattatacatacctaaaaatttgcttaaatatttgcattgaggtaaattgacatgagaccctccatggagatcctggactatgaagacttccaactcatggtcactgattggaaaaaaataagagtcctggccattctctgtaattaaatacatggacatgactaacggagaaaaatgtgcctactgattagactcacaagccaatattttaacagagtatttttactctgaaactacctgggatgatgcatcagatctgtacaatcagttgacatgacataccttgtctggagagctttctaacatttcaattattcagcatgcctaattttatttttaattaatgtctggaggagtttttggtcttatcacagggaaaagacagagagagatggcagtgtgattctcttccccattttcttgctaagacacatgctccattaagagaatgaatggaaggtactattgacgacatttggacccataagccagttcaatttgctttttaaatttggcttttttttttgcttcaatattcatttttcattgtttgatttatattacttaccttttattcatatcattttaattcccactggaatgtggtctatcttattcatttcctcatttattctttcattaattcttccacccctttatctatcctgccatactcagtagtaacaatcgtgcaaggagcaagaaatacaaaaagtgaatatgatgccagtctagtccttgaagatttctcagttcagtgaaggaaaaaatacaaataaaatctcttcccctccatttctttcctttttactttcttttgctgaatgttattcaatgtaacctcatatttacccatttaagctctactcagtgagccagaaacaaaagaaaacattctttatatccaaagagcttagaattaagttcagataaagcgcaccaagtctttgctaatgcaacccaagtgtttgcctctggataattctgagtcctcaaagccactgggtcacccattcatttgatacttgaagtaaattgctaacaaactgagttcctcttccttccatgggaaactctgtaccttctcagtatctccaagaattttcatgggtgctacatttccccttattacctggcattcttatttttatgactcttctgtgtttcttatacctataacatatcccgcctcccatggttaacttctctcctctttttgtcctctgctggcccaataccttcattccttgaagcagaatcaacatcaagctcattttataaaatagccttttgctgaaagcaaaacagaaaaggcatcatcttaaaatttaatattctccattgttattctcaagttctgctactggacctgtgaaggaatttctcatttgctgaacatcacattttcagctcttcctccttctccttagagagcttttccttttcccctcttcagaattcaacctcagtttccaaatttctattatgttattgtcaagcatacttttgttctgtcttagaatcctaagattattatcctaagattagaatccagattatgacaagcgtttttagctttcacaaataaaaacattgcctctctggctgttttttttttttttaattggagacagagtctctctctgttgcccaggctcgagtgtagtggcacaatcttggctcactgcaaccttttcctcctgggttcaagtgattctcctgcctcagtacttgggaaagtagctgggattacaggcatgtgccaccatgtccagctaatttttgtatttttagtagagacggggtttcaccatgttggccaggatggtcttgaactcctgacctcaagcgacccatccacctcagcctcccaaagtgctgggattacaggcgagagtcaccgcgcctggcctctctggttgttcttaaagcaaaataatcatctacctctgagatgaatgttgtctttttctcagaatgccgaagttgttttctttttcaaatattattttattttcctcttagagtaaaaatattactatatatatttatatatgttatatataataaaaataattatttaattatataaattatgtaatatatattatagcaaaatattactataataggaaaataaaaagaatatttgaaaatggaatcaactttggtattaaactggcaaatttacaaagtacttaaaagctaaagatatacagaattataaaaatagcaaagtagaataatacaaatacaaaatcatggtgtggtcctttaaatattgccaataaaatattgataaatacaagtgccaaacaacttacataaacaagcaacttttggttttcaaagttttgtgtcttagatctgtttatatttgtaggctgttcacatgttttatttatgcacaagtatttgcatagaaaccaaaattttgtcaaaatacacacaaacacacacgcacacacacatcccattactaaggaggtagtgagctataaaggctttaggaagattcttctgagtctgtaaatgcctgaaatgcttcagtctaaagtagggatggtgaagagtgtagttggggtgggagttagtaggtacatattggcaggactctaatgacaaaagattttaggtagaataagaaacaatcatgactcctaaatctacagataaaattgggattagattaagaagtaatttatgaatagaggataactgattcttcctctgaaaggttatcttttaatgtgtacataggatctttatgatactaagtgttacgacaaatgattgattaaaaaatagtagtacatttacttgtacaaagggaaaactgaatgacaaaagaatgttattatctcataaaacgtctgggaaagctaatgatcagaccacattgccaaaacttagagcagttggaaaatgtgcatgaaagagcaagtcaaagccatgaaaatgacctgccttagaatactatacagctgatgtactaactggcacactgtagaagaagttccataatttgaggtggttctttaaggcagatagccacagtcctaagatattttagtccttttgtataccctttacattttggtggattaaaactcaaccaggtaaaaagggaggtggtttcaatctcttcttgaactgtctcagctcttcccaatggcatgcttgaggactagatattaggggcaactttggattttggatacattctattattttcaagtaagaacctccctccgcttgactgacaacttccttctcctgaatgactcttttgtttagacatttaaggaagaacctattggtgttcatttagcatgctaaacctgagtgttatcacagattactagtgatctctagcactgctgactataacagtgccattcattcaaacagctggatttcaagttttcagatctttaatattaagaagtatgtgatcccagcataaataaatggttttcaacacatttgtattctgcatttgagagtttggtaagtgaggggaacagaatctgcagctaaatttgtcaagttagtgactcaggcttatcattttgtagtttatgaccatggaaaagtagcttaaactttctgtcctgatatccctgaactgtaaaatggagtaggagtagtgctgttatgaggattgatgtgagttaatgatgtaaattactttcaacagtatatggtactactaagaactatatgagtgctttttttattattctgtgttggtggtaggtgtgtgtgtgtagtcatatattattggctgaagaaatgaattgaatttaagaaaactctttcagctttatagtatgttactcgaacactttgagatccattttcaagagaggaagacattttcatttaaattgctcctttactgggtttttctcctttcagtcttatttattcttcctccctaaatttgcacttttggacaagtctccacctgaagttgatgtaatttacatggcagcacatattgcaaagattttttttcatgctgttaccatacgatatccagaacattttatatatgaatacaaatctacagttaaatttgggtagcttccaaatttctatcactgtgtcatgcaccttaaatttaaaggtttaaaacttgatcatatgcataaagatttctaggatcataaactgtcatctaaatttctcttttgttttggtgtgttttcatttgcaattcctttacagtgattttcatgttctctttacaggttatattttcttacacaaaaaaatctcaataaattatattccaacataaagcaaacctttgtatctataagctgaaaacagaacctgaaatacattacctgtacactctaattaatgttacatacatgtatcttcttttccttaggtcatatccaagtgaaacctctaaatatgctgttattcttttttatttacagggattgttgcttttagattagaatcaacatatattacgattcagatcactatgggtttttttatttctttttcctctacagtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcaggtaaggcaggacttcaaatgcatgttattaaatactttatagaccagtatgttccttaggcagaaggcagtcattctcattttctgcaaatgttcatgagttttcagccctaaccctttcacgaaatgtgtgtttgtgtcaggcttgtagatagctagactgtagcattttctaattgaaccccaagtaggagatggcatagctggtctatagagttttcctgctttagtgggaatgccctttgctgatggtgccaatattttcttttgcctgtttgttgcttttgtgccaatgtttctttgtttccctgcacgatgtgatggtatgatattggccatttttcatctttcatcctcaaaatgttgatctccatatcgtttggcttggtgtgtttgtctcagttttacctctgccacatggtgccatgcatctcaacctaattcacaagaagcagttatttaagaagaatggatgcttacatttcaaaggcctaaactccaaacaggtgatatggaagataacctttttgataacaaagctcttccctagtaatatcctggaggattgattaaattttcattgttcttaaattaagtagggtatctcattataacccctttgatgagggtccatgccatgtaatataattaacccaccatttttcagggaatagatgatctgctttggccactcaatggcaaagttgaatttctcagtggaattcctttttaggtacaatgtgttgggttctgctctctctcagaactgaattttgaatgatttactgcttgagattagttgaatctctgctcctccccattgctatagacaatgtagagttgatcgactagaaattgacattcagctgccaaagtaatagtgatgtcacctcttgtctactgtctggtacaggtaaaatattttgcagattaaacaatttaattagcttttaccctactaggaaaatgtagggtttattgattccccataacttagataaatttcatttcattttttcttacagaaaaatgacttatgatgattttatgtgaatgattttgcataatttagaagtaacatcaactaacaaagcaaactaacaaaaaaggaggcatcattttcataggtccctccttagcttctagaaattttaatgaggtaaatggaaaaaacaatgtggctggagctgaagtttgtaagtgtttgtaagtttcattcacagtccttatgcttatttagtagattgctatgcaaattcttctaatatatatctaacaactgttaagaatgtatttatgaaaggtagagtttagttggtgttgctgctctcatcaaactattctcaagtatctatgcagagcctttaagaagggcatgggaaaagaggacacactatcatcccaggtaaacattgaaataacaagctagtatctaggccaataggatggtgaaagtctttggcaaggatacagaagtaaacagatacttatttcaaggacatttggagaagttggccttgttccactgcatgctcaaaaatatcttgccgcttcaaaattgactacctggaaacggagtttgtgtgctttggaataatttttattaagagttttggacacaatgctttcagaaattaataaaagcatgtctcttaaaaaaccacaaagccaaagtttacttaagatattttcttaaataggttccatttttaaatattcctattcagagtaaatagataacgtcaaaaattgtaagacaataatccacatgcttcttcattttcacatttattttgaattcatattagtcgtgtgaaaggcagtttcctattagataaaatccaaaatggaattaaaatctcccaaaaaacatttctattcttttcaatacatttccattttgctccatgtaatttttcgtgaagagtgataaaaattctttttcttattgtgatgtgattcttgtgtgttgtatatcgagtgactggactaccggcattctgtgtaaactctttgtactgtctcatttcctcattcatcactgtctgtcaatgggcatggtgctgtgaccagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaaggtaggcatgcatttaatcagatcataacaggtgacttagcaataaactgttggaaatacatggagtaatgtaaaatgctcattcatcattttctaggaaagactgcgtacagtgctcttttcctctcttcattacatcttctctccttagaaacttgttaaaatacataataacctatgtgatcgtcatatctgaaagacatctcatccttttttctctcttctttggtttgccatttgtctatgggcagaattggaatggaatatgtaaatattaaatcacttatccaattactttaatataatgtactctgcagtcattaaaagttatcttttctcactgcaaaaaataaaactcactaattggctctgtgcacatatttgatgagtaattcatgactataaaacaattataagtttttttttctcaaagtaaagcattaaacgttctctaatgtttctaatccagtacataggtagtttttgccagtggtttacctgagggtctcaaggttgcaaaggctcgtgatccgcagtcatatggaacagtatgtctaatcacttcaaagcctacttgtgtactcacaaaatgcacttacagaatttttcttcaggaccaataataaaaaatccttttattactatttttcaacagacatgaactgttcctgacacctagaagataataaatcttgattgaatgaataaaaattgtgggatgagcatctttggtaaagagtataacagaatattgaagctcccacttatcatttgggtccttttcccttgattgtaccaactgtctaaactattccctaaaaggttttttattcccttttggtaaactttacaaccttaggacaattgggatcttttcctcccctttaaaaatagtctcgtgactattataacccacttttgtcaaaagtggtatgctttattattagcttctactttgacaattccagttgctttattgccacagttatttttcctctgtttgttgacagaatagggaaataactataataatgtcttatggtaattgactgaatttgaataaaaatccactttaaaactttcatattagcacaactgcatttaaataataccgtgcttagttgttattcattggagtttctccctattgaattatttaccattttaaggttcaaatatttattttgtgaatctctttttctttgaaatattttattgcccatgttgtacttctcttcatttcttttggtcactttagatttttcttctctgcttctatgcctttgagacttaaaagagaagacaaaagactcttgttcctttcatgagtaatattttaaatacctctccattccaattacttccattgtttgcatctatttcttgcaccaaaatgtatttcaatcctctcaatagatttatttggttgtttactgttttacattaaatatgtgctagaaaaatctttaaatatattttgaagagagtgaatacactatcatagtatttgagcaaaatatatgtacatgttaaataataatcatcatatcaaactaatattttatatagaacatgctgttccaagtgcattgaatatcttaaatcactatatgcaatgtatatacatgttaaatttacatacatttttaagcagcattcaataagattatcacatgtaatatttatactaagattatgtgtttaaagaactctagaatgtttttcttctatgttagacaatgttttgagttttaaactgtcaaagaaaatcacgaatgagaaaaagctttgcaaattataaggcactatctaaatacaaagttttactataaaattgcaaagttttgcaagcaaagcaattaataagatatttagtttgcatggaaaatttatacatgcaatcttatttcacaaatataaattctttttattagtgagaacatcattgaaaatttattcatgagttttttattgtttgtcatttcttatcataatcaactctttttcattcttgcttaagtagtttatagttatatgttttttcctactaagcatgatagtacttctggctaacttcacttaatcgtttcagttggttatcttatcatatctatcacaaatttattcatttcttctcctgtttccctttttgtaggttatagatttctgctgttatttctattcatttattttctatataatcctttcatttatttatccctcaagttggtctatctgctgatttgattttaatatttaaaaattctctctgtaagtgaaaataaattactggattcccactgaattatttttctagctaaaaatatgaacgtaattgggcatatattaagaaaactttaaggattcactaaaagagtaaactctcaatacttagaatgcatgtttgttgttttaagaaagcatattgcataaactaaaacatgctcgtgaatagcacatgggtaggtagtttcagtattgccacaaataagctcatgctcttaagaattatttaaaatgaatgctgtatatctagaagttagttcaaaataagttcaacagtgtttaccctcatgaattatatttttagccattcgagtaaaaccttgattaagcaacattttatcaaattttctaatcataaatgaacatgtagaataaagaaaaaatatgtacatgaataatatatagttttactaataaatacttgttactaaattagaaaggaagccttttcaaataggcactgaaattatagtcattagaaatataggacccataaacagaatagaatatttatagtaaaactataattcagaaagataacatttagaatggcaaccaagttttatatgttactggcatgaacactataaaactgccaaagagaattttatctttctgggggtcttgtaggagcaaggagattgtagagaacagagttgtaaatctgtgtgatgatgtataattattaacagcccatttagttcatgcatattcaccacttcgcctttaatcgaagccaatcaatgtttatcgtctagtttacgtttttaggttatacagtcaacttcgatggcataggataattttttcctacaattcccaaagttatattttcagtcacttttcagaagagcagtaataactaaccctctgtgcatgtgaaaatttctatttagggacaaattacttgcaattcttaaatattattccagatatcctcccactattccatcattcaccaacataaaatgaaatatataccacttctcatgttttatagctcagaatactaacaaaacattggcagataattatttaattagcagagactatgtgctagagaacatttatcatagttaatggatgacataaatttctatctacaaaatttctaagaaagcaactagtctgctgaaggttaatgtgtgtgcattttgtgaggggaggggaatgttcatcgttttcttttcttatccagtccagcttcacctcataagagagctttaccccgtaagagagctgttactgcgatccatacctatgtctgtcttggcctctcatacataaaataatcagatacatcactttttctcttccaatgaaaagaggaaagctatccatggcttcttctctggaagttccatgaaaagattgaattaaagatgaatagctgaaaggtacataaagaaaaacaatggacccattttttttttctcacacactcatcgagtacactgaggtctgattagaatccaaaaagtaagtcatatagtgtaagggaggcaagtagtccactagaattgtatctacttgctcaattttggttgccaaaaaagaatttcattttcctgttctataacaatttttcaagaagctgtcagaatattcatctccaaagctttgtagcatgactacttttttagtcaatagttgccctgctttaagatatttcacttcaaaatttatactaggtgctttccacctcgtttaactgtctgtaatattttgtaataaaaaatactaaaatatgcaaatatttccaaaggtgaccttgatagggttgcttaagtagctaaggaataagactaaagtttatgagagcatcttttattttgtaagttcgtagctatcatgaacaaaagatcaaggtgtgatataatagaaagaaaagatgaattaacaccaaattattctcaattcctgggtgggaaggtcgggggtggaaatcagctgaaaacatcatgtaatcaaattcaaacttatttcactgaaattatgacttaatttatatttcattcattttctttttttttcctttacttttcttacccaaggaattagaaatgggcattccatcctacatcacctggataatggcaccaaatgccattatttaagaatcatcttttaaccctataaagctggaagattaaatatgctggaaaaagagttgtccatttaaacttaagtatgctttattggcttaggaaataaaaaatgaaaagagaaaaagtagcctacttatttctctttttttcaagaatacattctgaaatttaaaaatattagtcaagcttatatcttacttaagttgctttgcctaatttttaaatgagttctagtattctatatgccaaaattatattaatgctaactataatctgggaaaaaatatattttgaagtattgtaacaataatttgtgatggctggtttaatcttttcaaaatggcaactacagtgagcttcatttttttagagttataaattgtctcaatattaaattctttgtaaacaaattcttctttgagcttgaaagtagcacttttgattgccctgcatggtattatttgtctgtctatattctggttgaattcaactgatgtctgtgcattttttcataaaaggatatgaaaaatcccgaagcttaaacaacatagcgggcttggcaggcaatgctctgaggctctctccagtaacatcaccctacaactctccttgtcctctgaggcgctctcgatctcccatcccatctatcttgtaaaccaaacaaccaaactgcatcagtcggctaaattgtattaattcaagtgctgtttaccccataatggaaataattaaatgtagagttactccaggctccattaatacagtataaatcttgcatgatactacaatttgaagtcagaaatgccacttgggtagctaatgaatcttacccaggctttaaagattgtctaaagtagtgctaagatccctcctattaattgccctgatatccttttgcaataaaatgacagatagtgtcagatattgaccagtgcactaatatataaacataccttcagggagatatatttaaaacagtgtgcttccaaatgccaaccacttcattggaactttatttcttgtgactgtaaaccattctgaagatgtctgggatcctatcttgattgcacacgacatgacttgtgtcagctcatttgcatggaccatcttgtctctatcacctgaaagcaatgttgcagagttcggggactgtggatagctcaggatatgtgtacttgcatcgaaccatcctgctgatatgaaagcattggtcgactgttctgcatgttgaattgtggggcagggagggcacttttctccttgacatttttttcttattatttgaaagaaatatatgttttaaatagtttaatttcttgattgatttacttttcttcaaaaatgctgtattggagttctgaatgtctctggttgtttgcacacagataactgcaaagaggttgtcattactggttacacgcaagccgaggccagatctcttacttaatgacttggggaaggcacaaaacatgagagaaaggtaactgccagccaggcttgcattgtttagccagaaattgctgcttggttctagactctttaaaaaaaaaaaatacccagggtttgtcatcattttcagaggcagagtgccaaatatcacccaaagctcttgtgtcttttttttacccccttattttatttttatttattaattttttgtgcaaacatcaaatgtcactggtgttcacagaaggcttttttgactagccttaaattcctgagtcaaaagattaatcagattttcaggcagtgtttaatcaggtgctttgtcctgtatgttgttcttgtctgtcttagctccctgtctttcctgtatatgccatctgtctccatgaagcacagaaatgcctctgtaagatgtttatgattttaatatttactccctccaaacccgactccataccattttttgctatttggagcagcctctctgctttgtgtataaattaatgatgctctgtagactacctaagttaatcggcactgtgaatctttttgataagcagggtttaagcagcaatttcaccattgcacttggttgcctgctgcagtgtcagtttctactacctagcaaccagcattcattactacactccaacaaaatccttagggagtcatattcagtctgagtggaagaaagtctatttatgcattcctatgaattcaacagcaatagcgtgtctcatgtattgagcatgtgagggaagaaaaagaccgtaatataaatagagggataaataatatcactaaggcatttgggagccttgagactgctgattaattcctatttctcatgtttattttttgttaggaagacaattgtcacttttattattggccacgaaacatgtattactctatatccccaagtcctagagcatgacctgcatgttggagatgttgtacagcaatgtatttatccagacatacatatatgatatttagagacacagtgattcttttgataacaccacacatagaacattataattacacacaaatttatggtaaaagaattaatatgctgtctggtgctgctgttattgactacagtgttgtacagaatttatcatggattattgactgctgagaaagggacagtggaatttagccataccaaggactatactggaaacagacttctgctgctgaatgtgccctgatgtgaccaggttgcacttggaagagatcctcgcgtcttcatgaggcacttaaagcttataaaagaactgcggctggaactcatctggtgctccccatgagagtgctctgcttgtagactggccagtgtccatgaaacaactgtaaataccaacatgtgtgcatgggtcaacagtcttggccatttctcatcaaaagaagccaaattcatgatcaacatctctgaagtttcaagtaaggcccacacttctttgaattactcttcatgggcccacattaggttgtgctgtgaattacttaaggcagtgatactgatgtagtatagttttgtcttaatttcccttatttctacttctttggttgaatctatgaacttgattgtataattttcttataaattactgatgtaatcagcttgtcaattatgttgtgaaattgttagtattcatttatcaaaaatgacctatgtttagtcacatatttgtttagttctgggaaattgttatagcttaaatggaactcaccaacattattcatagtttaagtcttttatcattattacctcaattataaatattacaaaaacataattctggcaatgagagtatttttttattcaatgatcaaggagcaatgtcagtatatagtagaatatcaattaaattatatcctaaaatgtatattttgcataaaagagatattctttaatcaattacttttttgtgagttttgtggcaaatgaagcttgtacgtgtctttaaaactgttgtagatgaaactgtataagatttttacatcttgcttaatcaatattttcagagtctattagttcccctgggattctgaatataacatatagcctattataaatccctgtatcgtggaccttttgtgaacatttcaaggcgcatgcacaaccttgatgataaccagtggaaatgtaactaactgaaatgaagaataaaaggcaaatgagctgggga

SEQ ID NO: 51 - DNA, 149604 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaaggtaagggcgtgtctcgccggctcccgcgccgcccccggatcgcgccccggaccccgcagcccgcccaaccgcgcaccggcgcaccggctcggcgcccgcgcccccgcccgtcctttcctgtttccttgagatcagctgcgccgccgaccgggaccgcgggaggaacgggacgtttcgttcttcggccgggagagtctggggcgggcggaggaggagacgcgtgggacaccgggctgcaggccaggcggggaacggccgccgggacctccggcgccccgaaccgctcccaactttcttccctcactttccccgcccagctgcgcaggatcggcgtcagtgggcgaaagccgggtgctggtgggcgcctggggccggggtcccgcacgtgcgccccgcgctgtcttcccagggcgcgacggggtcctggcgcgcacccgaggggcgggcgctgcccacccgccgagactgcactgtttagggaagctgaggaaggaacccaaaaatacagcctcccctcggaccccgcgggacaggcggctttctgagaggacctccccgcctccgccctccgcgcaggtctcaaactgaagccggcgcccgccagcctggccccggcccctctccaggtccccgcgatcctcgttccccagtgtggagtcgcagcctcgacctgggagctgggagaactcgtctaccaccacctgcggctcccggggaggggtggtgctggcggcggttagtttcctcgttggcaaaaggcaggtggggtccgacccgccccttgggcgcagaccccggccgctcgcctcgcccggtgcgccctcgtcttgcctatccaagagtgccccccacctcccggggaccccagctccctcctgggcgcccgcgccgaaagccccaggctctccttcgatggccgcctcgcggagacgtccgggtctgctccacctgcagcccttcggtcgcgcctgggcttcgcggtggagcgggacgcggctgtccggccactgcagggggggatcgcgggactcttgagcggaagccccggaagcagagctcatcctggccaacaccatggtgtttcaaaatggggctcacagcaaacttctcctcaaaacccggagactttctttcttggatgtctctttttgctgtttgaagaatttgagccaaccaaaatattaaacctgtcttacacacacacacacacacacacacacacacacaccggattgctgtccctggttcaagtgtgccaagtgtgcagacagaacatgagcgagtctggcttcgtgactaccgaccataaacccacttgacaggggaaacatgccttggaaggtttaattgcacaattccaaccttgagctgcgcgggttccaagagccaggcccgtacttgctgttgatgtcattggcttggggagttggggtttggtgcccagcgcggtcgttgggggaggggcaaggcatagaacagtggttcccagaccttgctgcacattggaattacctgggattaaaaaaaaaaaaatcaaaacaaaaaccagtgtctggctcccgcccccagacattctgatttaattggcatggggcaagacctggacttgggattttttttaatgctcttcatgtgatctgttgggcagccagatttggggatcactagacggaagaaggattgttaaagtctccggagatgttacttgccaatgctaagagctctttgaggacatctggaattgttacaatattgccaaatataggaaagagggaaaaggtagagtgtgattccaataataaaggattccgcttttcattgaaggaactggtggaaaggtttcttctctgctgagcctgcaggcccgtcctgcctgcctggggtgcccgggagacgcgggcctgctccggagactgctgactgccggtcctgttagtcaggtgtcagccctgtctctgccgaagagactcttctctttattttaaattaaaccctcagagcaccaccaaagcatcacttttctccctccattggtgttctcattctttgatgttacttgtttgaacaccactattagtagttggagatttgttcctgagaaaaatataaataccacttaatttgcctgtttgtcccgcattcactcaaaacagaatgctcctgaagacaagagagagagtaggagaacagacgctattccattacagtaacataaaagactggattttcaggggcaaattattaaaataggagatgagctcttttaacagaaatttgtttaaggcctgtgtctatcaaattcagtggattttattcaagatgcactttgtttagtgggagttttgtttggttctgggacatgctaacttctagacttgctgctcttagaggtaatgactgccagacaccatttcatgagtcctaatccccacattaagcataagaggtgcacactctcctcctatgggggaaactgaggtacgaagaactaaagtgactttcccacagctggtgggaggcagacgggaaattcacaccaggggcttccaactccagatccctctctcaacttccaaactccactgccttgtccgagttctggtttcaggagatccaaatcaggtgtgtgcaaatgtctaatgtcagagctggcaaggggaaagggcccagggagccggctcatgacgatgagcctgtctgaagcttcaacgcgggctgtccggcagtctgcattcctgccgagttcctcagccctctgttgggtcaccttccatagaggcagcttagtcctcagttcagtgagcatggagtggagactgcttgaggggtgctgagcaaagccctgcctcttacaggatgaaggtgctctccagaagggacactggaaagtattccaaggcgagtcgaattcccaactgagggagctttgtggaaataagcccgcccagccccacttctggagacgttcccattcagtaggtccgagctgtcttaaagagaaaccaaagtggggatattaatggtatccaaagtgagatctaccccaccctccctcctcaaaggaggtcagatcaagaaagcccaagcccggcctggcaattgggacctttcttctcactccagcccagggtgaaggtggacaagtcactttgacccttcaggcttctgagctgttgtttctgaattcagtgaatatttactgagtgcatagaatatgctagatattctgggctaaaggttgaagggggggtgagttttaagggtttctgctcttgcttccagattgctttcaaatctggaaaggacaccagtggtttgtgtgttagacccacactgccgtagcacagaatacaagaaactggctgagagctccaataggcttttaacagtaatttctggcttcacgtatttagtttcataactcatgatttttcaaaaacttctggtttgaagacaccgattgccgaaagtccattgtgctgcataattacacttggtccacgtgacagcactaacatgttctgaaatgtttttagaagtagtctcagcaaagatgaaggattcctccctgtttgaaaagaaaatattctttgttttttctttgatctaagctctaagactagcagctagcatctgaaacttttttgacgagagtgacaaaccaactctaatattaaaggcaattgatgattatgggcactgaagggaaggtaaccccaggctggtgccccggaatagggatgggtcacaatgttgaggacatttcgcctgttgcagaacccacctgcaacacagtgtggcccttgccatgtgacttgtgtgtgtgcctgtgtgtctgtgtgtgcgtgttttaattttgacttcataagtactctagttatgagcttatttaacattgggttttactaataggggtatgtgttgagaaaatttcaaagttttagaatatggttcacccacatgttgcttccctgtaaatataatttttaaaaccagattctgggccgggcatggtggctcacctctataatcccaaaacgttgggaggccgaggcaggcgaatcatgaagccaggagtttgagaccaggctgaccaacacggtgaaacccagtctctactaaaaatacaaaaaaaattagctgggcgtggtggcaggtgcctgtaatcccagctactcaggaggctgaggcaggagaattgcttgaacccaggaggcagaggttgcagtgagccaagatcgcaccattgcactccagcccgcgcgacagtgtgagactccatctcaaaaaaaaaaaaaaaaaaacagattctgttcctcagatccattccatttttgttttcctttatcacttatggacatttgaaattatggtaataaacattgttagtctcagttaattattactggtttattcttgaaccactaatccatagagaatagagtgtaaatcttaacttgttcctgtaggccatccccattaaacatcatagtgttttctcattcgttctttttcgttttcctcctacaggaatgaattttctaagaaaattccagcagttggctctttggacgacatctctagattgtcctccattgggcccataggcacaagctggccagtttgaatttgggcaagaatccaggcattggaacttattcaaataactagtttgcctgtaattttcactttttcagagtcatctgataaagctttcttgctacacatttagatagatacactcaatccagttgtctagaaagttccctgagccagctgggagcaggaggggtagttggggccaggaatattgggggtgtgtttactgagcccctagaaagtaagtgctagatttgacatttcaatccctgaaggccctgaagttcagtatcaaatgactggtcctgtggactgagcatctgtgaattgcatatgcttagagtaaattttactcctaccagtttcagcagcttgctttagcaagcagtatggaaacactaacatgggggagtagaatttctctctctgatccaagttttatctcattctggtgggttttcaaggagagactcggagtccaagtgtcctttctgaatatatctggaacttctcattaacaaaagactcaagttataatttaggggacaaggcacccaatgagaatgccttgcaggcagccctaagtacacctgcaattacaccattactagcgcggcagcacacatggccctgacttagtttaaataattacgtaagtcaaccatgattgtttgccctttgcatagaagggcaagtattggtacctgttacaacttaggcttttttttctttatgtttgagccatgatgagtgatttacactgttgcatccatatgttgagatgtaagaataaattagacttggtaattgcccttaagtgtctggaagtcaactggggaaagagagctagagataataagtgtgaaacaatgtcacagaatcaatgacggaactcttcccaggacaaaggatgacttttgagttcagtctttgcctttaattctacatggggaggagagcacgtttagccacaaatggaagggattactcatttgagctatttggttatatgattatttccccagagaataggatgtgcagggcattacacaagcagtgccaatagcagcaaagttcttgagagtgctagtaattcaaatggcaggaagagaaggaataaatggtaaggctacctacagttcacagagagctccatcctcactgtggctttggattttgtcctgtgtgaaagagaagtgactgtgaactgacatgctgtgtttggtgttttagaaagatggctgcagcagcggtttggggaatggactgcaggagtggcattggaaacaggaaggttcatgactattgccagagacagaggatgaagcaggagcaaggaagattcaggacaggggactccggggctgatcaggaggcagaactggttgataagtatatgtagcagcataagaaagaaagaatcccagattgacacccaggcttctcacttggaagcctggatagatactgaatgcaatcacaaaggctgggaagtcaatgggactgcagggaagggaagggaagggaggagaagaggaagggcaggagggtccaatatcaatattcagcttttagatgtgttgagcttgaagtgctcagatggagaagtccaggaggcagtagaatacggtggtccagagcacaggagagcaatgtggcttgagttgtcatttgctcacatatttccgtgtcagttacttgtcttagatcacagaacaagttctcctctcacagtttcctggctccacctgtctcatgctcaccgtcagcatcgaaattgagccacaccaggggttctggataccagcttctctctaggtgaggctgctatagtcagcagctgattagttgcagttatcagcaactggtaatataatatattgtgcatataagtgtaccagaagtcatgtttatatattgctgcaaatactcggaatggggatctcttgttccctgcttaagaccacatcacattacttggttttgtacgctagtggctgaaccaaaaaaagtaggagatgattttttttcttttttcttaaagcagtagcttttgaaccttgaccatgctttctaaccagctgaggggcttttgaaaaagagggtgccttactgtgccccagaccaggacaatcagtatttctggggaatggagcctggcacacacacatttcttaaagctcccttggcaattctgaggagtggattacatgttgtatgtagctcgtaacgaaagaaatcttgtctttgctctcagacccccatttcttactcatctcatgagctccttcgagatccagaaacagttgcatatttcattagtaaatcagttccagagtcacattttatttcacaagttagtccattaaaagtttcctgcagtgaggaaatagccagaaagaacactccacccctcctcctttttataactatagggtctggctcgacagagcaggagcatcgccatcttggacaagcccctcattctaaagttcaccttaataaaaaactgcctaaattcaaactgcatcagcctaatggctaaggtcagcatgaccataaaccacaaataacatctccaaccggaaacattcgaaactcctcctcgaccagagacatgctagtcccgagataacccccctccagcagggaagatgccagtctcgggataacctctctctggccggaaagatgcctgccccaagataaacttgcctcctcccagagatattccaaccctgccataaaacttctccctcaaacaggaacattccaaaattctgataatctccctcaccctaaaaccaatatatactcctagtctgtaagagaaagcgctcttgaccaaaattcaccaggagtgcctcccaggttttaactaaagaaaacctctctttaactgccaaaaaaaaaaagggaaaaaaaaaagctttctgcagtggctttcagcgggcccagcatggcagcagcacctgagaacctgttggagatgcacactcttggaccccaccctggcctctgagtaagacactggaagggcaggccccggtctgtgcacacaagtcctcagggagattctgactgatgcatgccagattttgagaactgctgatatactccaggcacatcgcatgctgggatctagatacaccaagggaacaaaataactgcacttgtcctctgaggaccgacttaccttttggaagggctgagaaagagagacacatacaagatcactccctgtaatgcaatgttttataacagatgtgatttgggatttcagtgggagcccaaaagagggactgactaattcagcctctgtgacaaggggagtttctcagaaacagaatgcttagctgggcctccaggcacagggacaggaatgaggaaatacttgtaggccctgtgctccttcagcaaaaccctcagtttcttgttatttttataaatgcaaacatcttattaaagtagatgctaaggcattagaatttcctgctttatttttctaaatgaccatgaggaaacctggaatgtcaaagataaagtgcaacacattctgcatttaaaaattaaaatgatcctttttaaaagtagcaaccagatgtgaaaaattggactggagtccaggttatagttgatagctttaactttctccccaacagcaacagcacaattttccctaaaatgtgttatgaataagtaaaatgactacttcacatcctttaactcttcctacagaaatctaagagagaaatgaaacaaaagtttgcacagttctagacacgataaatacatgtgaaatcacacaactcagaaaatgtcccttaaattaattgagccattggtacttgtgaattagaagagacatctatgttctgatccactgttgaaagctgtacaatgttacctatttatttgcagacatcctttggaaacaaataggtagatttgcaacaaataaagagtggagtacagctgctgacattaccttgtatattcatgcctttatgtaaaaaaaaaaaaaaaaatatatatatatatatatatatatatatatatatacacacacacacacatatggaggtaaagaccactgcttgctttgcagttgttttaagagcattcatgaaggattttattttataagcagaaatgtgatatctgacgattttaccactacatgcttgcaggccagtgcacagcagatgacgtcatgattgttttagcagtcctatcgttttacttatgatgtcattacaaccctttgctaaaatttctttcctttactccaggttttggataaaattgatgcattgcacatagtctctctgataagacaaactggcatttgtatgtgaaaaactgtgcatgttttagtgtctctgctgatactcaaattatccattattttagtgctggaataaaaacaaaccacttagtgaatttgtgcaggtccttaaggacaggcaaaggtgtcctgagattttctgatcattgtataccaaattttagaaactttttcaaaaacatttttttaatttcaaaaacctggttttgtttatttaccagcaatcattgaatacctgaaagctttcaggagattttattacaatggtttctattcacttacaaaattatctcctagttcattctcatacactgtaagccattgtaaatgcttcaaattgtgccgaacaagataaactagacaaactattttaagtttgttctagtgctaacttgcaagatctaatggctccaactagatttttaaaataaagtatattttaatatattattagaaagttaagcaattatctgtttataggtaacaaaaaccctggaaccccaatgtcagatgtcatccacttttgattaagtccaaacatatgacagataaacaaaagatggttggctgggctcagtggctcatgcctgtaatctcagcactttcagaggccgaggcgggcggatcacaaggtcaggagtttgagacttgcctgaccaacatggtgaaacccgcctctactaaaaatacaaaaaaaacagctgggtgcggtggcacgtgcctgtagtcccagctactcaggaggctgaggcaggagaatcacttaaacctggaaggcaggggttgcagtgagctgagatcacaccactacactccagcctaggcgacagagcaagactcagtcaaaaaacaaaaaaaaagtggtcattggagaattattgtgtcacctgttgttttttaatgtactaattttgagaggcttttaaatagagtgcactatagaactttttcttggcttcaatttgctacaatgttaatagagaatcagaaaccttatccttatagatgtttcttgatttttttaatttctggtgacatttatgagtgagaatagtgtattgccctgttttctttcttactcccctttcttcttccttccttgctttctttcttcttcccttccttctttctcttcctcgctccttcttttttacaagctgttatgaattagccttcacagagaaagaaaaatttttataaataactggaaatgaaactttgcaaaggactgcagatgaaaaactttgtcaaatgactgtaaaaatatactatataattttcaaaagttagaaagtaccaaacacactcagtattcatggttatacaagtatgcatacacatgtattgctccctgaaaagtggtgttgttaagggagtttttcttagtacgcggcttaacatatttttttctgtaatttgttgttagttataatggggagagaaaacaggttagagtctcccctctcagtttcaccttccataaaacagctaaactagacgatcgtcagactccttccagctgaaaacatctgtaaaattaaaaacaaatctaaatgtatgcaagatatgtatttaaacatgctggtaataagtgtgctgtccctataatttagatgctaaaacattgatgtcataataataacaacacctcgcatttgtacagcacctcatagtttacacaatgccttaacattcttctctctcagcctcctacaaccccacaggattgggatagctttccagattgggaggtgagggacccaggctcagagcgattctgctgttgtccgtaatcaccaggctggtgatcagtgggcactgggtgctctcctgctacacagcactgtctctcaacatgcaggtcaaggttacttattcctccttcaagacgtcattgggttttttagctatggatgccccatcacttttagttctatttgtgaatcaaaggctaaataaagtattcctcaaaatttgttatacttctgttactaatgcttaatgtccctcacaatttctgtatatttctgtgtatttctgctctgttttggttcctttcccaggtttcttttttgttatgaagtagtttttagactcaagtctcttctgtatgtgttataactgcccattccataagatacagggcagtgaatttgtgagccttgaaaatatttactttagaaatgagaagtatgacttttcaacgttgtgtcatcaacttctgtaaattttccagacctataaatacttgcagaaaaaaaatgaaaggagaaggcaacttgatttagcagttgggtcagttagcaatgcctatggcaagctgtagtaattcccttacatagatttgtaagactcatttctatgatttaaatgaaggcatacacttaacctctttagggtgtgaaacagcttttacaaaaagagacaaacttaagaaacagtgtggccctccaagagtgttcattttccatatcataccatttgtaataagctattctggctgggatttacttgcaagcattggcttttaagaagagatggtttcacacatcaaattattcacttggaggcactttctgggttgaaggaatggaatggagagtgcggcagtgagtagatctctcagtgacggtgatgtgcctctcccagaagaaatttcaaaatgcagtgttcattttcctccacaagaaaggaagaaactgttttgttattgtttattcctaacatagtggaaacttttcagtactctggcagaaatttcccaaaagcaattttctatttcatgattataaagtagcaaaggaaaaagtcctgcactccagctgagcaatggatctccagttgttatctaggtgctgcaggtttagagaggattgccaggagaacacatcgatttttcaggcctgtgatgacgtatctcttgttgaataagtaaacccttccagtaaacagacagttagtatattgatttcagggtggctttagccactgaacctgtaagtcttgcaaaggttacttgggcaaaagcatcattattttaccttcagtcaacaaaaatctacctggccaaggcagaacagaaagttcagcaatttgatgaagtgggacaacatgaagaatcaggtgagttgcctactttttcacttcactttccacctttagagattcttgtttagatgcagagtagtgacgtgcctggtgtcagggagagagttgaatgagaaaagtcccagaagggcagaagacttgggtgattatctgagtccatctttccttatcacatgacagagttcttgaagtcttggctaggaattctaggcttttagattctttgggcaatggctactaaatgttcataatgttgctcagttgcaaaaacaagacattcaaactatagccagggagataagtagtcacgaactcaaggcctaaattctgctgatggagccgatgagaattgggtgctaaggcaaagagagttgccaatattatattcttcggggttttttgtttttattcgcattttggaaaaggaaaatattagcattcctctgacttaatattgagaagacattgggcactctttttcctcccacacttgtcttctttcactaggtgacaagggaagaggtagcatgaggtggtggtcacaggtgagaggggctgttgtgagcacaggcatgttgactgcacattggtcacctagtagaagttttgcaggcttggtgacttctgaacactgttttcaaggttgatttttagttgagagaacctctaggtaccacgtaatgttattaacagtagtactgatctcacaatcgccctatgtcccattcacaagatgttctgccaagccataaaaggcccagttaagtttaagagaagtctcaaaagtaacagatgataactaattaatacccagtgattttgaaatgtagacatcaaacataccaattcagtggtatcatccttagaggcagacagaggatgattaaatcattcagcccatctctgtctgaggacgcagcttagcacagcatggtggaggctaaatgggccttaagggaaaaaatgatatctgaagatgcaatttatttcaaaaagagtttgctcccgtgaattttcactctctatgtagaacggcaccagcacacacttttcctgagcctttgcatgtgtggcaggcagcggcctggcatcctggggaactgaatgaggacgcagatgacccggacgtgttcacagtttgacacatctgactcccagatcagggacagctagctttgctggctggttaagttgatgattccatctttgcctggttctctgactgtctcatgctttctgttattactattttgcagcagatatttctgctcatttttcaatcatatatgcatcctggatggcatagagttgattctcctaacaaatcagtgtccctttgtatttttttctggccataagatagaatatatatgtcatttattaaaaatggagaaaatgttcaggagtttcttgactcagagagggaaaagggatactcagggcactttttcagccaggaatttactacctttgcagggtaaaggggactcaccacgctggaagtcaaaataagccaccagtgccaagtgttcaaagcccttagaatcacaatgctcttaaagcaaagtcttcaacaatgcttgaaaacttccactggttctcagtatgtccaaaattgtcatgtctatgaatgattttctcaatctgaaaatttttatagcaggctaaagaatgagataggtcagtgtgattctagaactaatcattaacattcaatagatgactattttattctagaaaaagcagcaactttctatttactctctattttgagggtaaattctctgtaagtagaaaaagcaaaatgtggacatgggactaacatatgaatatacaaagcaaatgtaccgaaaaaatcttaagacctgccttgtggtgttttttgttttgttttgttttcattaaagtgacttgttagcctcttgctccctgtgaagcacagggaggtgacgtgatgtgcacagggcagactctgccatatgccctggccttgaactcagggccccctggggactgcaggggatgctggccatgctgagcaatgcctgtgggtgtcagtttcctcatctgcagaatgagggtaggcctggtgcttatttcatagggtcgcagaggggattcagtgacagggtggtgtagaggctggagcgtgccccatgtgtgcacgacagccttccaactaggggaggcgggcctgggctctcaccagagagcctgtgttctccatggctacatgactttgccccagacgtccttcccgtggtctggaccctgggaagtcgccaagagccagacaggagaaaggctccacttggctctcctctttggtgaccatcccttgcctccatggcgggactctcaggtgacatcccaccaaccctcactttgcttccctggtgggtctcactttccctcaagagtgttgcttttttgtttcctgcatagtcctgggccagttttgataaccctcttcatttcacttcagaaaccctgatgatttcttcctgtgctctttttaccttaggacttttactatgacgactgtgactggcccatttcttgttttttttctcttgctctgctttctcccccatcatcactaaagcagacatggcaatgatggccatgcacactttccaagggtccagctgtagatcttcatggttccccaggtgcctggaccatcttgtgaggagggaggcaaacacaccctgcctggagcacttggccctttcggcaatgttttggcttcctcaagtgagaaaagaatggatttgtattccccctctgcattattgtttttgttttgtttgtttgttttgttttgtattgagacagagtctcacttttttccccaggctggagtgcagtggcccgacctcggctcactgcaacctccaccttccgggttcaagtgattctcctgtctcagccccctgagtagctgggactacaggtgcccgccaccacacctgactaatttttgtatgttttgtagagacagggtttcaccatgttggccaggtgcccattattatttgatctggaattaactgagctactgcaggaattgcttgattcactgatgactggtgttgagccagtacacacccacacccaaggactgtgactgtcttctgaggtccatcctcagaaattcctgtctcttcacctagtgtgtaataaggcctgcgcgtgttatatggaactgtaaaaaatgcgccaaccatctgtccttcctctttatctgattacttatcattgttctctaagttgcaagttaatagactgatcataaattaatgcatgctggagacttgctgtttcctactagcagcatataaaagttatttttaaagttgttttaaatctgtgagtaaaaataaattgctttgctgcaagaaacaccaaacatggaaaagctaacggttcaaagttaataatttatcttatggacatcactagtggcatagttgctttaaacagtgagaggatttaatagatatttgatttgcaagtgggatgaagggtggtctaacctttgtcctgtgtttaccttccatgagatcctagaggttgtacagcacagtagtggcatgtgacacacttgagagtgcctgttctgtttggaaacctggaaactatgaagggaagtggccttcgagcttaacacataagacttgggaggcaaaaccttttattctctttaaatattcactttaggataagcatttttttaggtgttaggaacagggaaaactgtgtggttaggaaggaagaaagaagaaagttaactgttgtacattccctaggtaatgtttttaagcattgttattcactttcaaaacacattttatttatttggacttaatattttgatcttattttttcaatttcttttaatttaacagacaggatgagtttttttatagttgtattacttagaaattatactaaaaatggccgagtgtggtggctcacacctgtaatcccagcactttgggaggccaaggcaggtggatcacttggatcacttgaggttgggagttcaagaccagcctggccaacatagcaaaaccccgtcttcactaaaaaaaaaaaacaaaaaaaaaactagccacgcatggtggcaggtgtgcctgtaaccctatctactagggagactgagacataagaatcacttgaatccaggaagcagaggttgcagtgagcagagattgcaccactgcacttcagcctgggtgacagagcaagactctgtctcggaaaaaaaaaaaaaaaaggataaagaaatcatactaaaaacaaaacagaatgctgaccaccttatagaaatagaaatagtggtttgctgtgatagcaaattttcttgttaactttttatttttaaagaattgcacattcacaggaagttgcaaaaaatctactgggaggtcctatcccccttcccccaacctcctccagtagtaacatcttagtagcaaagttttgtatatttattttgatatcattatctaagtttgacatcattatctaatattaacctaagccaaaagcccactattttaattatctagtgatgcagtgttatagaactcatagcctttcacagcattatttggaagttaattttcttaagtgaaatgtttttggtctttaaggtttggaggccatggaggcatgaggagaaatgggatgagggagagagagctaagatagataaagacagagatggggagatccactgattcgttgaacaaaccagatacttccttatagtttttggattaacttacatgagctaagtttatattctgttcagatcacaagtggtcaagtttgtgtgtgtgtgggggggggggggtgggtgtgtgtgtgtaccactctacccatcctatatttattgtcctgtatttggtctgttctgccttctttattttcaggataggtgtcctaaatgagggtctttggaaagctggtgaggccatgttgcccgtttcaggtgttccgtgctcaaatgtattcatttcttgaaaaattcagggagtgcacacttttgtacattttcctatgtgtatatgataccattatataaatcttaaaaatatatatggttcacctgaatccccagccatttggtagagaagatagaaaacctacagaggaggctaagattttattagaaaattcagcttctcgacggaggtattggctttaaagtcaaggcaatgcatctattctttcttttgatataactagctaaaagatctcttaaattcaaagtggccctcatcttactgttactgcaatttactcttaattacaaattatataaaaataggttttgaaatactgtagcgacaaagtaacatacctctgctccattacacagataaaacctctaaggaacacctcctctcttaacaggcattaaccaactgcagaaactgcagaaggacagggctatttgggaataacacagctcccttccttgtctgttccctcccattgtcaggcttctgtggagccatattcagagcaacatagggagggggaagagaaaatcaaccccttggtgaaggaaagctcccaattcacagagcaaacatgggtactcttgtttgtgggagctcccagggcctcccagctcaccgagcattctgagccctgatccttacactaattgtattatgcaaccataaatgatgtctgctgtaccagcggggacagtttattttaatagattggtataacttggcagaatcttatctgcatgtttcatcttggatttttagctcaattcaactcaataggcatgtgtcaaatgtctactgcagactgagcactgaaaagctgctgggtacagggttacatggatagaaaacgtagcctctgacccctaaggagcctgtaatccagatccccattctttccatcccattctcccaagcaagaatttacctaatgtggtttgcgagaatttaagagctggaaaggtggtcacgagaagccggaatgggttcgctaaaatgtgtctatatgattaagcataacgtagctttgcagcactcttcacagcttcctcagagccttccgcacgcggtgtctcatttgaatacttgtgtgaggatagcctcatacccctcagtgagctcttcatggagtgatgcagtagacagcaagcctcacacttctatgctcacggaagaccaaatttgccttgaaaaatctttatagtctcttcacatttctaagttgacatcaaaaatcggttaccataaaatcctaatagttgaagagatgtaatttcaattatttggtaaacctgaccttcattgtcaaagcaattagtcaactcagatttactttctcccagataatagattctgacttctttttttctgattaaaaaacttaacaccttcctcaggagatctatctcagttctgaatgctgattctaactaagaaggatatttggctacatgctgggaagaggggtactgaggcacgccgcgattccactccagcatttccagttagtcgggtgcctctgcactcccggtgttccggcgcccagttagttgtgtactctgggctgtccctatactggagtcctaaaacacttacgactgcagatagggggaggtttttcaaaaccttggtctgaaaagccatagaagggagataggaaagcgggggggtggagccacagtacattcaggtggatccgtttttggaaatagtacaaactggaggtgaaaccctggaaattgatctgtcgttcacatgcttcatgccgagtccttgtggacccacagagacacactcgccccagtttgaaggctgctaacttgattctgaggacaccagtgaggtggtagtgtgcaaatgatgtgtgaggaaactttggaggagtctcaccctgcctggagcacgtggcccctaaaacagcgcagcctcccaaagacagaagatgtggactagtgagaagccaggtatggtgactgctgctggatgaagcttgtcccaccagaggctcgcttgtttcattgagcacctactgtgtgcttgtgggatgcaaacacacgtgtggtccctgccctcaggttaataggcaggggtggaacagttatgaaactgctctaaagtcattttctcaaactgggagtgacaaatgtatccacttggaaaagattgagaattttataagatttttaaatttttgtttattcacattgaggagaatctaaattcttttgaacttatgtatagatttcaccattttatagtaataaatcagtcctcctgtgtgtgtgtgtgtatgtgtgtgtgtgtgtatgtaaacctcaccttgcaatattattattttaaatagccacttgcatcttaaggaaattaagaggacaaaagaaaagctgctgttttgtatgtatccacatatttaccagctgcttccctgccggcaggtgctctggttctgcactgcctgttgtcccttgcctgaaaatggttgcctccaatattttgctcagttttctgattgtttacagtggcagaggagggtagatctggtaccagttagtaattgccagaggtggaagtctgtggatgaaatttgtataacatggaacgttagttccacagttaatgctactcaattggaacccatggaaattattttttggtgaaaagggcccatgcgttatgaaatttgagatccatcactttaagtgaatgtaggccctggatacagtgggagctcagaagagcaaatcagttggtcaccttgctcaacgtattttactaagggcatcagtaaggctttctatgacctgctccttcaatgcttggttgacatttggggagcaaagataaactaaggattctaagttctgtcctgtgatgctgtaaggggaatctcaaacctctaggtggaggagtgcagagatgaccaggatggtggaagcctgcaggagagctgaacacctgaagacacccagtgggaagaccaggacctttaacgcccatatctgctgctcaagactggcagagagaagagggtttgtgatgagaaaaggtggtgaaaggcacaaggaggcacagagcatgtcaggtcccatatcccaaaaggaatgtgcttgggtgagggagagctcctccatggctggaggcattcagagaccaggcagtcgcttgtgggtttgtgattagagtgaggttcttttataaagggagtgagaagagaaggtctgtggatacttgagtgtatcggtaattaagaaataaattgtgtacatcccatttctttccacattttcctgggctgtcacagtggctgcaaagaaagcagtccgtgaactgaactgtgatcccagacaggcaagcacaccaggaatctcttctcagctgttgataatgagggagcgctggggagagaaatggggtcctctttgagtttcctctgtgccgatacctttctctttgttaaaacagctaattaaacactgaagcagtatagctctcttactatacactggtagtcatagttctcttactgttctcttcactgacagttctcttactatacactgatggtgacgcagaaattcagaattccccgcatgtgtcccggtttgaaagccactgtgctttgctgtggattaggatcagacagttgagtcttgttccaacaaggaaagttgcttattggaaagttttgctgcagggagccttgagttctgcatcaggcttggaagtgggctctgtggaggtcagaaggaggatcccccacccgcagcctcaagaaaaatatgaaaagtggattatgcctctgtagctatattgcctataaactttctgcagaatgacagtattcatatcctacattttttcaaagcgatattaatcctgagacctgcagctaaagtcaagtagaatttagggataattaataggaggaaggtggggttggaagatctgcatgattatagtcctctgatataactggaaaattctttccattagcaaggagctttggttaatataaaatggacagattaaacctaggcaatttattttactcattgctgtatttttatttcagagctggttgaaaatattacaaagtaatattttaaagtgcttatctaaactcttactctgcattttatcattgggttatgaaatgactggggaaagacttttcttgcttttatttctcagtgtctacttataaacatgttttttgaactactgtttttgtgacaacatgcctttttcccagaaaatctcaggttaacattaaataggcactggatgtttatctgatcttgtttatagaaacacaagaaaattttaaccttgtatatactttactcaattaactaggtaagaggtcattgaaacatttagaattccactctacatttcaataattatcaggtgaaagctactgcatctacatcagaagatgtttgtaatttatttaagaataaaattagctatgcaagaaatagtatgtggagtcctatgtggaaatcacagaaaccctgacaacttgatgatctttccgcaagctaaaaatatcactctggatcacagcagtagaggactctgtaaatttaatctgtgtgtctcctgtaaataagtgcattagcagtacacaggtggtgtcagagtcagtgatgatggatagaaattctacataaaatccaggctcagtggctcatgcctttaatcccagcactttgggagtctgaggcgggtggatcacctgaggtcaggagttcgagaccagcctggccaacatggcaaaacctcgtctctactaaaaatacaaaaattagctggatgatggcacatgcctgtaatcccagctattcgggaggcggaggcaggagaatctcttgaacctgggaggtagaggttgcagtgagccgagatcacgccattgcactccagcctgggcaaaagagcgacactccatcgcaaaaaaaaaagaagtaagaagttttacataaaaacgtggagtgagcccaaggtgccatttatccagcccatacacatcgtaccatgtacagagtggacaccagataaatacattgactgcatgccacaaacatatatatgtaggcaccgttgcattcaaatacacatctgcagccctaacacatctttatttgctaacgagcatcaatgtatttaaaaacaaacatgtttaaactagtgaatgattagattataatgatcttaattcataagttttctcattggccttttgtatacttcaattgtaatacctagaaaaacagttatgtccaaaggagtgaataggccttatctgaaacaggtgagcgtgacaagtgttttcttacttattttacttttcagataattcatccttaaagtacattagtttaaaagtactgtttaaggaaacagtacttggattaaaacttgaatcattgttaaggaaaactataccttaacttcatgtaatcacaattaaacctcttcatatagaaggatctaagaattttctgcagcattcaccagcaccaaaaagctcagagacatatatttctttctctgtatatgtattttaaattcaagttagtataaattgacaggcaggtcagagtaatatatgatcttctgagtccccttagtaattaaaagaaatgattatttttgcatgaaatatgataaagtgattttaagtgcctgataaaaagtcttaaccatgacaaccattaaagattacatcaaagaaaaataagtttgactttcatttaccttggaaacagctattaactggtaacctcaagaaacaccatgaagagtcagtttgctccacacatgtcttgtaaaagtcaaataactggtggttatccagtaatgacaagaggtagaagttacatccttgctgtctgattgaaccttcccagagctggcacaaggctgggaagaccataggtgctaaatgaggaactacttaaagaaagaaaatggaatttcacggacaagaaaatccatgtccatttggttctgtgacccacatcctttgtatcctatgcttttttacacttggtacatggttgcaagattgcccctgttttctacttatagttccatgcagcatggatgtgggaaaaagtctcctctgcaaagggggttaatgcaggtcactctacgtatgtgcacgaggtcgttataaagctcgaaaatatgggctcaccaaccaggtgatttttttaattatccaaccagaagacataacatataggggaatcaaaagaaatctctgagtaaaataatgataacaggtcaaactttgcggtcccacgtgaggctggagatgcgtattgtcttgactttgcatctacaagtttaacaaatgatgctttctcagtttacctctggaaatggaaattagcattgcaaatgacttcatgaggaggtagaagctatctgtgaatttcctttcgctgtgtttacgatagactctcacgtctagatgtgtcatgtattatgttaaattggtatgtcttgaagttataaagcacagccctctataagtatatatattccacctctttcaaatcggatggtacctatccttcaaactgctatttaatgactgtctgctatgttcaaggcactgctctcaatgttaatacttgatgagatcgggcgcgttcaaggtggcatggccgtagactcaatgttagtatctgaaatatggcctacgagctgagttgtgaatcaagttaatagattttcggaatgttaaggtctaaaccagtagctcttaactgagacaatcctgtcctcatctcacctgggagacatctggcaatgtttggagaaccttttggttgtcacactggggcatctagtgagtagaggtcagggatggtggtaaacaagtttttttgtttgtttgttttgtttttgagacagagtctcactttgtcacccaggctggagtgcagtggtgtgatctcagctcactgcaacctctgcctcctaggttcaagcaattcttatgcctcagcctcccaagtagtagctgggattacaggtgtgcaccactacactcagctaatttttgcatttttagtagagacggggttttgccatgttggctaggttggtctcgaactcctggcctcaagagaaccgcccccttcttggcctcccaatatgccgggattacaggtgtgagccaccgtgcccaggctaacattctttaatgcataggacagcccccaccatacagaggaatccccagcccagaatgttaatagttctaaggttgagaaacccaaggttaagccaagtcaacttatctatcttctttaaaattgcataagaatgcagtcctgttcttcattcctcttgctttgcagttaatgatcctttgcctggactttctaagtgcccagaagagcaacagccagcatgcaggatggcattcctgaccagttgcacttggcctagcattccaacctcacctgcctcagcttgttcaacctgaaaacctaccaagtgaaagcaagagccacgtgaagacgccttagttatatgcacccacccagacacttgctcagaaaggaatcagtggggccctggccttagaaactggctccttcactgctgtagaaacaacataaatttaacataaaacacgtgcttttcttttttcttcttactttttcctgtcttggcaatgcaaggatgccattaggtaaagaaatccttcaccacactaatcctgcagagccagaagagaaaccagcttgttctaacccagctttgtcatggagagaaggcagctgctccagtctgaactattctttcttttggtagcagcctgcccaagggtgaaagtgtgtttaatagtttgaattacacaagtgaacagtaaatgtatgcctgtttctgctttatgggactttgaaataatgttgtttgtgccaaggttttagattactatacctaacaacctagaaaaagaaatgaaaaggaagccttctgccaggcagaggtcactacgggcctggagctgggcacctgactcagcagctgcccagatccccagagctgagaagtcaccatgcatttgtggtgcttcgagcgagttaccagagtcctggaacagagcagcacacctgcggggtgtccccttggcatttgggcagggcaggtgaccaagggtcttgttggaactgaagtccagcttgaaaagcaaatctggttgtgagctagagtccagtaacacttgtttcccgccgccccccgcataactcgtgtgtcctaaaatacaataatttcttgaacttcagtcacttatgcctataagcgggcatacaacaggggcacaataaatgtttgttaagtgaatgaattctttcagaactagatgggatcttagtccaactctcttatttaacgaggtccacagaggttctgcgattgtctaagaaagaaggctgtgttcatggcctttgttgtttacgtggccctgtgattctcttggctccgtgaaagtcctgatgcagacattccggccatctagaaaggcatgcagacaagccatccagctggcatgatcctgagtccagctttctttaaaagagcttccaaaactgcttaagctttgactgcacaaaacctgcatcacctccagttgagaaactcaagagaataagtaagttatggagttggagaccccagcttaactactagttttaaaatagtgaaatcaacattttcaaatctttgacttcactaagatttaataaagtttattaatcatatattatgagttattgctctctctttatgtctgtaatgcagttgctcctctctgtataaattaataagttttagagatccaaaatgagaattttaaaataaattacgtatattttaatcaagtttaatttgactatatccagctaaacaattgattgaacttcacttgcttttctatgacaggttttttgttcttagtaaaagaccccagttttctcacttgtgaacagaaggggttagacttcatgacagctaaggttccttccgtctctaacaaaagtggcctgaagagaggcttctagactatactcacggtgggttcttgggacctcagagtcagctccatcacttaagtggctgtgtgattgagtggagacacctcaatctctttgtgcctcagtttcctcacctgtcgagtgtcaacatgatggcacctaaagctgttgagacttcagaaaggtaatgtgtgaaaagtgaaaagtgcctggcatccaggaagtactcaataaataccaactattttattgctgcagctgttcttatagatgtgatttctagaacattgccttctaatagggtagccatgggccacaattgttggctgttcggtgtttcacatatggttagtccaaactaagatgtgttgtgagtctcaaatacacactggattgtgaagacttaggacaaggaaaacaatgttaataaaatctcattgataacttttaaattaattacatgttgaaatgaaaatatttgggacatattgagttaaataaaacaggagattaatttcttctgtttctttctactttttttattagtgtggctactcaaaaatgtgacattatgtatgcatctcgtattacatttctattggacagcagcgctctagacagtactatgggtagtatctgtggggaggttctcagaaacatgtcgcatgctcttttagaaccttaaagtattcctagtctcctctacttccagcccttggctcttgggcctcagtctttttacttttgcggctgtgtttctctgaaggcttggcattagtagattgaaaagaataaccatctagggaaatgtgaattcagtttctttctgacattctgctctctacaaggggatattatgtacacataaacctacttccaaaataatgaagtgaggcctaattccttactcttcagagagcccactgtggaagtgtcactgaccttgtgtatgggctgcccttcatggctctgggagtcattataaagggcagcatttggcgtggtgcgtcctaagccagtgtttctcggctctgttccttagacatgtgttagtgttaatagatgttcttggaaaaaaaaaaaaaaaacagcattctgaggtcaaacatgctcagaaagcttggaatctgcactacgcttctcgtacacatttcatattaaagattttggaaagtcctgcaatacagagccctgtctaatattgccacaacccacaattgctcaaatgtaaatagatttgagtttattcacattcagatcacctcttaaggccccacctcccaatgctgtcacaatggcaattagatttccacatgagttttggaagggacattcagaccacagcaggggaaagcagggtacttgctgctttgcaagtgtgtccacatctaattaatagtacagttcttactcttggtgtgtccggtgatattaaaaattaatgtgccttatttagataagtaacataaaaatcacaaaatgtatgccttagatttatatgtatttataactagtctatttcctgaaaacagttgagacaccttgtaaaagttaccggtacgatagggccattccaacaaagctgtaaagtggtgataacacagtcataaagaagaggagatagctctgggagaaaaggtggcccagaaaccagctctgagcctcatggctgcaggcaaggtctgcaggttcctggtcctgattgcaggccatttgctgccttgagtggtggttacacaaggccagccctgggggtatcacccagaacacctagtacacgaatttcagtttagaggacgaagcattactggagtattgttatgcaggaaaactttttcctaaaaatgccctgaaaagagagtagcctaatgcattcaatcaaaatgtttttaagtggaaaacatattgtgtgtacttgatctggcctgctgcttttaaaagattaaaactgggactgggcatggtggctcacacctgtaatcccagcactttgggaggcagaggcaggtggatcacctgaggtcaagagttggagaccagcctgaccaagatggtgaaaccccatgcctactaaaaatgcaaaaagttagccaggcttggtggcgcatgccggtaatcccagctagttgaggggctgaggcaggggaatcacttgaacctgggagccggaggttgcagtgagctgagatcgcatcattgtactccagcctgggcaacaagagtgaaactccatctcgaaaacaaacaaacaaacaaaaaaacactggggccaaagaactctgtgtgctgtatcacctaaccacatttcatgacacggctagagaagaatcatgcaaataaaaatttccaacatgttcgtaaactgggaaagtatttcactggggagtgagcagaaaagtaatactataacctctatatctagacaaatgtgaattcagtttcacatataaatatataagtgaaaaaatatataaatataaataatatgaaataatggttatctcaccactttctacatcttttgtgaatattttatagtgctcaaatatattagtgcactagtatatgtacattacattaaataactaatcatttattaggaggatgtgcttgttttttgctaataaagatgataataaaaaaatccttagaccccccctcggtttgttttcagttaggaattagggatatttataagaatatctttaaatgacacatgccttgctctgggacgaggcatctgcatgggtgacacatatgtgttgtgtgtacaggctcccagcatttccagggccctgctcagaatgtaggccttactgattcttacagagttacaagcgctggtgaggttggcgaagtttaggtaaacacagctgggaatgccccatggcctctgggtgactttggacatcactgaactttacccttagagatgcatacctgcatcttttttaccctgatagggccttccatgatgctttcaaagtgtttttgtctgcttttcggttaatagactttcacagtagccaattgaatatattggttaaatgcatctctttatacacagactggattcaaactgaggttgtgtctctccctggctgtgtgacgttgggtatgatccaagtgtcagattactcaacttcaaaatgaggacagagcctttcccttctagggctgccaggaacattgaatgagagagtgctggcagcttagtacaggtgttcattgctcttgtatggtactgtctgtggcacggctagataaaatacagtagccactgattcaaatttcaactgaggagtaaaataaactgaataacttagaaaagttttcttcttttgaatgactctaagaatttaaggagcatgtgagtgttgatggctctaaaagggtaacagagcccaactagctcagttctcagcatgaaaatagtcatatggcacagactcagtggagtgggtgcacttcaataactggaagcacagatgccctacagcagcatcaaagatggcactctaaactactttcaatcctttaaaataaatggaaacgcacatttagtatgcatatgacaacacgaaggacttcgattttgctgatgcaatacagttttacaggattttttatactcaaattagtaaaattctgtattgcatccaaattataaattataatatcatctagattggacataggaataacgaccactggtatctgcccagaaagctctaccgcctgtttataagctcctgcaggagacacaaaaagaagagaatttgaatataacttgaaatgaccgtaatctcctgccccaactcatttcattaccaaaccgcctctttcttcattatttctcctgaagcacaaatctatagagaactcagctgccagtctctcccactgcactcagcagtgaaagggttaggcctaggcttttcaaacagaccagtgcttgtatcagcccttaaacatctctggagaaggaaatgggatccttctttggtaattcatttttgacagttggggattaggtgttctgtatctggggggccttgctgtcttctctcctcctcctcccactgcagaccctctcctcccctcccctctccagctctctgatgactgcttcatgctccttccacctgaggactgccagcacagcctattgcaggaacagccaatgaggggctggctgtgctcttttatttataaaattataaactcaagcaaaatctagactatgtgtccccaagatcagaggagcacaaatcccttgcttacagattgcatggggggcacattctttaaaattggtccctgatctagactctagcctgagaatcatctttaagttcagaatttccactcatgacctcacatctgtgggctcccacattgtcttccaaaacacacatggcatctggcatcaccttcacccccaccctcagagcctcatctccctgcaggtagatagtcaaggcaacctcttcactcttctgccaagcctcctctcctcagctcttcccttcctctctctttttgaaaatatttttaattgtggcaaaatatacacaacataaaatttaccatcttaatcatgtataaaagtggagttcagtggcattaaatacattcacgttgttctatagccataaacaccattcatctccagagctcctttcatcttgcaaagctgaaactctgtccccattaagcaatggctctgttttcctccgttcccccagcccctggccaccatcctcagttttctgtctctgtgagtttgattactctaagcacctcttataagtggatcatacaatgtatctgtctttttgtgactggcttgtttcactttccataatgtcttcaaggttcatccacgttgcagcatatggcagaacatctgtccatttccaggctgaatggtactcttttgtacgtgtggaccacatttcatttatccattcatccacgggagggcacttgggttgcttctgctttttagctattgtgaataacgctgctatgaacatagctgtatgcctttgtcttttaaagcccaaatctgatcaagtcactccccagcttaaaaccttccactgctccccagcagtgggataaaggccagtctcccctgtaggtctctcccgccagccctgctcagtcttcttgcttgtcatccttggctaggccttgcattgccatagccctctgcctctgttcacgctctctcatcttggagcatgagccttccatcatctctaccagatgaactctcatttcttctttcaaaaaataaaaaacccaaaaaacccagagatcccaactgtcctggtgtctgcatagtctgcagcacacgccccctccatggcccttcctccataagcagaatcactcctcactgttcctgcagcacctcctgtgtgcccacacagctgtcctgcggtgggctgtgtgtgtgagtgtgccccctctaggacctgagctccttctggagggtgggcacagcatccattcattctgggaatcctggtcggcaccatgctagaacttctgcaagtgagtgcctttggtgctggcccatgggagagctgttggtaaggcatacttttgcagattccagttgctgctgaggttgttgctctttgcacaagtttcttctagtcaccagtgaagtgacatgtgtggcaggcatggcccagggaggctttttcataaagaagaggttgaatctttggggctgtggtttgaatatgtccctcaagcttatgtgttggaaacttaatcccaaatgcaatagtgttaggaggtggggcctaatcacaggtgattaggtcataaggctctgccctcatggatggcttaacatgtttagtgaggcagtgggttagctattgtgagagtgggcttgttagaaaattgagtgcagccccctcttgcttgctggctaccatgctctcttgcttttctgccttctgccgtggggtgacacagcaagaagaccctccccagatgctggcaccatgccctgggactttccagccttcagaaccacgagccagacaaatttcttttctttataaattacccagtctgtggtattctgttatagaaacacaaaatggactaagacaatcttctttcatcaagttagggtaccaacctttaaagactgccagtccaaggttaaaggaaacttttcaagagcagtccaaacatgatctggccctcagctactctccagggtcatgccaccctatcacccactggctcacacagacgctgaccactgcttagtttctcaaactgaagttttcctcctcagagcttttgcaaaaccttttctttgcctggaaaactccccccacaaatctttagttgtaggttccttctcatcttgcagaattattagtttgctcttcaaatagtctctccagctagactatcaactccaggagggcagagttcttcttcgcttccttcacccatgtgcccactgagtccagaactgtatagcagtttgattgaaaaaatccacagggtggaggatgagaggaccctggatcccagcctcacagcctcttacttcacctgtgtgattttggtcaagtcctttattcttcctgggctttagttttcccttatctaaaatatgagaaaagttcccctctcctgggtattctgggagactcatgtaaaaggcactgagccagtgcagcacatctatgaccaggaagggtcagcttcctgccttgcatgagacacacattcccttcttcatgcacagttattcatgagttaaatatgtattgagaagtgggttctcaggagatgatgcatccacagcattgtttgtatgcctctgtctttgatgtccctgcctgagtcgcccactttagagcccttctgttcttcagaaaccagacttttctttcaatagtttcagtaatcaatcgatcaatcaatcaaccaatcaacagtgataataatcatgagtgagcccctgcccgtgctggctgtgtcctgctgaaggcacactaagtgctgcccttcccagaagcctcaggaagcttgcgaagctcaggtgcatggatgcctggtggaatgaggaagggatgcagccaggtagagaaatgccctgccatcacttgcatcagcatctgtgaagagctggccaggcttttgctcacagtggttgacacagtcaaggagcaagggccccgtaggagaggggagtcaagggctccgggtgggaatggagctgggggctgatgctggcttctggagcactgtaatgtgactgagaaaggtgaaggagccgttctgaaaaagaagaaggcaggagctcgcacagctcttgactcatcttgacttctttttcctgcttcatccaagcaggtcgactctctcgtgatctcagagacagagtgaagtcatgagtgggaggggagcacagaaaataagaccttgattcccagcattgggagactccctgctcccctgagtctcggaaaatagcacccttcaaatgttttagggatccagatttgatgaagagatgttattttggcttttagattcttaggagagatttgtctttctcaggtcaggaagaaaatgctgcccgctgcacattcttcgggacagactcttttaattattactagtttaatgtatgttttgcttagttaaggaaaacccctgtggtttcttgacgtgcttcagtattctaactcacagctgattcagttcagggggctggggagatgtcctcgacctctggaaaggagggtgcatctctagaaataaggctaagtatgccactgacactgtctgcataaacgtgtgtgatctcaggtccaaaggatggggcctggtctaagccagggacgtgggaaatcattttcctgtggcaacttgtgaagaccattctgtgaccttggtgtctctgggccttctcttagattttctaagttggctagtcagtggagctgccatccctcctttgcccatgttctactcccagagttcctccaagaaattgcggagcaatgcctgtttcatgagagctgagtttgctgtgtcttccacttagaaacaacactgtggaccaggaggacacacagctcccagggccatcaccacacaaagtgaaggctggtgaatccgaggcttctagcccttgccgggccaggcccgcagcactccgctccccaacccagccgctgctttgtcgcaggaacctcagcagggcagggtgtttcctaggaggacatccgattcccagccattcctttcagtgaatcacctgagctcacattcttttttcttttatttttgaagctcttagccaatctgcttcgcgatgaaccagttttgcttgaagcagacaaacccgattgtcaggagacagtgatgatttcttcagtctctgaggaagagttttcattttccccaattcgcaaaaaaagtcaggtccctccctccctccctctccgtagaatattttccatgtgtgttaacaatggctgagcgtggtagatgccaggaatttctgtcaaccctcaaagaggaaagccctgcctaatggtctgcccgttcttgttcactccctgccccaggctccccacccgccttctttctggaaggtataaaggctcctgcttatacctggcactgcacgcttcgctccctctgatctcctgactgtcatgcccagtgtctcagcctatcattctacctctaactcgaccttgagtgaccttgagcaagtttctcaggattccacctccaagtcactctccctttgggatatgcagcactaagttaagcttgcctggaaaacatcacttgaagctggaaaaccacttttaacacagcgggaaaagctatttgttcagacaggagtggggtgggtctgggcagagcactgctctaacttggccatgccgtggcagcagctcctttaatgccactttttcctggcgcgcccgcggggcctggagctcagaaagaggggaacgctccctcgtctctcaacagttgctccagacaggtcagcaaacatggaattcagaatgttcattaaacactggctgtgtcttttgtgttcaaaagcaagacactctctctgaaccatggccccacagagagtgcagaatgtgtgaaacctgccgggaaggtctggaccccttgcggggcagtgggcagcaccgtgcctccgttcacaccactcacatggctgtgcctctgcttccttctggcatggctgcttcttcctcaggtctcaaccatctccctcagatgctctttcccatgtttgtggctacaggtccccgtgacctgcagaggcagagcactcaccagcagcccagcctcgttgcgcacccatgtttgcatttgcaggccctagaaccactccaagctccgtgtggcgagatgcaccctcctgcccttcactggggagctgccctcctgttcacagcggcacctgagtcacacatctggagccatcctggactgcctcatttccccgatggggggtttccctgacttcatccatcctgtcttttgggtccccataataactgacatgggtcggcccgtaccagcccctgtgagaagggctttaactgccttcccaccccctgctcatcttagagtctctctatagtgctgctgaaagaatctctaaatcagtggttctcaacctcagccgcacattgagaatcacctgggacccttaaaaaaatcttaactcttggtccaagaattctattacaatcggtctgggatggggccctacaggtatttttttaaagctctccagttggtaatgcatagctagagttgagtatcgctgttctaacgtgcagatctggtcatgttaccagccttttaggtggtcttctttggctttctctatctaaagttcaaaaccgaacatgtgcgcattcagtgcacccattttcaactgtgcattaacacattcagcccaccagcaagatttatgaaccattttctgctgttgtatataacatatcatatgcataatggcataggttattgttttcttcaaaatatatgagatgtgagtccttctacgaactgactcacactgattgcccaacttcctctctcgaggtctcatcctctttccctgcagccgtctccctcttgcacgcacacacacacacacacaccacacacacacacacaccacacacaccagggtcgatgccatctaccctggacttcatcttgaactccttcgagtgtgagtcattactcctttgtgcacctctgctttctcttctcaagatgttcacctgcttgaggtcagttccttgagcgtcttccacttgccatgttcaccacagtgctcaacatgcctgaatgcatggatggcgacttctcagatcctcagtctcctcatctgggtaataaggcattgggttggcgggtccatctggtttcttccagctctgagagtgcatttgctctgtgattcattcgttccacaacacttcaccaattaaagagagggtacaaaaggtgaacatccttggctcccagcagatgctcctcaaaacctgaaaaatcagataggtgagggaagattgaatgaaaggcctcttatgattctgcagcaattttggtggtttaagaactctatggaaaaatcatcagtatttctggaattgaagtaaaatggatagtgagcctctgtgtatgtgaaggcccgcatctggaacatgaaagaacctgtctgatgtgttctagtcaggaaagcaggtagccaatactatttatagaatttacagaaactgaagattttgtttctactgattttcaaaatagtattatgtctgatttttttcctcagaaatatacttcctgctcttctcaacaaactcatttgaaaatatgattagaacatgatagaattttactcatttgccaactgcggttcccatttcacatattgttagaattctgcatggtggctttgccctttaaccactaactgataaatgatgtagttagcttttaaatgtgtggaaaaatataatttcaggttcaaccataggtcagaagtacacgtgttttgttagtctatttgtctctcagtcatctcatggaaaattctcagcttttggtatggaaataattttcttgaaggcaatatttgttgagtgactgacggaatgaaaaacgccagttgcgtaagtgtgaaaaagatctgggtgttttcattggatccaaattccacatgagccaacaacagcgtggtgtggaggctggagcacattaataagaacagtgtcctaaattcaggaggtaatgctctgcccatgccctgtgcagctcagacggtgtgtgcagtgcagtatgtaacccagggcacatttcaggggcccacagggagctgcagcttgtaaggtggagtgcagccaacagagcagagagtcagaatccccgcagagtggttgaaggcacaaggatgcgcagcaaggaagacagacttataggtggtgcgactgccatcctctggtactgaaggtgctatcatggagggagggaagtagattgaccctcctggctccagagtacggaactcagacaaacggtcagaagcttacagggaggccaattttggatcaactttaagaagaattttttaaaagctagagcaatcctaaaatggaatttgctctttataaagttgcgaatgcctcaccctggaattgcttaagcaaagttgggacgggcagttgtgagtaatctcctttccaatccatacccgcaatcaccagaaacgtggacttccctgacactgagcacctcttaattaagcatctcataagtgaacaaaacccagcccttcaaagaagtcactttatttatgtgtgggtctgcagcttggatttcttgataatgttaaataaaactccatctactcttccacaaacacttcaagaaacctaagacttttggccagagtaacaccgaggtttgagagaaaggatatgtgtgtgagaggtgtggtttcattagaacatattatttgacttcatgttgaatcaacacttttgtgcaaaatgcagttttaccagcctctttccttgttttggtcacataatttaacttaacattctcggtacttgattttctaacataaaatgggattgagaggggaattttgaagttcccatggtctgtcctctacattctgacagctcattatctctgcggtattgttctcacatttaagtgaggttagcggaggcagaggcctctcaggcctgaagatagcctctgttttcagggaaatactagactgtgagatctgtgacactgaagcactaagttcatctcacaaaagcaacgtgctctttttaaatggttgatcaaagttactttcaaaaggaagtgttagtttttgttattagccgaaacaagagctgctttaatgtagtatatttaaaatcatatctcaattaagatgttattcaaatactatttgacccaccaatctcattactggatatatacccaaaggaatagaaatcattctattataaaaacacatggctgggcacagtggctcacgcctgtaatcccagcattttgggaggccgaggcgggtggatcacgaggtcaggagttcaagaccagcctggccaagatggtgaaacctcatctctactaaaaatacaaaaattagccaggcgcggtggcaggcacctgtaatcccagctactcggaaggctgaggcaggaaaattgcttgaacgcgggaggcggagtttgcagtgaacagagatgaagccactgcactttagcctaggtgacagagcgagactctgtctcaaaaaaaaaaaaagaaccacttgcatatacactattcacaatagcaaagacgtggaatcaacctaaatgcccatcggtgatagactgcataaagaaaatgtggtacatatataccacgaaatactatgcagccataaaaaagaacaagatcatgtcctttgcggggacatggatggaactgcaggtcattatccttagcaaacgaataagaaaagaaaacaaaataccgcatgttatcacttataagtgggaggtaaatgatgagaacacaaggatacactggggcctacttgagggtagagggttgaagggagagaagcagaaaaaataactattggggtactaggcttagtaccagggtgacaaaataatctgtacaacaaactactatgacacaagtttacctgtttaacatacctgcacatgtacccctgaacttaaaaaaatttttaaaaagatgctatgcaataaaattctcaattaagaatttaacttggtaaatgttcatttaatgatctaaaaatatgtgtctggatggctctagcaaaaaaataaataataagtttctcagagatggtaaggctgaaataaatggggaaaaatctgaattgtaatcctttttctgttggacctggtgttggggtttcacacttgtgggtgaatgtgggcctcctgtgagcaccagcacaaaagactaaactgaacaaaagattaaatgtcacctctaaaattctgtgcaacaagacttccagccacagaatgtgcaactcagatttccaagtaaaaacacaccaggaagcagatcttagatctctgttatctccttggcaccagctggtattcatcctcaatgctagctagagttgaaataaagagtgaaagaactttctcttttattacttaataaacttccttttttgagctgttttaggcttacagaaaaattgagtggcagtttcagggagttccagcacggcccctgtttctttctcatggtccctgcaggtttcccctattattaacgtctgtcattagcatggcacatttgttacaattaatgagccaatattgatacattattcactaaagcccacaggttgcgttaggggtcattcttggtggtgtacgttcttcaggtctggacaaatctataatgacatgcattcaccattactatatcacgcagagtcgtctcctggccctacaagtcccctccttccccacctgctcactcctccttcccaccctccccaaactgtggcaaccatttaacttttgactgaatggatttattcttattctgccttattgtatgtacaccatattttaataagataaaataatagtctatagtagacttctgtaaatactcaatgaataaatacttgcatgaatgcaggaaaaatcaatcagtcttgcaggatttcttatgcgttacatcgtccttataagaaagcagtcattctcaccgagatgtgctgagcagatactggacatgttctgacccagataagggctgggtggaagtagggctggagacacagagacccagtgccaacttccaggacctcggaagaactgaaggcagagaggtcctctcagtgtggactgggcctctgctggcagccaccagcgggcacagagctgatgtgtgttatgccacgtggggaaaacctacagacgattctgagaaaggctcacagggacaccctctgcccctaaaagaacaatttaactctaatttatttctgtcactctgcattttctgacctttcccaagtgtacagttttatatgcatttaactgccaaattgtcatgtgagattatatggttatatttcattaatatattctagtttgttcagctgttcttactgggtgaatttgtgtggtttcctgacatttttgtttttagtagtgcctcagtagttttatacataattacgtttcccttctggattatttccttagtatctagttcaagaagtgaaatcgctggattcttgtggtaaatttttgaatttcacagtataatgctgattttctcaaagtctcacattctaagaaagtataatgaggcaaaacaaacaacaaacatcttaagttgattttttcctagcatcttttccttccatctttgcttgtagaatctagactatttcatgaacccaagatataatcagtatccttcttcagtatggccaaagtgagtttctcattattttacctccccttcaggaaatgacttttcatcttgtgttttgggagccatagatggttctgggcaggaaactggctttggatagacccagcatgtagatggctatttggccttgctcccagtataacgatgcagttccctgtgaaagggtatgagtaggttttggggctctggataccgtgtggcctgaagagacaagggctcaatgccaactctgcctgtttccaactgtgtaaccatgtgagcgtcaaaaatcatggacgtgctctggttaacactgagtgggagctcaacaaattattatttttaattgttacttggacatggccaagttgactacactttatgttctgctacctgccagtctgaaagtgacgccacagaaggtgaaccgcatgttgggagatgctcctcatctgcttaaatgaggtgcaaacacagcccatgcgcctgctcttcatgactgtatctgtaccagcaatatttgtattggcaaatcacatgccccagtgggaactacttaaggggaattcaatggatttcattccttttatgtaattggccacttagtaatagacgtgtaggtctcttgtgtggataaggattctgccttttatgtaagatatgtgttgcaattcagctttcaggtcccagccccgggaaggctccaggccttcacaaactggcccacccacgagaaggaaagcaattgtccaaatgtgggtagcttttcttcccactgttgtcagctgcttccaattagcccccatatacataatcccagtttgtgtctgtatcagtacaattctcccatgtcaatgtgaattttaagccacagagggaaaggggacagagaatatgctttcattcagctctcctcgtctcacacctcttgccctgcatgcatttctttgctctgattaaacgagcattttataagccacatttgctgtgtgaaaggcaaagtcttccctcccacggatgacggtctccagggatgtgtgtgtgtgtgtgtgtgtgtgtgtgtgtgtgtgtgagagagagagagagagagagagactgtaaacatatatctctgtgaaacttcattttccatatgtgaatttttggaaccgagacaaatggaacttagctaaaagatgggaaaggtagactgactctgacttaatctacttaacctaccaggcaatttataacttgatggcctaatttttgcagcacccagaagcaagcctgtttcagcacggcaaaggctcagctgctaagtgggcagcattgttggaggtgagcagcttaggctgactgttcatcaaaggaccaagcgcttgaggttcgctcatcgctggaggccagagtggggagggccatttaactgctcaaggccatggaactctactgtcagtttcagggaaatttgggaccctggagcacaaaccaaaactccaattaaccaggagaggaactcgatccccaggagataagtgaagagtaagaagtctatctttagaaacaagagatgtccaaggctagaaagatggggaaggagggtggaactgttctggaagtgggtctcaatctcagcaccagcagctctcaagactttctagagaaggaaacttcatttctgaattaaaattagtcttcaatgacatggcagggatttcggcacactctcttgcgtcataggccactgtgttggaggcaggagtgttggctttggaggcatagagattaaaattagagtaacacgtgagcactgaaaaggttaaacagtagagacatggaggactcccgacccccatgtacccctttcttaaccctttaattaagatcacagccctagaaatagcttgcaaaataattaactactgatcatttataccttagtgcttctgtgagcatgttttctctttcattgctgctcatctgcatggaaaaatgtgcatgggtttctgaatataactccatggtgcttgcttccattatatttgtgccatttggatcataactgataagcaaccaaagagtcccatattactgcacgttcccatcgctattttatgtgaaggtggtcctgggggctgttctgaattctcagtttccttttttcccctccccagttctttgaaaatatcagaaacggacttgtggcatctttgaaaagctacttaaaatgtgctgctgtgctctgaacttgaaaatgtgcttttaatacaaagtttgtgcagcccttgctgctcatacgagatgaatcttaccatgtggtggatgcccgtctcatgccaggcactgtgctctaagcccattggtttatttcagtgcttgaaattggctttcgagagaggcaccacggttccctttttacaggagaggaaacaccagaggatcagagatggagagtctttctccacaaactcacagaccccaaaggcaagctcagggttgtcagcttccaaagtctgcctgctccaggacctcatgttgcatctccattctcttcactgagggtcaaatggaaagaacacatgggggtcaagtttcagaaaataagagaaatgaagaaatatgtgcccggaagcaagaacgaccgacctcattaaactggctcccttcacctcctctcacatctttttctgccttttggccaagttttctctcccccgcatttcctccttgatctcgtttgaatcctcttccctggtgaagtcatttaggttcaggctcttattttactttggtccataatttagatcgaaccacatgtgctgatgtgattgaaacgatgtggaattctctggacagagatagaattatggaggggttagtgtgtgtgtttaagattaaaagaccaggtgtatgggaggaaatataatgaacaaaaaatagtattttaaatgaatactaaacttgcactcatggaaaaagttctcttcccatgaggttctcgcaaagcattttaccatcagcacacgcagtttttctcagttttctgagatggggccatcttgaatccaacagacaacacacagcatcagccagactaacacaaaggacgtcatgggcatggacgtaaatactggtgtcaacactaggtctgcacctcgagaggagtggagcaaaaggatggagtggcagatgaaggtatgctgttcagaaaggaggcagaaatgaaaggaagaccatcagtgcgctccacagcttgaggaccgtcctggagggcaaatgccagctgctcacttctgaaaagaaaaattccagtgaaatgagtacagtcattcttaggattactcacttgatactgtgtatgtctcttcttggcttctcatctccacacaaaaccctcaggtggtaaaaatctaattaaaaaaattatataaagtcttgtagatttattagcctgaacataatagattttttttaagcacgttaagtcttccatggactaaaagaaaacttgtaaacctaagagaacctctatttttgatatacaaaataatacatttccttaaactatgatcttgatactagaattttaattaaaaaatacctgcagtttatatgcaaagttatagattaatgcttaaaaataggttgtatgtagtatccacaggtcatgtttgactgtcaaatagatgtaattttaattcataataattgtgtcgtgttcttccccactagaagccaattatgcaagcttcaccattcacacatggaaaataatttaatggagtactcattgcaatttcacttatccagaattggctgttgttctcagagcagcttgtgttgccttgttaaggagaatatgttagtatccagacatccagaaaggatcctttactgtttcagagtccattttccccacttttgaaatacacacacaaacacccattcatgcaaaccaaacagagattgtaaagtgattccactgacatttatgcacttcttttttctctttggttcttcaaactctcagtcagtgcgcatttactcttaatttagatacggtttaaacctaattagaaaccagaagctcttgtatttccacaaaggattatgacagccccaagaaaagatagtgaaaccattatataacaagataaaggcttcttaacaatacaaggatggattttctcattgatcttagccttctgaattttagaaattgccatttcaaagtctaaaacaaaggaaaatcagggaataaaagaatggtaagtagacacaaacctactggctccatcatttctgttttagcaaataacctgccacatataccaatagcccaagagatgggcatgtccctgcatttcctggtcaaggtgacaacactgcgtcctcctggaagaggtctgccactcaccataccacaaaccaaatataataaaatcagaaggcacactatagtgaattttttagaggcatgtattgaaaagcatctcaaaaagcattctcgaagcttccagaagtcaactcaagttatctgaaaagtgacacttttgatgattgctcgcttaatactgggagagccagatgaagattcctccccacttcctcagatgtgcaactctggaatttcttagtgttactggagattcctgctgcattctgggcctttaatgcataaacactgagatgttctaaggaaattactccctagggaggagaggggtggacgaggagtaagctttgctggtgactcatgcgctgtgtggaaactccctgcacaagtgagctgcgcagggtgagtctaaagggttaatgcactttcaaaagcctctaatttgttattccagaagagtaatttactcactagaagtatctgggtggctactaacacatttgtgtctttaaaaagatcagttttattttaagattaaaaatataaagcaagagctggaaagtcactaaaaactgacagccagtttcccattttcaagagtatttattaaaaggttctggttgcagaaggaataagaaatggcttgagatcatgacacagtgaatcatgttgtaaacatgttagctatggctgtgaattcaaccagcgatgagttcaagcgtccccagaaggtgttgggggaattagggacatggctgtgtttccccagagaaaagtggccattttactttccctcttcactaacatgcttttgacatgcatggcagagctgaaggcaaggggaaggggacaacatagtaagtgactaagtggcttttttttttttttttttgccaagtgaagctgagtcatatggcctctgtcattccaaaactattctctacggctgcattcctttcgctcttgccttcctttagaaccctggagaaggcctcctgaagcctggccctattatgtatcctgacaaagataaacttttccaaaaagctgcatgttgtttctagcacagtttttcctcgcagtgactacgtgatgaaagtaccatgcagaggaggtgtctgactgaggcgttcgtggtgtgtgacagagtcccctgcacaggacagccgcactcccctcttgcgtcctttcctcccatgtttgcaaagcctctttccctgtcagcagggggtgttctggcagttgacatttctgaaaactacagcctacatttttaaaaaatccagtaagtgaaaactaaaaaattaataccgtggtcataatagtgtggcatttgataactaatgaggcactgtcgtgccagctattattttcagacatttacagtccttttttaaatacaaagaaatatttggtgtgaaatgttccccgggagctggtgcaagcagaggcgacagggcaagggagcttgggttgtagcctcgaattcctccggccagggctaccgtcagcctgcggcacacaagtaaatcaaatataaaaccaaaatttctgtaagcaaatcagtttctaactcactgtaacgaattatctttcgcacatcacagaggcatctcttttcactgtcgagtttggtttgcttggttacaaaaagggcagttcaaaagctttggttgctattgtgaaagtcagctgaattccttccaccgtgctggggtggggtggggttcacgcaggttctcttttgtcaccaggggtgctgtggattcacaagtaagcaagaggctcctcaggtcaagcctctggctgctccctgaggtcagctgcctagcttctcctcctctgagatagacgggaacaaagtctttgatgtgtgcatttctcaagcttgacaatgatacagctacataaaaacccatgatttcatatagatattccaaaacgtaaaagtaaaccatgcatccacagagacatggaattacagaactggatgctgagctggtcacttgggaggcaggcgtccttgccattggtttatgcctcagccccaccatgcagtggctggccaggtgacctaggccagtcctgcatcctcggctcctcacctgcctggtgggacagtgacatctctcctgcagcactgctgtcagggtgagggaggtagggcgcagtttcagaaaaccattgggctgcacctgcgtgagcacagctgcaggagcaaaagtcagaaaggtcagcaaaggatttcaggagcaaaggtcagaagaaaccctcaaggtggttgtgtctgcaggaaagtgctgtcgtctcctgcaatgctttcaagactattcagaagcacagtgtgaagggagagccggagcccatggggaaatgactccagagtgttccacgtgttggaaggcatctgttggaaaacggacattcaagcaaatagttgcctgcatagacaacgcagaatgactgggaaagccccaacaagttacctactggtaaatgaggtgagaagcttaaagtgagaaccccattgctgcctctttttcactttaaaaacatttaagttttgaattatggtaaaatacacgtaagatttactactgtaaccatttttaagtgtacggttcagtagtgttaagtatattcacattgctaaggaaccaatctgctacttttgtttattaattttttcctgaggggaaatatttttaaattttaaaatatttaattgacaaataaaaattgtgtatattcaaggtgtagaacatgatttcatatgcacgtacattgtatactcattaccacaatcaaagaaattaacacatccaacccacccatagttgccattgtgtgtgcgcggatgtgcgtgtatgtgtgtgtatgtgtgcacgtgtgcgcctgtgtgtgtctgtgtgtctctgtgtatacgtgtgtgtacatgtgtgtacgtgtgtgttcctgtgtatgtgtgtctgcgcacgtgtgtatgcatgtatatgggtatgtgtgtacgtgtgtacgtgtgtgtgcatgtgtgtatatgtgtgtctgtgggcacaggtgtgcctgtgtgtatgtgtatatgtgtatgtgtgtacatgtatgtacgcgtgtgcatacgtgtgtgtgtgtgcacaggtgtgtatgtgtgtgcctgtgtgtgtgtgtgcatgtgtggtggggacactaaaaatctctcatcacctttttagtcaaaagaacagttgttttggtttggctcttctgttttaaaatatcagaacaataataatttcccacagacaaaatcctcaatcctcaccatccttctatttcctatattcatcataaacttcatgcttgatgttgaaattgttttctgaaaatagagaatacaaagaggagattttaaaatgtcagtggcagccccacactcctttttaatcttatttcctgatatcttgagtttacttggacgtagagttttccttgactatggttatttctggtagtagcagctccagattaggcaatggttttcttcagagatagcttagagtgagccccagaacaaggtcaatgcgaagattgcttgtgtctgcgtgtccagggcacagtgatcctcatcactagccggggggctccgtgaggatctgctcctggtcgtttctgttctgtatcttctctgcagcccttactgaagccgttaccaactggcacaattcaattcctactgtacccatcatgcacagatggctgaagtattgagaacgctccagtgaccgggaggcaatagtctgtccacatctaagaacacacttggaataaccttagagaagagagagagagagagaatgcatggttagtaggttatcaaactcctatgacttttcacaggaaaagccctcatccacaccaactttaggaatgtgtagaaagaagggtcagggacaggggtgagtggtgggcagagcagttggagggcacagggaaaaggcatctggtcatgtatttggagtaggaggtcttgctttactattgaattgcagggacactttgggaacagtgttcacttctttttgcaaccatttcttcagagaaaagtcatgatactcaagtcttcttacaaagcagtttgaggctttgagtaccagactgattacagagatgagtatgaagcattattgtagtatttttaagtgaaattcactaaatgcaaataaacctagcaaatgctctatggttaatttttttctaaaattcagataattaagacaattcattctcctgaaactgctgttcatgtaaaaaggaattttatcgaggtggcccttgagtgccaaacagcctgtcctcagctgcaaaatgagtcgttgatgatcctccagcaagggatactttttagctcgtgtggtgattgctgcacacgggatatgtgcagcaagtatctgctgagctaataataaacagcctcagacagaaagacagtgggcacaaggtcatgcttaaaaagaccccttgttctactgcatcccagctccccaccatggggcctcacaggccctggtgaccaagcacatcagacctggttcttgctcagtcctgggagccacagaacccagcacgtactttacccccaagaccagactccagcttggcttttgtcctcctctccaggattggtgacctcctaggtcgtgaagctgtgatgagcaaagacacactcctctccattctcccaacttcaggtccctttgacagtgtcagcaggcatttaaatagcagaccacccacagcagggctggtagatgcagtgaactcaggaagatgcctgcatagactctagtgttaaagacagaatccttacaaggaacccccatagttacctaactgctgtctccagtggtcatagaagtgtgataacccactaatcatcattctctgtctctctgtctttctcatacacacttacacacacatacacacaaccttgttgcttaattttcagagagtctactttcagaaaagccttcaggaatacatcatgtacaaaactgagaaattacctgaagtatctttaaatttagtaaaaagttgcattgttttttgaacatcacacttgaaaagtacatgaatacaaacatacttaggaaaaaaagctttaattaatttaaaaaggagaacaatgctatatgctgtatcccacctttctctgaatgttacattttctcccctatcccaggctgcatctaagaaaactcagagggaatatgctatctatcttttccgagcaatgaaagctctgggttttttccttgcttttcagggcacaatacttctctttcttcctggttagacaggataagttctgagtcccctggtatcatcagcttacttcttctctgttaaatattcacaaaaaatcactaactttcatgcctcagcaaacctccactgcctaaaatatagtgaggtcattcatcttcggacaaattgccccaactacggtgggaaaagaaccaatgtgttggactatttatctaatttttgtttagttcggggatacaaataaatgcatagatacatacaaacatgcgtacataatagcagcagcagcctgtgaaacattgacaagacctggagttggaagaggactttgccatcctccagtccaacagttgcctgtcacagattagacgactgggatgtgcgcaggcgattatttgcaaacggccctgagtcccccagtttatgtcttaattcgcagccagggctgattgtagaagcaaatttgcaaacatgtgcaagaagaaatcacacatcctagagcttggatttcctcgtttcttgctatttctatccgtagacagaaccattgctgagctgttaaatttgtctccttcccctataccagtcttgaaaaaggaaaggaagtggagcaaagaaaaagaaattaataaagccggcagatcctaggagaatcttatttaatccaagctttgtaaagttttgctttattccatggcaacatgggtatacacatcccaccggctgtttcagtggctcagagcaggtaaggcctgtgccaaacgccgctagcaggaggaacaacgtggagacagccccagaggtggaacgttggcccttctgtggctccggtgtctcaggacctccctaaagcccagccctgacactgagcaagtttccaccactgttaggaagaagtagaaaggaatttggagggttggtgttactgttcaagagctggaaggcttctgcccccattcccattccattaattgcgtgaggtagagaactcatagaagataggaacacatatgctgatttccaaaattgcctttgtatattttcacgtgaagactttaggggcaaaagaaaagaagcaagcattttgaatatgtgtttcaatttgccttctgttatataaaattgtattttgcctattcttttttcattattcggaaccttcaagaaataaattaagttctctcaaaaatgtgttttttgaaaagaggactaaaacagatggcctggctgtgttaaacacagggaccagaccagcacccacctctccacctgccctgccttcactggcagaattgtgatccatcatgttctctgttcaatgtcatcatccctttcagagcatgggtctcttcctttctaggcagtcttaccaggatgcatgggtgtgcctgcgtaggcacacgcacagctcccaaggactctaaaaaaagatatttttctgcttatatactaataatatgttagagatttatgtttcaaattagtacagaatcacatggttctctccaaattatatttgagagagaaagaatagaacaaaatttattttacaaaaatactcagtacatttagggcatatacaaagatgttccagaatgtagcttatctctttaaagacaattaacacagtttctgggcaaggcaaggcaaaatattcagtaacttagcaacaccaacagaagacagccaatattgcagcacatttttctcttggattgggtcagagagtactgcagagaaaatggagtagagagacctgaaatactttcgcacacactgtggtcagtgcagcgtccactgtgtgccacagtaatactagaaactccctggttaggccttggaatccagctctcatttcgtatgtgacctgcagggaagtaagttaaatgcacacgttttatcaagttcaaatgcaaacttaattttaaatgtatgcaacatcagtttaagcgttgtagctattactagcaattgtacctattactagtctgtactctgcacaactttggagtatactgcctactcaaggtggattttagagctctatttgtggcattatatcacggacaaaagcacgttcatcagagtcagaggaatgtggtgcaaatcccagctgtcccacttaccagctgtgggacttgagtaagctcctgaagcagctgcacctgcattttctggtgggcaccatggagctgtcagcagtgctttcctcagagggctgcgggctggatgaggtttgctggtgcatgtgaagtgtcaatcattgctctcatgagtggtgatgctgatgccgttcccttttttagggaagtgattttcccttacaaagttaccaacagtttcatgttggcccatttttctattaattgtttccactaataggaccaacagtggtagtcccatcattttattactgcttgtcgtagcacaagcagttgcttcattgtgtttagataaatattgacggctgcttttaacagtctgctgttttgtctccttttgaggtccttaaagtaatccttaaaaagatagtgcagatggaaagatgtctggagtcagtgaacctgccttctttcctgtgtgcttgtcagtttctaaaatgccatacacaaaggactttcatgatttctttttaggtacatgattacagttcaattcacttcactgtctggaaaatttccttataatcaggatgaaatttctcatgttagcctttcacatttcactacttttagataaggaattctcaggctttgctatatctgactgctcttggaggctgagcttttggctaactacctgactactttgtcgtttctcttcccttggaatgaagcaaatatctaacttctcactcattgtttctgctattttaccatttagtcatctgtgatttttctaaatactgaaagacttccctcaattcaaactatgtgccggatcaaggaaagggcagttggatattgcagacagcatagtgcaattgtgaagagtgtctgcttaccagccacgctgccttgcacaagttatcaagcctctcaacccacttcctcaatctgtaaaataggtatgagtgtaggaccttcccaggggatttttttgtgactatagaatgattctcagaagactttcaggcagtatgtgggtgaggcacatgctggaaaggcttctgcaggtgcagtgatcaatgcttttctcagtgtgtacatcccataatacagacacgttaccagaaactccctagccaggactttgattgcagctcacattttgtatatggcccatagggaaatgaagtgtgtattttttataaagttcaagtgttaacttaatttggaatttactatcaaatctcagttgttatgggcatttatagctattaatacttcgtcccatgtgtcccatgaggaaaccaaggaacagaaattaaagttctttctggagtcccctgaatctcgttcctgttcttttgcaccctgttaattacatagagacattcacagctcttctgaccttatcagcgttaaggaaaacagaaaaccagcgtgctatttgttctgtcccttagtcaagccttctcaacatatatttttcttccaagattttgcatgtgcacagggatgcctatcctctacaagaaacacattttaggcaaattataattaaaatgctgtttacatctcttcacctttagaatttaaagaatgatcatttcttagattgcatctcagacacacccttcccctagtctggagagggcgaggcccatgggtactgcaaacagcctgacgttgtcaggggcggtctcaacggctcattcaccacatctgcctcgcgaaggctaagccatgtgctgttacccctgctgcgctctggctcattctaaggtacacgctattaaccttgtgagaaaacaaagaggccagccccacccttcctgctcactctgagtcacggtgaaaatgtttcaggatctcgggttcgaccatgagtcctgtccaggtccaggaggaaattcggaaggaccacatgttcactctgagatcccactttcatttccctcctggttgagcagcattaatactctggctagatttaaattctggctttctccagttagaactgaaagttatgacaatgtaatcaaaatagaatgtgggtttacagctggccccctggcctggtttgtgaacataaaacagaaacagaaagtgtaagtggtgacatcatattctctcattcaatgtgaaaggccaccgaagtctttccagaattatttttgagaataatatgaatttttaaaaaatacctaattattttaaatatcgtcttgcttgctccccaaatacctactgttttcaacttggatatacgacatgattaaagaatatctaatatttgggaatgcatactttaaccttataaactaccactgtaaatagacagactcattaaagtgaaaggacattttaaatcaattagtaagcaaatcaattaggtggcaaagacaagattatttttccttatggtagttgaagaataatgcttaacctgtcattctaattaccaagcacggtgttctctttggaagatcatttcaacaaaacattattttcatccagaatttgaaccttgagattgcatggtattttagaaatctattttagaaatctttggcaaaggttactattaaaacaatcacattcatggaaaatcagtataagagcaactaaaataactcacaataccagtaaaatcactttgtcatcttcttaagacttttaaagagcatttgtaagtaactgaatagaaggccaaagggtgtgtaggtagcccagaccatcagtgggcagccagggccagggcaggggccacggttgcagcctgcattcttctaaagggcagagcaaattaaagttgaagcaggagctaaaaaaaaaaaaaaaaatgtttcaaagaattccaccaaccagaggatactacctaggacagtttgggcctaacttatctgtgaaggcctccagcttcctccacaccggtggccacttttcattcactctgaacccttctttgtatggaggtcattttattaattgagctgtgaccaacatgacagaatttcctgttttagggcttttataatatagatagtttatatctaatttcagaatatattcactggggaatggacttagcaaccactaccacaacaatgcaacaatgtgttttggaacaaatttaccaatctgaatttccccctagattaggtcacaggaacattgcagctgatgtacagctatgttcctcctgaaacttggagacacatcctcttgagctgggttataatgggccacccaaagctcgagttcctgtaatggatacactcaggcagcagaacctaccaccgtagtgaggacagcacccagagccctcagaggccatcacaagtgcaccacagctgccttctctggcacgctcagagctacacagtgtactctgggattggaactctttatttttttttcagttgatttgtaaataagattgcacaaaaatccatgcacatcaactctccaaatcagaatttgctgagctaaaaagagcattaaattagatgggctggctttcaaggggtgggggtgcaatagtggaactctgcacaacagttctttacaaagagacaagcaagcacatcgcgtggaaatttccattcaactggaaatgtccaagcctgtttacctcaattaattgtccttgttcacttgtccagcctagcaattgtccattagtaatttgttataaatgagacatttggtattaaagcatctctttgggatactggtatggtttattataacattctgttagtagtgttgtacaagcttgagatgtattaatacgaaatccaagctgcatgagggctttatttttcaagcctacaccttgctgaaattctgaattaaaatatgattctcagtacaaatgaataaatcaacagaaatggtaacgcatgtcaaatattcttaaaacccaagaaagccttgtaacttccttcaatctaatgggaaatgcaggcaaatacaagactgatgtccttgagttttattatcaagactcaagggcaccagtaaaatctagtttcattggttggaaaaaaaatcctgataagcactgttaggcatattaactttaatgattacaatttttaggacactctgtggcctagacttagaaacacaactaatgtccagaaaaagattcctctttttattccatcatctgataggcctatttttacacatacacaccaaccaaaagtagccaagcaaacaaaacaacatactcacaccccttcgcctattatcatctaggtgattttcaatgctcattgcaatgaaacctacttattgtgcatggcacccacccccactgaggaatactgtagtttctttccctttgaacttcattagtagagcacatggttcattcactcctgaagagttcttcgtatgtcagaatatatatactacaacataatttccatcagagctctgaccacccgcttatctattttcataatgcctgccactccatcattagctgttgtcatgtaggctatcaataaatatatgacaaataaaacagttagggaatgagggaaattgactagcagccaaagacctaagccatcctctgcttggacattagaaaactgagttcactacagtcataagatacacaaaggcagaatgtaagccatacaaaaatccatgtcaatcccaatatgtgagtacaactattgaacaccatgtactaatggatgagttggtaaatcattcaatgtcttcatgaggtcaattacagattattatttagaccccaaagattccaaagatggtatttcggtcagatcttcatcctttgtaagcctagcagaaaatatggcagttttattgactactattctttgctgggtgtggtatttttaaactgagacatcagtgtgcctagcacagggcctcaagcacacagaaaaattccttgataataattaaataaaatttcagcaaaaaatatcatcttaaggctgtgaaattatcttcctgtgtggctaaaatagtgaataaaattcagcgcaatataaatcatagtacaatttcatcactaaattttctgatcttgatcttgtcattttacattggaagtaaaaatgtgtcctcctttttttctctgacagtgaaaagtgtgtgtgtgttgtgtgcccttttgcacaccctgcctcacacttgctggtctaattccttccagcatgattatgatataattaaatgacagaaatgtttacttccaagtggaactaagccagggtaactcagggtagggcagctgcttgcaccgaaagaccaagactgctagagaactaggaaacaggcggtgcaagaactccaggctctcatggaagagcgggaggcttctatggggctgcagaaactctttggtgcttggggaaaaaatgggttaaatgctcttaaaaaagaaacctgggagaggtagtttccagatgcaggcccgtcttttcttttaaacagaggcagctccgaagagctggacattgaaccctgagcaggaactggaggccgtcagcgcagctttgtttggcgagcggagctttgcaagggtgtaatgctgcaccagggagacgctatctgcagggaccggtgacgccgtgggtgtggagggggaggcagtggctggccctcttggggtaaggtacgcccaggaacagtttagaataacgtgcgcgagtcaaagggaagaagaagctcctgcagaccttctgggcactgtgcagggtttgctcctgtccaccgtgccgtgttcctgtcctggggtatttgggtgtgtggcgtgtggggaggggagaaggagcaaggcggcagggaggggatgaggaccaccctgtccatgggacaggccctgggccccgcacacaccccaagccccgcgtcccgcgtcctcactgtcctgggacaccccccaccccaccccaccgccacagcccagagcggtgccaggaagccgcctcgacgcagccgtatcttgaggctccagccccatccccagggtaccacgccacgtagagacactatttttcacttcgtgtttgtcactcctaaagcatgtgtgctagctgcaccaaccctgggatgcctcggtgcatagggtttatgtgcgtcctcctccttccctctgagctggtcccccgtggggaactgctgcccagactgacctgcgtccttccgcacgtgcaggaaaatgtccacgtgcacttgtcagggtgggggccacacgggcaccaccactgatcatctgtgggatcgagttactgcccatgcagatcccacgtgcagggcccagtcgctttggtgagagagtggacgctgtggtgactccacggtctgtggctgtgctcaggaggacagagaggggacatcctgagatggtttgggcagcccgcggatcctgtgcatgtccccagagcgtccactttctccatggagcagtggagtggcgttgctgagacagaaagttcaggttctccactccccatgcagcccccactcccctgtctccggccaggcacgcgtctggggtggagactcccggtgcccggggccctccagacctctttccccaccccagggagcaggcgggtacttctattccgtttggcttcagaagggaaaagagaacgtaagttcagggagttctcgtccattcctctcccgtgggccgggcaggcagcagggacagccttcaggagccaggaggggctcgagctgcgaggccctggaatgaggcaggcatgggctgaggctggagggaaagccccgctaaggctgggcgggggcgggaaaacttaccaccaggggactcgagatggggaaggaaaggtcagaagaggagaggccaggcacggggtgtgggcggcctgcagagctggagcaggtgctccgcccagagccaggcatgcacactcagagtaggtggcctgtgcagcggggaagaggggcgggtcggcgtgctgctgaagatgcaggagctgcggcctgctctgtgcgtgctgaaggtgtggtgagaagcacttacaaaaagaaatggactgtgttaggattgcacattttactttgtttctcccaaatacgtgttctttgaatttttttccttccagggccaggactggagtgatggttgagacaggcacgcactgggtcttgtctgcatttacattttgagattttgttcagcatggattttatggcgtttttttgtttgtttgtttgttcgttttcaaaatactgcacggtttatcgtgaagacagggtcctttgctgccgtcttaagttttgggcccaagaacgtgccccaccctaggcccgggcctgctggcttcatagctctcatcattcccacggaaccttaagacctgaggacagaaaggaaggaaacaagcccagtagtccgtgaaaatccagggtcccgccactccaggtgtctgcagcagagctgaacacacgtaggctcttgccaggaggggcatttgtatgtgctgagcattccttatattctcaatatgacgcctttgaaagatctgtggtttgcaaatatttactctcagtccataacttatctttccaacctcttaccaggctcttttgctgaataaaagttttaaattttgaagtctaatatatttttaatttttttattttatggatcatactttttgtgtcaggtttgagaagtctgcaccaaagtatgtcctgtggttttcccttaggtcatcttcaacaagtttcatagtattttgtttagatgtaaatctgtggcccattttgagttagtttttgcacaagagttgaggtcaaggttctttttttgcctgtgatgttcagtggctctggcaccatttgttgaaaacatgatagccaatgtcaagacttaatagttataataatcaggagcttttgtttctttttgttttgtttttagtaactgccagtcactgcttgtggtatacatacacaatggaatactattcagtcttaaaaaaaaaaaaagaaggaaatcctgtcatttgcatacctggaggacattatgttaagtgaaataagccaggcaccaaaagaaaaacattgcatgatctcactccttcatggaatctaaaaaattgtattcagagaagcagagagtggaatggtggttaccaggggctgggaaggtgtgagcttggggagatttggtgaaaggacatagaatctcagttagacaggaggaataagttaaagagatctattgcacatcatggtaactgtagttagtgacaatgtattgtatacatgaaaattgctaagagagtagattttaagtgttctcaccacaccaaaaaaaggtatgtgcagtaatacagtcattaattagcttgatgtagccattccacaatggatacatatatcaaaacatcatgttgtataccataaatatatactgtctctttatgtaaatttaaaaataagataaaataaatgttattcacttgtcgtggatgtggtggggacaggtgtgggatagccctccctgtacaactaggacccaggggtgatctagtgacactagccatttatcaggacgtatgggtgccagtcaggatgataaagcttccttttggccactatactacttagaaatgccctgcaaaaggtgcacatcaaagattgaaagctcaatcctggattttaagtgcttcaaaagtgcacttaattgccacatttttgtcaaacattttcccaggtagtatttttcctcatgtaaaacaacagcaatttaatttgaacagaaagcattttgaaacatacttttggcagggttccttgcagatcagaatggaaatgattaacagggcaattatcaatcatggacttttggcggcagaaggaactgtattgtttggtacagtctgggccagggccacacaccgtaacggagatactctattctgtggacggttggagggggctgtgctgagcagggtaactgcatcttttcctagactgttcacactgctgccacgaaggagtcttgtttagactggacctggctttcttcttcgcaatgagtgttgcagactcccgacaaaggccaggtggtaaagtgtggtgtctgtgagcgagagcctgagatgcctgagctgacctgtcctcagccacctgccatcgtgcagaggtgagagcagcccctgaattctgcccctcggtctctccatagctaaagcaaaaccatccttccgtgctcccaggacaagcaggctattaccaaatcacccactaaccctgggcgaggaggggccatcactgcacaattcatcagtgtctgtgacaggaagagattgttttagactggtttttttttttttatttgcaagcttttttctctctccaaaacgtgctgtcagtgtgttctaatttactctgtaaggaattctggagctaatcataggctcacaaaaagcagcacaggaaagtttcccagataacatctatttcagtggctttcaaacatttttgaccttaccaaagtaagaaatacattttaatatcatggcacacatacagctgtatctaaactttcataatactgcctttacgatatcactctgatattgtctattcttttctgtttatttttctttttgttccttgttatgctggttgtgacccactccagtgatttcacaatgcaggctgggtggtgtcccacagtttgaaatcccaatctagggccttcctctcactgtacaaagtaggtaactggggacattagtggatcagtgatcaaaccaaagttatttgatcttaccaagtgatatcaggatgagaaagctgttagagtgtcagatatgtgaaggaacttgggtcattcctgatacctcaaagagaaaaaaggtagtccttgaacacctcctacttgtaaaggatgcacaatcctacatgcccctccctttcctttcctcccctctgtaccccacccctgcccacattttcttcataagcagctttggtgttttggcttgtttgtttcccttgtctcctacctgtgactttatagccttttggagactcacagcaatagttgtatttaaactcagtgggtggcatccaaggctaaaaaggagattgcctagacacaaaaccacccaagggagaaagcaggacagcatcttactatgattgtttcttgtttcttcctgtctcataaggattattacccagggttttcatttttttcatttcatggttcattttcgctccagtgtagacatacaatagaccactcgtccctgtggctccgggcagcagcctcatctgagaccctcctgagacatctcgtgcagggcagccgtagtgtgtggcttccccagggctgctctaacagatcaccatccttgccatggcttaagaagctgcagatttatttgcttacagctctggaagccagaagtccaaaatcaaggtgtcagtagagtctctctctctgaaacctgctgaggatgatgcccctggcctctccccagcctctggtgttcccagcagcccttggcattccttgccttgtagatgcaaaactccgatctccacctctatcctcacagtgagttctcctgcatgtctgtctctgtgccttcacattcctctctgtgtgtctgtgtttccatctccttatgaggacacccatcactgaatcagggcccactctataccagtaagacctcatttcaactccattacatcttcaaaaaccccattctcaaataaggttacttcacaagtgctggaggttaggacttgaacataccttattgaacaatccaactgatgacacatagtaatttatgcactcgttcttggagacgttgactttatttagtagcattaaccatggcaatgtcaccagcatcgctgacagcctgaagcatatgatctccagaatgtatttcaatcatcatgttcacttccttggtattctttagacaataactcagccttgaactccagtaaagggtttccctgggattttcttcttgactcactccactgtggcctccctcatccaggactgtaacagacgcctgacgtcagtggtctagacctctctgctgaatgtcatctttggtgaatgtcttatgagaaaacacatggttggtcactcttagaagggcatgaaagcctgtctgcagtataaccaaaacaggcacatggcgaggcacactgtgcgcatgtgtgtacaattaatatcatggttttaaattattttcaggccaaggggagatctttgctgcatctactgaagaaagcgaatctttttcttcctgaaaaaaaatggctacttattagtcgaatttgtgttttaaaaatatgtgaactaatataatgcagacatgcattaatgtttaaatatactggaagtttttggtaaaatgaaacccattgtctctgttgattactttgatgagtcaagaagtaacatcctgggaatgattggccagtttaaatgagtgcctcaggtttttggaatacaagaaatcaagaggaagggattagaacatataggttagcaagattgggatcctaaaatacagacccaaatgaatggaacaaaatcagggaatttattaataacagggtcaaggccaaatcagtaacaaatatcctgagtggaagaaaggtggtttaacaaatgcccctatgaaagatagagattggcttaccatgatgagatgtaagcccaagttatgaggttggcacacaaaaccacaaatgtcatagcttaaaacaacacacacttcttatctctgtttctgtgggtcagggtctgggttctcagggactcacaaagtatgttttcatctggagctccaggtcctcttccaggctcataagggttcttggcagaattcagtttcttgaggctgtaggactgaggtcctggctcctagaggccaccctctccataagcagttcttagcatggccgcctgcttctccaggcccagtgggaaagcatgtgcctccaggagggctcagtccattcttcatggcttttacctggttaagtcaggcccactcaggataacttcattttgtattaaatcaaaaccagctgatttgggatgttaattacatctgcacaacttcaactttgccatataacctaaccatgggactgatatttatcatgcatttgggtcaagttgcattaagagatataataaagctggacaagcttctgttgattagaagagttcagttacaaggctacacttgggaggaatgtttacaaactggaatggtcagaggatggggaagacacttgagaaaagtcaagtgacggatgaaggcaaatgtggatatttatctgggagaaaactaagaggagttataatagctgtcttcaaatatttaaagggcttttattaggaagaggaatttggcatattggattttgccttcagagaagtggagtcctgagatgctcttagccattcattccagcctccagggctcacctgctgtcttctgtccaggttctcggtagcagggcagtacagccccatccgtgatcttccatagtcaggcatattgtcacactcagtgagcggagagtcaaccgggaggaaggcacagtttctctggaatgacctacggaatggtacgctcaaatgcaaattctccttcccttccccagtccttgtccttcagatggtaatttaggagctgaaggtcagggcaccagcagcctttggaagcctacaggacaacagtcagcctggctagaaaaaaaaacaatgtcacaggcatgttgtgtttaatcacatgaaggatatttgcattgttttccaactgatgccagcagacacattgtcagtggtatcatgcctggggtatcagagttgacattgggttgccccttctctgaggcattcatgtaaatccttttaagtttataaaacctccatgtggctcctgcatgcttcatcatttgcatgtgtctctttttccaggggaggcagcatggggagcaggatgctggtgggctccaggtgcagagagcagggtgggcgtcagaccccaggtccactgtgcacgccctcttgtagagcccgttccgttgtccatgagatgaggagtgttcttatctctaaagtattatcatgaaaacctaacaatgtagaaagactaaagcacatgggtggtgcttcataaatagtatttctcccactttctgaaaactcctgctgaagtaactgcacaagaatccttgaacatttagaattctggttttagccataccataaagtcagtagtgcgtggtggaattctgctaacgaaaattgcgaaggatcaaggcagagtacagagctggtgtgtagcgggtaccttctgtctgctggcactaggtattttacacattaaatcagctcgttctcacatcagctcttttaaaaataaggaaatgaggagccacagtggcccaactgatgcagtggcagaagtagaatttgagcttgtgcagatgtgcctccgtgttttgtctcctgagcatgctgccccaagtttgacaataccaagatttgtactggaacattccctcccatccccaccccctagaagcccctcttcctcccttagatttgacacatagtttgaaaccactattaactaccttatgagagccactgtttgtgaagtgctgactatgtgccaggtcccgtgccgtgcaatttttgtgaattatctcgtgtctacagtgcctcacaatttctctgctcaatacctccatgttactgccgaggaaagggaagctcagagagagtaagtaatttgctcgagttaaagagctggccaggacagccaggggcttgcaccccggagccttcatccactacactgtcagctggtatctcaaccagccattacaggctgtaaaaaaattatataagatagtctatggtaatgcagaaaagtgaggttattttgctccctttccctttgaagaaaaaagccctggaaagacatatcacttgagtatgggaaaaaatgaagctgtggcttttctgtgagtcaattctttcctggcagcttcttggaataagaccaagtatagcagcagagttttctgttttaatttgagctgcagggtgactttttttcttctatgctttcatctctctgtggcttcttttgcctcgttaatttcatgccctgcccaggcgggctactgtgctgcccagtcacccgggtctggggcggccaccgctggccagcaggcaggccctccagaggcagaggtggccacgcttaggtcgctcccgctgtggaggcggcacacttgggtggcagcacagctgtgatgtggcggcagctggcagccccatgggaaagatgtgtgaagtgtggggtttgacgacccatgggagaacagactttcttcctcttcttgttttcccttcaaagccgtgagtcaacctcaaattctctgtcttttttctccaccccctcgtgcctctctccctcacgctctgcatctctcattgcaagcttgcatttttttgcacacaacactatcttaatatttctcttttctgcaggcaggaaatgagaagtcatttttcagggtcattcaggaagtcatccagagttataatggcccattatctactggtcagagtttacttaggctttcactacttccactgcccacttgaaacagggaaaaatattttccccccgcgctgtgagtgtgctatttagagctgaccacaagcggggggaagagaggatggctcggatgctgcatttccactgagaacacaaggctggcaaagcttgtctgctgcccagcaagcacttcaggctcacaccattttaggttcactttaagtagtttctcaattgttaaaaaaaaaacaaaaaaaaaaaaacctgtactctgaggatatgcttataatcccatagctaacccagaatttcttagagaactgatcaacatcagcagtggcacttactgaaaatgcacattctcaggccctgcgtagggcctactgagttagaatattagagagcaggtctcagaaacattctatccggcagtcttattctatgcacccgaagggataagagccatgctttcatgaaacatgggttgtgtgtaaaatgtttaaaaggtatggcaaaatgtgtttgattggcaccaaggatttctggttcctcctagaatcattaatcaaactttgaaggagaaataagagagtcggcattttcttgcacattctttgtgatgttgtgatgagttggaaacttcccgattgggtttattagagcatgaacacccaggcacccagcttctagccagccctgtcaggcagagtctcctcgaagatgtggaaaggactgaccaacagctgaggcctacaggaacctgagcaggcaaggggagaggcaccccggaaccaggagcaatggccttcccaccctccctcgtcctctcctcttctccttttggagttgcaggccacagaaaggaagtgacatgagtcactttgggccttcttaattccttcatcaaaggcagcacaggtgtgtatgtgtgttggtggctaattgaggtaggcccacagaggagataacagatggacatactatttcctttcttccattctgatataattcagggtataaacacacacacacacacacacacacattctcacttctttggcatctaccacacctgccccagtgcccatttctctcccacctgaataaaaagcccccacaaagcctgaggtacatggaaaggagcagtggtctggctcccaggagtgtgagaagcagccatgttttcagaggctgtattccacttggacttggccctacgctgaaggtaggagcggatgggggaggcccccttcgcacaaagagccccatgaaagagtgcacagtccagtctataaaacagacgcagaaaatgtgtgtaggacttcttcctgaaaaagagcgtggtgcgtccagtacctccatgttcatggaacttcccagtctgcagtttacccttttgtgcaactcccttttggtaaagccctggtcacacttctggttgttcagattatacagggataattccagagtgattttaaagtcaactgccaggcatccgcacttgcaaattagatgcctggcacatgcttgtgttaaggtaataattcattacaatacaaattacaggggagttcctctgggcatgcgacctttcccgtcatttggctttccctgtgattatcaggggagcttccatcgtgctgctaatgggaccttaaccatgtgtcaacccatggctgtaatgctgacactgttttctttctggaatgaaaggccttcgcaattgaaaccaaaatgttatccaactcagtcctgtccctttgacgatgaaaacatcaagttctggagactggccatccagcctccctgcctcatctcccacgccctccatcattttttgtctctacttacttatttatttggctgtattttacgtacatcatgcaaaaatattcctctttgtaaaaagtataatgatttcaggaaattagagggtaaaaagcaagaaccatgctttcactccactgtcaagagttgtggaagaatccttccagcattttttctgtgtattttacatacatacaaatatatgtacaaataaaggtcgatcatttaggttttgtttatatttttgtatatatgagcttatgtcattcatacatattgttttgcctcttgcttttttttaacttaattttactttgcttgagagctttttgaactgaagtacgtgtaagtcagcctatgcatgtaatggctccctcatcttctgtgaggctgtcactaaaaaggggatttagcttgttctgggctttgcagcccgtacactgggcactgttcatacgtacttctctgtgcacgcaaaggagggcttgctagggaggcctggcagagggtgccattcaaataggattttcaatggaggaatttttaaattttcagttatttgaataagttttaatatatatccagaaccccaaatcatcaagtttgttttcttccacatctgtccttccatttctgaactattttaaggccagtcatgtctcatccaagaaatcccatcctttcacacaacactatctccgtttcatggttatgaatctctaaaagcatgatttttaaaacataatcacaatgctgtcatcgaacttaaaaattagccataaatctcttatgttacccaacaaccagcctactgacacatctccagttgtctcaaaaatgtgttttccattgtggtttgtctgaaacatgatccaaaagtcagacccacctctcacctttccctaacctgccggagcccatgtttctttccagccaggcttggagaccaccacacgggatttgcttcttggggcctccctctaaccagctatgcaggatgccctctttcctgtcaatacaagctgctcaaaggactcattcagttcaaattcacctatgtgagcctaggtgatgctacttatttatttatttatttatttatttatttatttatttatttattttgagatggagtctcactctgttgcccaggctggagttcagtggcataatctgggctcactgcaagctctgcctcccgggttcaagtgattctcctgcctcagcctcctcagtagctgagattacaggcacgtgccaccacgcccagctaatttttatagttttagtagagacagggtttcaccatgttggtcaggttggtctcaaactcctgacctcgtgatccacccacctcggcttcccaaagtgcttcatgttttcaggagctgtacgtgcatttttagttttgatgaccaggtcctttttctgttttttaaagaacttcaaatgatctccagggtacacagcgcttgtgtgctgatgaaaaagctggcagtacaaaggccaccagccaaggtcacacagccaaaaagcccctgacctcgggccccttcccagaccctgggtcttttgctgccacatgaatcttcttcaaggtcctatgtgtagattttcttgacttggccatattatttaggattcagatataataacaaaatagatgttaaagcataacatgaaggcatttaaaagggtagaaagcacatgatttactaaaaccataaatcttatgacctgaaagtttcacctaatctcttaaaaaataccgtactaaaccctgattgaaaatcagagctcagacatacagcctgagatgccaaaaaatggccaggcttgtctgttgagaaagccatatgtaactaactgtttggaaattcaaaatatatcttatcattttaaaaacatctttcttctaaagacaatcatcttggcttcaggaatgaggctagtaaaaagtgaaatactcctacttgtggaagaaatcctcattttaaccatgaagaactgaaaaatgcattctgatgttgatggacccaacctatatttgggtattttatgatgtacacaatatacttttgtatatgagattgttattaaatgtgactttgctttttcaagacatacaatgttcctccgggggtcaggcactgtgtttagcactttgtcctgacctcatctgacttctcagctgtccctgagaggtaccagtgtgcaagatcgctgagttggcaagtgatagtgacaatattttcaccccaatttctaatttaaagaccccgatttctagttttgttttgtattggatttgcacaatttcacgttctgaaagaggatgccctcaactttgcaaaatgggccttttgaatgaaaaggatcagtcatgtcaggaaaagcgctacaatgatgaaatatgataaataagtcagtctttcatctgtaattatctactatggggtaaaaagtgatgaaaactaccatcttgaaaggttctggtgatagtggttcctaatgcagtgaaagatgtgtaagtcaaagatttgtaaccagccagggaatgagaggcgaagccatagctggtggcgggggccacatctgggtgtggggaggccacagttgggttgggggtggggcctgcagttatccacacccctcccacctcccttcgacagtacaggcttcctggttaccttccagagagtaaggccagggagagttgaataagttgagaaatgtcatgtcgaagctattggtggaaagagttccattaattgacaatacaagtccctactacattctaaaatctggtcctgactagtggcaagccgggcccaggagtagcacttaaacaatggcaggcttgtgttgctggcaggatacttcagcctcagaggagctgtgtgcagctggggagactcacactcagaggatttcaaagcagagggcatctcgtagagcaacttatccaaaccctgacccactgtaaacacacacacacacacacacacacacacacacacacacacacaccctgagagagagaaagagagagagataactaaagagagagaactaaagtttggcaaaataatacatgctctaatgaaggtttattaatgattaatctactcctagcatttcctagtccactctatctccttaaaaaaaaattctggttgcagcccactaacttgattgtacagctgcttaatggatagcaggctgtaattttcagagaactgtttaatgcgggctacctctgttcttccatgctgcttgtggttcctgctctgctcaggacagaatggggaggaaaacaggctctgcggcacaatattggcaagtgaaattttgtaaaccggccctcccttccttttgcatttggtctgaaaattcaattagatgctgagtcctacaatgtatttgagaagcccaggagtgccctagaggatgagactgggtggctccctgtcaggttgaacatttgccttaattactttggcaagatttgcatcagtggtattagtccctgcctcacttggaggcctgcacttaagtggccacattcaggctccaatttcctggtgatttcatagtgtagggcacttgcaatcaaaactaggcttaaagcccaaccctcttacattttacccacccccacaaatgcagcaaataaaatgactctgattttcattccctagacctcttttctatatttattacattattgttaagacagtttttgaagaaagctgttttatttaacaaaatagctttatggaatcaacttcatatatcttctccgccagatcaaaacaagctcgtagtattagatgtcaccgagcaccatgacaggcagatgaacatcatccctgtgcccggctaatgatagctcggcctgccccggcgtcagccgctcctggcagggccagcgggcggtgtgggaccggcaccgtatctccagcaattcgcagataacaaatatggttctgatgatgttactaaagatctgtccctttcaagattggattagacattaggaatttggagggctttttattgctagcatttttaagaataaccaattagagtattgattctaaagtctgaaagccacatggacagagttcatgtaattggctactttatgtgcctcttcctagattgccctgcattttcaaaacaagagcctttctattttaatcaaaagaatccagaatgaaatgaggctttgaaaactcagcctatgtttgtcttgatttccttaactgacatctagaagaaaatatgagctcaggggtccgctgggttccttccagcgcctaagcctgtaagctcttcctgctggaaccaagctttaaatgcacttgtcagtcatgtcccatgagaatagatactgccttccatgtttttttgttctgatttccgtgtttgaaatgatgaaaatcatttttctgtgctttttaaaaatggaattgcttttgtgttgggaattgtgctgttcatttttactctacctcgttttggaatcactaatgtggccaatttatagccaaaaatcagtatcgtagagtgagcaatgaatggcatggtgactgtgtgagcgaattcatgccctccctccccaccgctcgccccgcgtctcagtcctcagtgatggtaaacagaatgaggaccttctcccgaccgtgatgcgcctcagccctacttcccttgtcctttcctatcataaaatcttctttcatagaaatggtcatttctgttcatatctgtggactgtaaataacaaggaagtcatttttgaggtgaaaactgcacttagactcattccaattttgatggaaacttttagctggtggatggcattttgttttgtcttagttttgcaaggagttatcttaatttagggagatgaaactagtctgtgatccgaggtctcacttccatacatttctctcgggcagtgtggctgcctgaatcatgcctggatgccacaggtgcttagccagctggtcctgtcgtaactgtcactggtagctcagggagtgcagaggtgccagcagacactatgaaattggcctcgtaaagcatcagttatgttgtgatggtggcaaagctgcaggcgagatgggaagtgcagccactgagaactcacagtagagcgtgtgtaacgtaaaaagatgaaacccattgtacacagctgtgtactgcctccttgaagtcaaatttcccccattaccaaggaaaagttttttctgaagggggctgcttgacaggatgacatctggtgatatcatttattcctttggaaatcaatctgtggaagtgagtttccactgactgatgaggagaaaaatgaattggcttcacccagcatccagcttcttatcctgggagagatagctcttggtctgtcatccacgcagctgcctggtgcaagagccaagtttgtgcagcctgcagagcactcttcctgagctgtgggctgccaggtcggggggcagggggggcctcactgtgcagcctcctgccacccactgatcatctggggagactggcctatcctgtcaggagacgcagttgcccagacgttttcaagggcctaagatgtaggcagttgatccacagatttttggagagtccttgagttggagattacaggtgacctcagaggagggagtgagaacatctgggtcatgggtttctactaggagtccacagtgaaaacaagaagaggaatttacgacaagacagtccagcaacttcctttctaacttctcctttcacatatgctggatactccaagactttgcatttacatggacatcacagatccactttgagagaagtagggtaaaaagaaataaatacatagtgctttaggtgtatttctatacatcttaattgatatgggattacattttcacttgtgtttactgtacagactctagacagatcctgctcttttgcaggtaaaacaaatatttcttaaaacctagaaagacccaaaacaatttaacagaaacattttggaccattttggaccttggcagttaggccccagtgcagcagcggcaaccataaacctctccataggtgctgaacccaggtgatccctggcaccggcagccttatgtcagggctctcttatcgctggtttttatttctcctaataaaagtgattaaaagattcatcttttaaagaaagcaaggacacagaggtggattctccctgacgctagcacagctcatgcccaagccactcctgcagggctctggtctaagtgcaaaagctggaaaagctgcaggtcccgcaagacacagagcaaccctgcaagccaggtcaccttccctcttctctgctgtccgactggccctccaccatgtgacattcaaaagctcaagttacttaacctctcaaaactcagcatccttttctgtacagtggggaagatactggactgttgtgaggattaagtgaggagagtggcccaatgaggttgacagttattactgtcattgtcattatttgccttctcacaggcaggcgtgccacagtcattttactgaagctgcttcagtgggtcctgaattaggccctgtcctttgggagagacagtcctggttcaacacacagctccctgcccagggcagcttgggagtgtgggccagtttcgcctttagaaccacaattctctgatatgtgcaatgagagaattaattatagactcaaaggattgcatgcagacacacacagatacaaacacatacacacaacacacagagttacacacagacatgctcacaatacacagaaatacacacagacacacgcacacagcacacagagatacacacagacacacacacacacacacacagacatacgcacagatgggcacacacagagacacactcacagagacacacagatacacacaggcacacacacagagagacatacacacagcccacagggatacacacagacacacagagacatacctacaacacacagagatacacacagtcacacacagagagacatacatacaatacacagagatacacacagagacacagatacagacacagacagacatacacacagacacgggcacacacagagacacacagacacacacaggcacacacgtgcagataaggtaatattagctagttcaggaggagaaagagataaagataaagtaatattagctagttcaggaggagtgaaagaagccttgtttttctccactttttatagaagagaaagtgaagattcgatttgaggtgagttcagcacaaaagcgtatcccaggccctctggctccaactgcagccctttctacctcattcccagaccccacctaagccttttctcttcaaaatcttctcaggcacactgatacacatacctcagatttttaattctccggttgtgttcaccaggtgcttggtcatgattaagaattccgtgatgtgtaccccatgtgtttaaatttgctgctgagttaactttgtggcggcctgtggactagacctctgcacatgcaatgcagaacggcagggccagatttgaaatcctgctatcttttcggctgccttgtaaaaataacatcaggcgatggggatacgatgccagaggtcacctgtgataagttctgtttatggccattttacttctaggaagacaggaagtgtcaggatctcagggatctaggaagccaaaatgtttttccactctgaaataaagtgactgaccaggagttcccggccacgcagccctgtgggaactgccgcacggccacttttatgaagtggacacgtgttggtcccactgaaaagaaactccccacccatggctccctcacgctgcagcagaggccctgccacagcacctgtcagcccctgccagcttgcaggggcgcaggcgcagagcggtttgtgcccttgctggagccagggaagggcacagggtccctcctggagtcatgggaggtgcagccgaggttctatattaaaatacagaggctagcacatgtgcttggggaatgcagctacagtagtggaatgaaagtgctgtccgttccttacccccccagctcctcacctgtcctccacacgcatatccctggctccctttccctagtaaggagactgaattgaaattgtggcttgcccgaggctgcatacctgtgctctttctgaagcccaagtcactggctctagaattctaacctgtgaggaagccactgaggatgtttgtcaaaatacatatttctgtgccttgccccagttccacggcccaggaatctgcagttttcacaagcacccccaggtgattctggtggtgtctttgcacttcttcaaggcagtactgcctggaacgcagaatcccagcctcctctatcctccttgcctaatggcctggatgctctcagatctacaggggaagggaaggtcacacagtcatcgcaatagtaacctcagctgataaatcctcccccataaaacttattccccagtgttttttaataggaaacaataaaactgtaaccagcccaaatatccatcaaagagaaaatggagaagtaaatcatcgcacattcacctggaccagatctattgtaaagccaataatactgaagccccttccaaggccctgggagtcctaacagtgcactggcagtgtctataatttatattatgaaatttgcataaggaaaacattttgtctcatttgtgcaatttctccttctaaatatacgtgtcactttgtacctgatttctataagacccaggacctacaaaccctgtgtctgcccctgcagccacccagggaaggactgcacagcagcaagacagattgccatggagcatgttgtgcccaactagggacagcgcagatagattctgtaatttgcctaacaatgtctataggatgatcccatttgtcaaaaaaaaaaaagaactgggctttattgatgtcacctaaatgcacctaaacttcttttttgccccatgctcttctgtactcttgatctttccccaaatttttaaaaacatgacactcattcccttatttttcctacttagaaaagtgtagatggttttatcataggaagttcaaaaaaattaaaatataatgaaaaatactcaaatagtgcctcacaacagtaactactgctaacataaataaaatccatatttcctctcatacagaccccagagttgctttgcctgacagtgtagttgatggagaaaataatctttatccttagcctccatctggttgcagaccataaagacagggaaaaaatgagggtgttggtagcttcgttagaaactgaaagctcactgattttttcaaaacctaaatagcctgtgtttctccaaataactaatttgcagccttcggcagccaggactggcagggatggggctagggggactggggagaactgctctctcctgagggtggtctgacccgacagcacgcatgaccttcccacagtcaggaactgctcagagacgtgatggcaactccatagaatgaaatactcttcagccagtaaaatgtatttttggataaatatttgctttaaaaaactttactatatgttgttaaatgaaaaaaaaaccttaaggcatcagaaattatgtgcagtaaaatctcacttttgtaaataaatatacctgtttactacgtatgcataaaaagaatcctgagaaatataagtactgtatgcatattgttgttaagtattttttctgtttgcttatctataattctaattttgcttcaaagaacaagttactccggcaatataaaaataaaataactaatttgtcttgtcatcaaacagatagtaagaacaggcaaacctggccctccacactgccagccttttgtgattcaaggcttcagtttcctccacttgttaaaaagattcaacaaagtagttgaaatagtatgtgaaccagtaaaccctaaaaggtgtccagtgttgtctgtgagctaattaagtgatttgattctgactccccgagtcttctgatttcgaagcagtggggagtcagacaggagcctcaggtggcctctcctgagaggccctggaaagtgatgagaacctggcctctggcagctcttcataaacgtccatgttttccctctactctctcactcttttcccagggcctcaaacagaagatgaaaatcaatttctaaaacagccctctgtgtgctctctcgtatctctccttttcacacatcgtggtggtggctttctctgtgttcctctgttgattcagtctctggaattaacggatcaggattccatgcccagaatgctacaaagactgtgcttgagttctcccacatctcactcaattacacagaagtttcagattatgtaacagatgctgtgctgggttaggcagagccatctgacttgttttgctttattttagaccatgagatgggtgagtttttctttttaatgccacattcttttaagaattaaaaacctccacttggctgtcagcattggaaatcagagtgatggtgcaagccctgatgaggacaatgtccttgtctatgaaaaggtgaaatcattgcttgaaatcgctaagcaggacatgcagtcccagatggaggggggaattcgggagctggttggaaaagagtatttggcactttgcagccttgagaggtgcagaagagacaccgaggggttcaccaccagagccaccattgtcagagaggcgtccagctgtgtccacctgggactctgccttcagggcttcttgcctggctgggagctgcacaggcagactcctgggacggtgtgccgacagctctgggcacccccttctaggatctgattcctgaggaatcacaatgtggatttcacaatcacttccagtgtcttttgccaacctctgtgaacagatgtgcaattaaaaaaaaaaaaagaaaggggcccaattctcaacactgtaagtggaaactttttaatggaaaaggataggctaatgaattgaatttgaaatctgagacagaaccgatgcatcaaatgtgctggtgtttacagataatacaaggggggctgcatcttatggtttcaatccttttttaaatttttgttctgagagacccagccagcagactgccgccagtcttgtcagagatgtcagtggtggccactctgaatggaaagcagcatctctcagcatctctgaggcactgctcctcagcggagactgtggtggctttgcctttcagcacgcatcctttctacgatgcctgacagtgcccagggaatgggcagagctgggagctctgaagccctttcacctaaaccaccctgggtcacctgacctagttttcctcccaattttaattatgtcaggcacttcacaaaggcctccttggggacaccatgagctcactgtcatcagattgctccaatcacagctgtggcttgcacacaaccgccatctctgccccagcagatgctgtgtgtaaacagttgtattaattacatctcaaaaacatggttcttgccagatcctcaggatttgggtgcagcctctgaggtgggtgggaggccctcgagggagaaatgtctgcaggaaattcttcccctacgagaggtctgttttctaagttatctaagagctactgcagctgtttactgcagagtgaccctgctcaaagctgtggtcacccaaggctttgaaaggggacctccacttccgccctgggtggagcaccgtgctggagacccacgcctgccaaggcctcattgtcatctccacacgccgtccttggggtgggccactcctgggacacgcagacaggaagccggccacctgagccactcggaggctctatccagagtcagctgccaagcctcacgtcacacatcactgttagtcttggagggctggcggggccctgaagtcaattgaacacttggatgacagggaacttgccactgccagaggcaatatgctccatttttttgacagttccaacaatttttctttaaactgtcataaaaaattgctgctgtgaataccagtgtcggcgtccctgcctcacctttacctggtgcttttccaccacacaaaactgtttctcctcgtgctggccttgggcttgcagacagctgattcttctcctcccgcggctgagcagcctcctccgagcaaccctctgacaactctgctccttctgacaacctctgcaagggctgccagatgtgaacaaggggcccgggcagaaggtatccaggaagactggaaactcgaggaagcctgccctgtcctgtccaccagactttacgcttgcgtcactgggctttgggacctaagtcctcgtcatttgttccttttgcagttcctactgttctcagcacttccttccagcttactgaggtacactcagatgtgatatgccatcggtacagacacagttctgctccagcatttccccgtgttctttctgtcgctctatttactgaattaccgtgaggatgtggagcgaggctgagttctgtattttaacaccattttaattctcacctactgagaaatccatcctcttatcactgtgctttttttaacctgtcacgaatccatgaaatcctatcagccagcctgcatacttccttttaaggtgcagttgaatcaggagaaacttgccgcacatgctgcgtccgggcacagcattggctgaggctgctgccctgacctgtccgctttgtagtactgcccagctatgaaacaggttagccacacatgacctgcatttaggagtaacaagtctgtctgtacatgcacatacagcaacttttttaaactgtctatattttttcctgagataggtatttataatatctccatcttctttcccattttgaaacttagaacaagtttgcctgtcaacagttctccacagcatactgtgtattctaggattttctaaggttgagcaacggaggttcagcaattttgacttaatttcttcccatcccttttccacgcagcccagaagccttggatcacgtggtgaggggaagaggttgtgctatgtcgggaaactctgtatcgaagctcggctcagatcatgacattctcttgactaaaaccctcagtttccatcaaacttgtcactctggcattaaagcctgtcactgtgtggctctgaaaacctctctgaacgtgttccctgcctctgccctgcaggtccctgtgctccacagaagcccacttatgtgacccacccccactcatcaccaccttccctcacccagagcctcagctccccactcccacctgtaagacccctactggaaagattcccacctgcccctcaagattaatctccaaggacatttccaaattcctctccccatctctcagccagatggctttgctccctccaggaaccccagccaccttcgacctccagcagggcactccactccacattctcctggtctgtctggctcatcttacctgagccatgctctccaggtgaaggactatgtctaactcaactctgctttaaaagcagctaacacattgctctttgcatattgttcactcactaagttgaactggacttggacatgcacactgaactgcagcgtctgctgcttcttggtggcccagctcgtcaaaagaataagatttcagcaaaacaatgtaacaattttttttaccaaaagtaatgttaacaatatatggttttcccctgatgtttgcgtcaaaatgctttttggaaaaaacatttttcaactctttagggtcagaattaagcaatgaaatttatataccacatgtataatgtgtatgtttatctaagtatctgttcatttatatatcttaaatagaaattttaaaaatttttttaaaactcctgataaacattctcaggaggcacactatgtaactgttggttgatatacctagctagatggtgaaatcagattttgtttaaagcatggaggagagggaaaaattaaatcttgcagattctgcagtccttaacatctttgaaagaggaacatttcagacaatgtaataagaaggccacgtgctttgacttctgtagattttaaaaatacttctgtatagtttcttcttcctttgaagaagtttggggagtttgggaagatggagaaagatataagaatagactccccatatgggtcatgaattatctttttgcatcagaactcttagtgcagtttcagtattttcttcctcaggagggtgagctgcttccgaatgtcctccccttctttgaggcatcctctgttggtgaactttgagagcatccatttatgaagttgatgacctttcccagtctctgcaagcccttcagtgtgtgtcctctctgagcaaatctgaattgtgtgcttaatacatggaaagggatttgggagggttgctttttaaactgatttcttaattaatattatggtttagttaactagacagtctcattgcagaagtgcataaccataatatgtcttcaaatatatctcccttcctaacaccctgtaatatacttttgtaaagatacccttacagaatgtgatccaccatttatgaacctgcagcattgcattcagagactaagtgaaaagctggcagattttcatttaaagcacaagctaaggaagaaagctggtctagaaggagctacagaagggtaatgcttagggagggaatgatgtgcctgtgggtggtggtagttaaatctaaccaaagaatgatgtcgtgggtgtttggatattggatggtccacattgggccacattctttcaaacataagagtctgtagaaatatgacctgtaaaagactcttaaatattctggaaactgtttcttccttgtcacatccttatatatacttgaacctatgcctaccagacatgacatgtgactattcatacagatttcatcatctctggtttaagaataaaggatgctgcatagaaggctcacatcttttaattcacaagactgaaactgttctgaaatgacattgtttctaaaaattcattacttgcattatattcatttttatttttccatgccagaagggtagaagttcctgtgctcatattaagaaacagcaatgtcaatcgaggcccaactcaaatccaatttataggagttataaagggcgtgtgcctgttttgtctagaagcagtgttgggcagcactgagtaggatagaccacctgttgctaccgataaaggagcagcttctcgaatgctcctgtctggtaggcactatcccgagtgctttggcccctcatccacaatctgtgtggcaaaaggcattgcaggcaattcagtgaggagaccgaggcatggagagcaagtgccatggaattccctaaggccgtgcagggagcaggttgccaagctgggttgaaaccgtcctccgtaggctcccaactccgccgtcgctgctactgtgctggatgatgcctggtagatgcagatgtggagccccatggattctgagacaggccgggtttcagtcctgccctagctgcctattggctggatgaccttggcaagttgactttcgtgagcctcatttgtctcatctctcaattaagaaaacctagagcctatctgtgggggttatctgaaggattccagggatgcatatggcactgtctaccgcatgcggtaactgtttcacaaatgatgaggagcgatttatgttcttagtggaaatatgtcggcgtgtgaagtcccaaagctctgccctgcctggcttgatccagtgcctaggcactgcccctcttcccctctctcccaacccactgtaagaggctaggctgcctcagtaactctgaggggcattgactcttttcatccaaaaattcatgttactgccccacattttttctgttgttttacaacgcagtaggaagtgggcagactgtcaggaaaagtgatttatagtcatgtattgcttgtgctttggcttcatttgatccaatgcagatcagctgcactcagaaaactactcaagtgaaagagaaaaagtaactgaagggggaaatctggatgagtaagaattccagggataggaatattaatagcaagctttttgcctgatatagtcactttatgctgcaggggtgcccctttataaagtgcttgtacaatggatgtttgcttttgattttggatttggagtctaatgaatgttctaaattattattagaggagcttgcggttgttacatgtctgcctttattgcttatttttagccatctcccctgatgtcaaatgctcaggcaagaatgatacattcatttataatgtggctccttcagaaatataccacataccttttggtgtggtttgtggctgagaagagtggggaatgcacaagtggaaaactgcagaaagattatgccttcatcacttcaagtatttgagatgaaactagatcatttgctgttgctttttattctcattctaagtgcttttcaaagtcagcgctaagattttaaaatggttttctgttgttggcagagagggaattactctattactttctgataaaacagagtctttcatgatcaaagagaaccaggctctagtagttccagtatcctaacgtggacactaattgtttccctccttttcttcatgaaaacagcttctgcacaaatgatagccttgtgaactagccatgggcacaactggagaagcatttagggagctttagtgcaaattgagaccacctacacatctgactctacagggtttgacaacatccagggtgaatcacaaaacatcagtctaatcagggcttatatagaaagagtgaaagaactctgatttcatcctaaagattatttatattaaccattgttccaaatgcattaactattttaatttagttgttttgattgttaaaaaaaacacatctgtttggtagataagacataatttaagacaaatgttctatttgataagcttttagaaacaacttatttttattctttcctgtgagataactcagatgtggagaatgtgacaaaattttaagcataacatgagaagggctgacacacatagatttctgtgtgcttacttgaaaacaacaaaatttaagaatttggtataggagttgtatcaggtagtgcagagtccccaggagacctagagacccaggtctgggagcctagcggcaagggctgaatgtgggatgacatcagcagaaactcacagccactgctattccaaaaacccagcagcagctcagtgcagggcagtgctgatagtacagtgcctgcaatcctggagtggatttggatgtgtcaggtacgcacacgctcactgctcccccagcagtacgttgaacagtgtgcgtccaggtgtctgtagggcccctcgccctaactcacaaaaccattctgggtcagaagccaccaatattgtcatcatcctcccttttctgagaaccctagtaagtccctccagtggggcaagcccaccttttcccttcattctgtggcaatatgccttcatttcctaatcagttttgccctgctcattcaatgcaaaatggatctgctttccttgggcaccaatatgtccagggattgtttatcaatcttcagttctgtttcctttacatatccctccaaaaatcaggcctgcactgcctgtgcactccacaatccacaggcctgaaggaaatgttatctttgatgtagagacttaaagtaaaactcttcaaattaattatttcatgcaaaaggctagtcctgactctaattctaagacatgtctcctaaactctggaagtctgatgtatcctattatcaacatttatccttaatgtgatggtttatcatttatcctcaaagctgcattgtaaaatgtacactgtaaagtgtacattttaaagtcggttttaaaaaatcatatttagagatcctggtaaaaatctatcaagtcaagacattaccttattacccatggaattgtcttcaactcttacagttcaaatattcctgaattggctttcacaataaacatcctaaatatgtaagtagaaacatatatattgccaactttgtgccttcccaagcaaaattaaaatacaggaaaagtcagtttgttttgcccataaataaatatatgtgtgtgtgtatgtgtgtgtatacacatacacactcagaaaagatagaagcagcagcatattttggcagcatctggtttattggaactcaaacgttctgattgtgcatacagactagttaatgtggtaacaattatgtatttcttccctgctccttgccttctttccctccccagtttttttcttcctgatagtaggtgtgtacttttttcctatttccattggcaagccacatgacaagcaaaacgatcactcgaagaatattgttccctcaatcaagaaaaatgcccattgggttttgttatttgatgttatttgatgacagagacctattgtttttccatttttctttttttgttttccgtggcacctatggaattaagcaatataaaaaatctattatttcagatgttcacgtctaatgaatttcatgtgaaatactggcagtataaccccaaatagaggaaatttgtgaagagtggatgctgcagggcatgagacatctgcacagagttcatctcttccagcatcttgcatgtcccaagcactgccctgccaggcagagaatgctgcagatcacggcagtgaattccagttgttcagagcacatttgacttccaaattctcaaggccacagatttgaggacagaacaatatttgcatttgaaattggaagattattttttgcacaagtgcctatatgctatatagagtttgcccactctgcattatcttccccctgttcccccgttatctggcacaagctattcaaaagacacgcctacttgtaaaataaatggtttgcaaactaaggaaaatacttaaatctcatgtaaatggtactatactatgtataaaaatgtgaagaaacacagaacagctcatgaacacctccactgctgtataaaagaaccatcttttttctggctcctattggatgccttagaaaaatctgtatttcctctttagttattgtgtttgaaagatgaagttgagacaaaagttctattctttttaagttggcagaacttctgaaaggtgatttttagctgcagtgtgactcattccaaatgcagaaatctctgaccctgagttagtctatttgtcatgcaagagcctagaaaagccctgagtgataagaaatggccataggccattcccacagaattttcaacaaaaatagaatcatgcttatgttctagtcatgacttagaacttataactcatgttcggaactgtccatgttcacgcacaggggccgtatcactccgccagagctgccctgggtgccggtgtgcagaggggtccgagagtgactgtctcttcctctgttgtcgaatgtgtgggttatctccataaatggctgccatgagcatccttgttcacacatttttaggtacttgagtgagtgtctgtggaataattttgggaagtgaaatctgtggtcagaggtttgtgagttttacatgctacattttcagaagttgagaaatagcagtaggctgaaggcaagtcgccatgcctggaattcatgaacactagttgaaagaactggcgtgagttagtcatgacaggagagatggggaagggagttgcaggtaggagggccatcttcaaattctcaaagtatagtcactccaaaccaaaattcgatttaatctgtaggactccattctcaaagcacagtcactccaaaccgaaattcgatttaatctgtaggactccaggtggcagaataagaggcaatggatgggtggaagcgaaacagggccaaagtttgacttcatgtgcaacttcctaaggagtgatttgaactccacaaacatgaactaagcacctcaacacaggctgggcaagttgctgttcttttggagcttacatcttagtggggaaagagaaatgcctatgtaaacatataaatcagcaggatacattgtgaggacggtcattgctcagtgagactgcaatagagtgatacgctggagggggctgcaagggagaaggtgggagggacagcatttagcagaatgagcagcacagtcccataggaagaagaatttattgcctccttaggcaaataaattcccaaaccttgaacatcagaaaggaaatagattaatgtgcacagaggattaaattatgtgatctgcaaagtcatttaaaatctatttccacataaaacatattaatgcaacctaaacaaaaggggtctggataccctcatcttcttcccaagcatcaagtctttctatagttaaactgagatgcttttattcttggaaaattttaaggactatctacagcaatggaagaatcgggtgttgggatgtgttcccaggtaataatgactgcaggctgatttggcccttgaggtgtggcctcatggccctctccaaaaaaaatcaaggacctgctacaaagcacaaagccgactgcaatgcttgctgcttactggttagggcagctcctctttgccagcgaccaagcagaaagcaagacaagacaggttctgaagcagtaattcaaagccttcctcgctttcccatgtgagtcattgctagtcagaatattacctttgcagagaggcttaattccaaatttgctcttaaagggatatcctctcctggtttaggtataaacttttgactcacaggacaaattctatcattcctttgggcctaggattgcatttatttccatgacaaaagggcctgtctggtgtttcagcaaatgaaaacaaaaatataaagcccatctccttttgaatgagctctaaaacagttctccactggacttcagaacaagagggagctctgggctgctggctggttgtgcatttgctgtgggttccctccggcaggcgacctctccgcgctgagaaggttatccggataaccaagtaagaaagtacatgaggaggcacagaaagaaaaatgtgagagataacagcataaacacacagtgtatgttgttatgaggcatcacatgatgagatactgctggggagggaagaagtgaggagattcctaggaatcttatgagaatttccagagacaacaagttttgagcttttttttaatttagaaaatttaccttatttttaaaagaatatgtaacatatcccatgctataaaattctagacatagtagatttaaaacagcataatggaaaatataaatatctattttcttttcctatttatgtattctgtgccagtaggaatgtagccaaaaagagagaaaaggggtctctgcagacatggatgtctctgtgacttgatcactgctaacccaagaagataataaagcagaagcatgtatccaggttgctgcagccaagcctgcccggtctgcggggcgtcctcacacatggggcagctctcccaccccacacactgggaaaggcggacagaggctgggcaaagcccccaattttcgttggcactgaccccgatgatttataggcctttgtttcccatgttaaatgtcttacgatcattaaattatttatagctcaattagcatgtgtccaaaaccaggaagttcataggagactgtgtgactgggaattaaggagcaaagcaactttccagtctgtgatttactgggtttccattctgtttcctgttcggatccggaagtagaatttcaaatattgcttttcatgctttatttgggaccgattttagccccgctctcctttctcttgccattcgctggccattagccaccagcctctgcacaatgaccagctggcccctggcagatcttgggcccaggtgtgaagtcgctggagaagcatttcagggccaagatgggagtgatttcattttccattgacactatgcagaaatgaaggggattcaagtgccttcagaaaagcttccttccagcgaatggagttttgggggttttccagacttgcaactgcttttattcttggaagcatcattgttgctttttccccccttccatttatatcccaggaactgattcagaaaccatagaaattggatttggaatcgctgaatgctagcagacagctgactgcactcttcccaagaaaccctgccagctgggttcgggtatcgcgcggtgtgtgctctctctgcctggcccgctgagtcctctaactctaatggattccttcttacaccaaagtgcactagaactaaagtgttttgcttcattctttagacattttgtggtttagggctcaatcagccagggtatgatttgcaatccacagtaaccggtttcagagcagctgcccagcgaggcaggtttcatctcgcttgctagacgttttgtttttttttttttctaaacctcacaccttttatttattagacttggattccagtttcctgagcctgtttgtgccactgattagacaggcttgaagcagaacccaccaggcttcctgaataaaatgcagcagtgattgtattagggggttttaaattgctcaaaatactgtctaaaaaacactaaaaatcatgttactttctagattgaataaaatcctatagaaatgaattcctggacttgatatgtagcaagctggcattggctcgggagtgagtgggctcagttaagtgagctaagatgagatggtgcacaggcgagcacccacctgaggagtgtttggatgttatgatagccagctcctctgtaaagacctgtccttctatgtcagcagcccagcagataaatgacgtgtaaataccacatttaggagggcttatgatgatgccaattaatggagacctttttgaaacaggaaggaggtgaaacatattcctttgcttctacatcactgtgtgccaggcactgtttacagcatctcgtttaaccagcagtcaccacctgacggatggctgatgtggggtggggtcccagggtgggattgcgtgatgggcttggggtctctggctgatgggtgccagagctgggactggaactcctggcgtgactgaggcagacacctgggctacccagcctcacccacgacgccctcactaagtgacccacaggactcaccggaagcagggcagcaaggtccccctacagaggtccccactgcaaaccgatacccagcttagacagcagttctgcagtcggcgtctcaccccttcgggtctcattgtgactcactttgatagccacacgatttaagggtggttcagtagtgatttgatgagtgctgtggctcagggtcattcccctgcccaagcatttcaaattccagaagttcatgccctgcatggtgggtgaaaagtctcaggccaaccatgagcacacagcagccaggcgactgaggcagctgcccggggtggcacgttgctcaaacccatcatttggagtcaaaacaaacagatgattagctggggtggtcactttcaatcaagagttttcacatcgcctagacatggcctcagaatcaggcctggtgtggccaggggctgatctcacagtagacaggaagtgtggcccgagggccatggctgccccctcagaaggccctgtggagtggctggccgagcctcagcagcctcctgtgaagcgaggaagggtcttcctgccggcctctggagatcagtatgggaatgcacaagtaggaaacgctggatgggaatccctctgccctgtgataccaaggcagtgagtttgtagactatggaattgctgtcggagggctctgtaaccggccaaggtcacacaggtagccattggtagagcagggactggaatcccagacccccaacttccaggactgtgcacctttctttatcccatacagccttacagtcaagtgccagtgcaacacctgattcccaggttccagcctttgtcttttataatgggaatcaaccttatcttgacgatccagagatagtcatcaaggaagattaaattatccccttagactcagagtgaccatatcattttccctccacacaaggacacttttgagaatgaaaaggaggagatgtctgtaccagacgctggatgacaggcaccgacaggctgtctgccaggggagcagcgattcctgtatgttgtagaaagtttttcaaaagtcaccttggaaagaggttttgttccttaaccttctgttaaataggaagctccgtgaatgaaaacaactcccttccctaaacattctagtaatgacccaacactgccaagcctgccagctctgcctcatggtcgtgttgactgtgtgagactatgtgagtgcctgctacacagtacgctttcagtaaacatggtattgcctcgataatcccacaaaaatgtcctattcaaatcacctggcacccaggaaatttccttcttttttttcccaggtgaaatatacagttgaaaacacctgacagcaattcccctctcccatgtgtttgcaggatggtggttttggttcctccatctttgatgtgtacaagtgtgatgttttccccccacagacaagtaaaccacattctcttcacattcccaatgttttgtcaatgtacctccttcaatagaggatcgataaggaaaaaaatcattgacaatctcaattagattcactatttcatccaaaagcatagcttagaactctagtttttgttcaacactcttgccctatgagtgcacagaactttaattctgatacaaacatccctgaatgtttagctttgacagagattccaaggtgatttgataagaagcagggctgtgtttgggctctgggagtttttgatatggtttcaagccccatccaaaacccacagacctctagaaagtaggtgcctgccttcctgcagcagccctggagcctgctgggggctttgagcagctgctgccaagccaggcctcacccgacactctgatgggcacggccatggtggcaggggcttggacgctgccaggtgactctaacttgtggccagggtgggaagcactgctccacagaggtgccaaaaccaggttccttcctgtgttctcacatttcacagcctcaatgtaaaaagtaagacatgggcactctggaatattacaaaaatatagaaaagcatgttatagtaaataaaaggctcacagaattttgtcatttaggaacaatgattattaatatattagtgtgtgtttttgctcattaacagtatatcctgagatatttcctataccatttaatattttaaaagatgtttacactggccacagtagctcatacctataatcccaacactttagagggcaaggcaggaggatcacttgaggcttaaaaattagccaggtgtagtggcacatgcctgtagtcccagctactcaggaagctgaggctggaggatcacttgagcccaggagttcaaggctgcagtgagctataattgcaccattgcactccagcctaggtgacacagtgagaccctgtttctaaaataaataataaataaattaaaacatttaaaaatacatgatgtttaattattagaggactcaattttatatctatgtatacaataatttttaagtttcttaatattggacttttagtacctttttaaaaatactatttttaaaaaaatctgtatttctaactttttataacaaggaacctttggctttgagatgactggggaatccattctttcctatagtatccatgtccaatggacttaaagtattaatcaatgtgtttatgttttgttatttttctggcattacaaaaaattctaaatatattgttaccgcctgtataaatatcagcttttgagagaaggacattgtgtagaaataatgaaacactgcaacttgtatttgtattattcttttttttttttttttttttgagatggagtctcgccctgtcacccaggctggagtgcaatggtgcgatctctgctcactgcaagctccgcctcccaggttcacaccattctcctgcctcagcctcctgagtagctgggactacaggtgcccgccaccgcgccgggctaattttttgtatttttagtagagacggggtttcaccatggtctcgatctcctgacctcatgatctgcccgcctcagcctcccaatgcactgggattacaggcattatattattctttaaattcacatgagaatttagtatggcttcaaaaaataccataagttaaaatatcaccaagactctgttcagacaaaagtatcagaaaagtgagccaggcactcacatagtttatagtttataaaagtgagacaggcatgatctcttaacctcactatagtcctgtgaataaggtttatttacatttcattttacctgccaggattattgtaaaaacgccaagcacattgcctacacaaactaaatattcagtcaatggctgctattttcatgagttcgttttaacatatatttattgtcctctactggatttaagaagttatatttattatcatctaagattttagctattccttctcttaaaaatagattttataatcaatggcagtaagggagagtaactcgcagttctctgaatctcaaggggttcctggaagccttcctgaaggtatagtgaaatttcagcttcacattcccatccatgagctccctgcaaatatcccggtctgctctcaggacccagtgacttacctatgcagaggctgtagatagcacctggagcttcctgtgtgccctcctcaaactcagccaatgccgtcatacagtagcaggcaggtgtctttgctgggtagttggactggatgtccctgggattgcagaactggaatggggagtgacatcaggaaactataatcatcaggacaacatggtttgccataactttaagttttaagcgaccgcagattatgcggagagagatgcatgcccacagccatgcttcccatgtaactggagaggggtctgaagtttgaaacaagtgttcctaggcacgggttacagtgtttgttatcatcatacttgatttagaatggggcacaacatgtggattcatggtaactgttacaaccttactcattttaatacctgaaaacatgctttccccatgctgggaatcgaaagattctcctaggaaaagaaaggcttgacaacatcgattcaaaaagggcatgcattttcctcatttaaataactctaatgtgcaagtagatcccctgacctcaagctcagaagagtccaggccttcacaccttctctgcttctgctctggggccagctattgagattcctgtgcccacgcaatgcgcacatcccacccctggccgctgtccacaagaaatccagttgcaccaagcaccccactttttgcacctctcatttatgtactcctaagagcctcaccacaactcccttctaaaaacatgagttcctgactgggaattcgatgctgcccaggcagctttgctcagagggagcagccttctagaaatgtttcaagtaaactttcaagtataactaaattcaaaaaaaacacatacacacacacacacacacacaagtcaaaggtgtgtaatttggccaatatcacaaaccaattagccctttgtaagtggcacccagatcaggacagctgaccataccagcaccctagaagcaccccgtgctgcctcctgggacagggctaccaccatcctaaggccagcacgatgggccagctttgcctgctgttgaattttgcttacatagaatcctccagtaggtactcctttgggtcaggttctttcactcaacattatgtgttgatatttttccatgctgtgctgcaaaattgtatttcttgcattccataactgggcagttccatcataggagaataccacactgcgttcgtccattctaccgccaatggacatatgggttctttctcttttcttgcagttacaagtttatgaatattgtcccacgtgtccctggtgaacttttgtttgcatttctgttgggtacctcagagtggcgttgctgggtcagagggtactggtcgctttagtagctttgaaagatattgccaaaacattttccagcgcagttatagcaaattatacaccaccagcagtagaaaacatctcctaattgctcacagtaaacccccaaagattgccacatacatcttccatatcaattacttaactattcagcaaatttgaagggaaatatatttaatctttttattcaaatagtttataaagtggaatagagatgtgggtaaaagttgtcttgccacctttttagatcggtaaaagtttgttgaatgcaggcaagaaaagatgagaaataatggtacccaatgaaagacatagcagtctacaaggaggggcatttcccggggtgggggggacccacactctgtaactcccacattcaattagcatgttataggtaagctgcagaaaacgaggcagcttgtcaaagaggaacggctcttggccatggttgctgccctaggaggatatttgatactagcagagctggggcaaccctggaggaaaccacctggaatgatgggagaactcctccagggaacatggccctttaatagatctctgttataaaaaataatcccaaagcagccaccagggcatactgctgcgatcaagtcctaggcggtattcccttctgcgccatagaccctgtgcagagtgccctcaacgaaggagcaaggaagaccaagtctcccgagggtttgcatatgtgtatgtgattctgcagtcatggtgaatgacacagtcagggctgcggaaaagcattggtaaagtgtatatttgaggcttcagaagtttgaaaaggctagatttcctaggccaaaacactgaaaatttgcaattagaacttcagtgctgatgctgggaagactggagttagtttgagacatgcacctgtgcagaactgggcccccagaaaaggagaaggaagggaatccagaccagagtagggcctgacaccactcagactcggcgtgtctataaattagaattgcgttacaattacactttgacattttagtggtttttaaagtgcccagcacaagttaatttttcattaatgaatcctttattcataaaatgcttagatggagattacccttttgagcattttgccagtgcttctgaaattaatggggacctcctgttggaggacacagtctgttgcaataggtgaccactgctctgaatctatgtcacctctccaggaccacgggcacaaccatcacctgaggcatgttggagatgcagatggtcaggccctcctagaatctcagaatctgcattttagcaaagtcctgggtaattcctatgtccattggagtttgagaagcactggtaatctcaaatactttaaaagattactagagtaagataggctcagtaggtacctgaaggcaccatcccaaagaccagagtggtagaagcaggtggaccagcctctgaacacatttctcccccactccccggctgtgtggaaggttgccacctttggggtagtcattcaacaaacacgtgtcaactgtccactatgtgtcaggccaccactgggcactggctgtggctagctggatagacaccatttctgccctccagaaatgtcatgtccactggcacatgacaagtcactaagtcattcagagccatgggtgacagctccaggggccgacaaaggagctgtgatctcacagatccacagagaagtgtcccagggcgggcgggaaccaggactgcacagggaggggtgaagtgacacataagaagtcagcccatcagcctgaaatgctcccccaaatcttcccattcagtgttttctcagtagcaaactcgtgggaaaattggttattttacttaaaaaactcatactagaaagctagtttaactttaaaaataaattttaaaaacatttttattaacaaatcctacctttcctccaaagtcaaggagaaaagaatagaagtgaacaatggaccaagtaagcctaaaactctgctctttcccctgctcattttacagttcaagtgccattcaatttatcctggcaagaagaggaaggcatcatcaagaccttaattttctaatacatctgatctgagaagaatgtgaaagctataaaattaatttttgatcaataactacaggccttttgagagagtgccctcctaatgaattgagtacctatttctccatacacagtgtctatcatgacctacaaacccttttcccatgaggtgtaacagagagagattacagccttggaactggatgtcagactctcctggtttaagacaataagccatgacatagagcctgaaaccaacacaatcttccgagtggttccagaaacatataggggataatgttggctctgatgctgtacatccccaacaaccatcaactatttggaaactagaatttcagcataattggagttggtgttaccctagcaaatgctgtgggaagagagtctcactgtgtatcttctcctgtttaaagcctgaatttgttcagaatgtaatatctctgtttagccactctactgaaactgatctaggaaatgttcaaaaaaaggtatcccaaggatccctttgtagctacatctgtgggattcccctcgctctggcgtggcctggcccctctgcatttgacaatacggtcctatgcttttgtcttcctgggctgcgtgaacccaccctgccctggttcacctctcctcttgacccatccttatcagtgtcttgaaaggtccttctattggaggacacattctgttgcagcaggtgaccactgccccaaatctgtttcacctccccagggccatgggcacaaccatccctggagtgtgttagagatgcagttggccaggtcctccaaaatctcagaatctgcatttttgcaaagtcctgggtaactcctatgtccatgagagtttgagaagtactggtctcatgagttcctgacatacaaatagtgctgaggccagtatgctgactgggtagccagatacaagtgaaaaccttcctgttttttgcaaacctggatggacccgaggccgctgacgtgggccaggacaagctactctttttcagtgtttctgttgcatcgctgtgtctctctgtgatcaggtgctgccctccctggcaggaggactgcagacaggatgaccaagagcactctacacagcctgctctccagtgttgggggacgccacccaccctcgtggttcctgttcatctgcctacacgtggagggcccaagagggctaatatgtgactatctccacttcctggtaccctgtgtgaataacttcacttactaaagggatgttgagcaactttattaataatgaagaaagcactttggtttgacaaataatcactccattttttcatttgaaagttaactcttgttagtagagaaagcaatgtattacaaccacaaggacgtttacatggaaatgaaccatctgcaaagcatcccccattttccttttaaatcagccaatgggtggtggtgggagaaatattcaccagagtatttaacatctatcccccttcctagactgtcagctccatccgggcggagactgttggtatctccacagcacacacagggcctggcacacatccggggctcagtgagcacttgctgaatggtgaacagattagctctcctgggaacgttgttgacacatctcataacactggtttggagtggagggcattcatcgggctgcatattcctatttttaattgtattctccactggttacagcacctacagttataaagacattgttaacattgcttataggaagacatttgatggaaatgagtccaaaggcattacggttagaaactggccaggtgtcatttttgagagattagataactgttttccggtagagtgaattgcctgtttgttgcaagttgggactttgctgggctggtttacagggccaaggggaaagagataagtggatcttctagtgagaggtcatctgttttgaaagcctggaagattccatgaactaaatccaagtcttacaacacagggaagtgtgtcatactgtgcagggatgaagtctccaatttagcatgaaaacaagagctcctcacactgtcctcttcagaaagcccatacaatccaaacttctgaatgcttagctgcttacaaccatacatagattgagggataaaactctgatatggaagagaaggtaaacattttttggcagacattcccaggaaaaggcggctctcttctctcattgctgctgctctttcagaatccatttcaacagaggaggagtcaatgggagccccgtgcctctggcagatatcatatggcgtttcagtggcattgtgtgttacccttcttaggtaacagctcagccattagaagaatgtcctacacaccttctcattttctgtgatgagaggaatgtgaggtactgcccttcgagagctgtcatttgtcctagtagccagcagcgtgactgtgctgtcttctgctctgtctccctgtcagccttctgcccagccaccaccactatagttttgttctctccattggaactcctggttcagagaattaccataaaaaacagacccctagacatacaacactctatcacataatggtgactttgtcttctattttggattactgagctttcttgggtaacttccactaaatcgaagttaatattagaagaacttcctcttactagaatcgaaaagcatttaagtgatgcagtcaagtttgtaccataagtaattcagtcatttaacaaatatatatggcctctgtgcgacagtgaccttgactgggaatgaagctgtcccatgtggggcctgttcttcaaaggcagttccctgctgcccagttcagtccagtggatctgggcatctctctttaatccgcattaggggctctttactgattcttcactatccaaaaagacttggaggggagacctgagcccacttctggaaggaaatgataacaatttatttagataatctttgtgcaacaagtcaattcactgaagagatctgctctctaggagcctctgtgaccccaccataactgggaaggctctacctctccagtcttcgggccacatttctctctggcctgctgtcttcccagcactctcagccttgctcatggagcactctagtcctccgtcgaccttggcctttggtaacgtgatttttcacctggcagctcccatctggtctcactccctctttttgtccagtctgcatgacacagcctcacatcgttagtgttccctcactcccctcttactgcccaacctgcaaagtccatgcctgggccagtgcagcatgtgtcctcaatgggctgctggtggcagtggggggaaccgcacagccacgctgtgtgctgctgaagaaatgcacagcctcctaccctcgccctcaagaggcagccatggctgcgcatttctgcccttctgagctccgctcacttttggcagcagccgttccaacctgcatgggatcttcactctctcacagatgtgctgactcctcctgctgcctcccctctctgtgccttctcactctctgttccctttgccctttctccccttttctcctctgcctacctccaagccatccatcacaggacagctcaagcatcagatcctctgggacactttccttagttgttcagtctgatgaggtgtccctcatcctctcttagctgaaaatcagcagctgcctcaacttcttttccagcatgtctcatgagtattgccacaacagcatctgtcacaatgtggggtagtggctgacttgcttttctgccattcaactgagttccctcagtgctggggccagcgtgcagtgtcttgtattcagtatatagctgattaattgatgaattgattaattaatggttcacactagcacagtgcaaccttcaatgcaaagatctcatcaaaataattcacatggtgggatattttagaaggatgaccaggctagtttgtagtaagaaaaaatcaacaagactaggtcaggaattctttttttgtctacaggcttgctatagaagatattgaaaatcatctacctaattacctttattttatcaggttgtgtattaaatatcacgtctgggggaagaaaatgtgatatgtgattacagacctttcctggtacaacatagtacgtttcagattaactcaaggtattgtggtgatattgcggtcaaagccaggtgattaaagagtcattctttgaaacaaatatctgtgcaatcaattaagaaattaatttgcaaattttatttgcttagagtaattgatatatcattccttttacaaacaaatataaagaaaacttaactaaaaatactgcatatctctttcagattatatatcccagaaaggatatatttttctcctttctggtcttcctttttggtgtagcatctgtaggaaatgcatttcttcatagctaagtgtacctccttgtgaaatatcttcagagtctactggtgcacataagcaattgctggcagcagcttgagggtctccatctcacatttatcatatgccttattgcatgaggctttgcaagaggaggtctagagctacaatatctcatggatatgaatgtcaattcaaatcccagtggcagtttatgagggggaaagcctagaagagaagaaacctagaggaatcaagcaggaggggagagtaataaaagactagagcagcaggtttttcttaactcaaactagaattaaatctctgtgtgtgtgtgcatgtgaatgtgcccgtatgtgcatgcatgcacgtgtgtaaatggatgtgtgtgtgtgtgcatgtgtgtgcaagtaagtgtgtatacgtgtgtgggcatgtattgtgtacatgtatgtgtgttttatgcatctgtttgcaagtatgtgtgtatgcacataaaagtgtgaatgtacatgtgtgcttggtgtatgtgtgtgtattaatgtatgcgtgtagttctagagtctagttagagaaagtgcataaagaaatagggaaattaacaagaaagctatagcttaaattataggaaaaacttttctccctatcagtcatggttttaaaatgttcagacttgatatgtttcccagtgctattgtcagaaaatgtccctatgacattccatactacttcaatcaaatctaaaacctttgttccaacatgttttattgatatgagtatatttcaaatttctaccaggtttttggagaggtattttggccataaaattgactaaattattcaaaataaaaaatgaataagcctgggccaaggcttggagacttgcttaactcagttcttaaattttcagattttcaaaattacaaatttaagctctaaaatcatggtgctgtgtatgatattctttgattgcaacttatggttgaaaaactatagagggctttatgctaagagttgtggatcttaggattttcatgaaatctgcattatcatcatctgcaagtttagatggggcataactgatccaaaggatggatccctcgggggcaattcaactggctgattccagccaagatgacaacagtcaggatccgttcccttctgatcatccattgggtgccctgatttcctctacagccctagctgaaagaccagacactatctcaggctggctgccccacatgccttgctccacaccaaattcacagtctataaacctgagcctccagtgctcctactaccatactcactcgaacattcccgattctgacctggagatgtcaacagctacttgatgccactctcttctatctttctgtagctaagccatccccaagtttgtcgattcaccctctttaacccctgtcggggtgtccattgtgccccttcaccctgccatctccctggtgcactgttttgcaaagttcagcatacatgagcgtcacctgggaaccttaataaagtgcagatgttgattcagcaaatctgggatgccctcgggctgcatttccagcaggctcctggggatgtccccgctgctgtgctgcagatgacactctcagtggtgggactccaggctctgctgtcgcctcctaggggtttctccacactccctggaggcctaatgggcccttctccacatggcagtaagatctgtttttgtgtttgtgtttcaagttgggagaaggagattatttaatactaaaatgtgcaacatgggattgagaaaactaattattagtcataagttgagtatgcaacattgaaaccacatgctttaaaaaattataagaaaaaatcatagtatttgaaagttacaagctattatggctaactccatttatctcagttagagaagaagagtcacctgtcaccagggcactgccagaagccaggctcatttccaacagcactgggtgctccagctttggggtgccagctcctcccataaagcaaacacatacctagggatgatatttctttgcaagggctctgccctacagcttgtacatctcaagaagttatgtaattaaactgtctgttttgagaaaattgtagattcacacatactagctgtaagaaatgatgcggataaatccagcgtaccagctttccccacggagacgtcttgcagcgtcacagccaggatgaggcattgacccaggcgaagtccagagcacctgtgcgctacagggccccttgcactgtgctgtcacagacacgcccacttccagatgccatctaggaccccctccaaaaagcagaggcattcttaaaaacacacatctgcacatgttcctcttcatttgaatctgtcagtggcttctcagtgcctttcaaatgaaatctaaagtccttacaagccttgcagcaggaacctctccatcccacttcccctcacactctcagcttcatctctgctaggctctgttcagccaggcagcctttcacagtccctctcctcctgccctgccaggaaggtcccctgcccccaactcttccccacatgtggcggggccccgcttgtccttagaagcccagctgaactgcttcctgaaggaacccctccagaacctctcagaccaggtcaggtttctgcactcttagatcatccccatggcataatcacagttgtgatgttgtgatgattcagtgaatgtctgtctccccactggatggtaagcttcctgagggcaggaacagcattggttccagtcaatgctatgtcccaggactgttcgtttttgcacatactaatcctaaaaggacgatgacaacagcaaccacttacatgacctagatgctcttctgggtgttgtgcaaatattaacaatttaatccttgcaacaatccacgagggaggcattcttctactcccacttaacagacaaggacagtgaagctagtaaagagaagtcatttgcccaaggggaccccactactgttggcagagctgggtgcaaacgcaggcttgtgaagccaggacccatgcattcaaagaccatgccaggtgcccccactgcacacctcatccccacataccagtgagggggagagaaatgctcctgcactgcctctgattaactgctttcctagaagtcacacatataaaagggatttaattctagtgggattgaatctcaatagtttccttattaggttgatttctgttaatagtttaagtactggatatacatgaattagaaaatctagattattagcaaatgcaaactataaagtattttataaatgttatcttgtttgtcaggggatgagtgagatattcattatacaaaaagtagtgtggattttgaggtagaaggtttactaaggatcataccgtagtatgaaatagccacaaacattcagtgaaaccaaacacccccgcttaacctcaaactaacactaaataataaggaatagacttgggggcagtgcaagtgtatttctaatggtgaaaaccattccccagtgaaaactaatgtaccatctagttaataagagctcctctgacccacgcacatcaatacttacatcccaatggtgatgtgacattttgggttttgtatttcttttgcaaattgagctagcatttttgatgagtggcagggctctgctacccaacctttggacagtttccaagcataaaatcacaattccagataattctgtcacaaagatctgggtctcattaggaaggagaggaagctgggagatgatccagtccaacctcccccaaaccaaacatcacggccttctcagttgtttcaccaaccatctaaatgttttagtaattctaaaaattgatgcgctttttccacgaaaggaagtgttaccacattttccaagtgggaggcatctatatccttactccttcatcctctccttcccaccccctcaccccccaccacccacacaacatctgcaattcttaaactaaagcacaaattgttacaaaagttaattgcactttcaaaggaatgcttgtatagaaactttctcggcttcaaggaaaaataatacgctttgaatggctgttcaacagcatagaaattagctgagtagaaggcactcatatagccattaggaccaatcctttctgccgccaacaccccccttataaagacttgacagtgggccagaataaacaacttcaggatgaattcagttgagacacaaagtacacacttccagtttttcccttctctggttactggcctcaataaccaggcagtcaacttaaaaagaaaaacaaaagcttgcttcagattacagattgcagacttcttataatatgtccatttcaccaggccccgctctcagccccgggaaaggccactggaaaccacctcacatggtagggccttgcgggagccagtaataaccttatctccgtcaacatgttctgtcagattgaatggggcagccagagaagccagagttggcacaggaaccaaaacaaaggcttcccatcctcctggagtgagcggttgagcctggattggtgcttagacctataatgggtgcaagcagcgttcattcatagtggctttctagacccagggacttggccccagccctgctgctccactcctcttcttgcttcattaccacgagtctcctagaccaccgaacgatgcctgcatttgaaagacacttctgctgatcaaagcagctgatgtgtccctttgcggttcatttctaattgtccccaaggaggagaaattcaaatagtttattactgagagttaaagaaatccactgaaatattctttggtctaaaattactgtcatggcggagcagcttcaccttagtcattgcccttaaatatgaaagctatttaagaaagtttgcccttaaatatgaaagctattttaaaaagtttaatgaaagaagagaatcacaaaacattttcaaaaagcaaaagaaaacctaagagaaaagttgaaagtaggaattttttaaagaatatacgacgtgtgttctgtgactcacccctgcaagttatttgtgtgtattcccttgcatagtaattaataatgaagcaaagcatggcaatgatatcttttcttgtctagtattctagaagactccatgtttttggaaaatatcactctagttagatctcaaatatattcaatcagaaaatgggttttctacaagattctatatctgtagtcaatagcaaatataattctattaagctagtaggatgtgataggaaactaaaacctaggggagaccaaagcaaggaaaaatacttcctcatccaaacttgagagcaatttaccgtcaggcctactattaatagatggaatacagattccattttcattactcaactgccatattcattattacactgtacagaaaagggaatcacatctgttgaaaacttatatatgatgttcatgcatgcattccagtaattcaacaatttttatttatctttttattgcttgctaatttttcaaaataataagctaaagaaaacaaaatgtttgtgctgttctcagatgacatgttatctctttaaaggacaaaatgtgctgtgaaataatagaatgctttcagcactcaagtgtgagtgagtgctcatacatgagagaaagccgtggggactacagaagccaagaagcagatctagctggggaggcctttgcagaggatgtagttgtgtggagaggccacacacgtggaattcccaggagggctgtggaggcggggaatctgcaggaaagcactggggtgagaaacgtgatgagaaacaattattgtcttaaaatatctgcagggctgtaaggtagagaagcaatacgttgcatctgtgttaagtcaaacaaaattatcaagggactggtttcagcttaacataaggaacaattatgtgatagggttgtcaataacaagagtagactgcttcttcacacactcctagtcactcagaatggtccaggaggagtggacaaccatttggtagagtatgggaaggcaggggccctgggtgggagtggtgagggtagggagtgagtatcccaatctagaagtaaattgtgcccagcacggagctgcaacactgccctgcacacaaacacacacaaataacaatccccagcccctgcatttccctctccggtttcaggaccttgtatcttacttcaattcctttatttagctgatgatgaaataggaagagcttagcactaagaaaatccttttggagtttggccttgggggaaaatgaatcactccaaccaggtctgtcttctagaaagtataggatgaaagggctcctcatcacatacttcctgacctcctgctaggcctttccctaaaacaggggctggcaaagcacaacctgtgggtcacgcctagcctgccacctgtttttgcaaataaagttttattggagcatgactatatgtatttgcttacagtctgtggctgcgttcacactatcccagcagagttgaataattgggacagggaccatatgatgggtgaagctgaaaacatttactctctggctgtattcagaggaggtttactgagcccttctctgagacatggcaagcgctgcttcaggctcatgcttcactagattcaggcctggggcagtaaagagccagctcaggatagcactcccgactcactcattttttcaggcaggggagccatctaatgtcaagtgcctacgtgcaggaactggtctgttaattagcagctctcctcatggaagggataatatattctagaaacaggagtgcggccctattgcaagaatgtcctgagccaaaattaagattcttctatggcagaaacttggctggggcttctcctgagttaacttggtagttgttagtgatttttgagtcagtttttccttgtcaacgaccccaggaatgagtttgggattacagggtagccagggaaagggaaagcttcacgcccgcccccgggacaaggtctgtcttcacactgctacatcccttcacccactttaaaatgaaacttaaaaggaggatttcagttgagtaggaagtgagaagagggctcattttaaaacaagcgttaaatgaaaacccacacacactcagagcacacaaatccaaccacgcttacaaaaccatcacagagggtcaggcgaggcccttttctaaatgaaaaagaacaggggtggagactgttctgagagcatgctgggttccctgaagggaattctcagctgtatgtgccccgcacaggatccctgctagacacaaggccagctgccttcctttcaagccgcagacgcatccctgtgtccaggcgggctggtcagctgcggtcagcaccagcttccccgctccatggtgaggtcatcacaacatgtgagcaggagggcaggccggcaacctctgagtgcttagagaaagggacgggattcctcctgtgcaacccctctagtctcactcagactcaagtctgactaaggggccaggtgctttgaccagggactctcccctctcacttccctcccaggagtcacaggtacatgagtccttgttttacaaatgaagaaaacagacccaacatgattaagatgttgccttcataggggtggcaccaggattccaaaccatggactccactgagcccagtgcccactgacatgtgccagtaacagtgcagctgcctgtggttctgtcgactaaactgccggcagaggctggctttccaccttctttttttttttttcactcttcaaacactttatgacatgaacataaactactggctgcatcgttctgctgacaacatgacatgtttctataacttgaaaaaagcaagcagtggactgctcattggtaaaattgagtcagtaatcttttaggaaggttatttttcttccttttactgcttctcatctgttccccgcagtaaagaggacaagatgacgacgactcagggaacacctccagcctgaagcagcaccatgcgagcttagaccttagggtcggcttagaaaccacaggcggggcggcttgggcccctcggacactccctctcgaagctgcttctccccaagctaccccaaaggcactgagcgccctctgccccccagcaattcaattcactggctgtcctgctcctgtcagtactgagagttgcatgtttgaccctcgggggaaaagtccagaggccctggggtgtccagcatgctctgaggtccctgctgctgaccccttgcgctgtcagcattcagagacattcacacagcacagcctcccaggctaacagctgtcatggaacagtggagcagctagacgtggccattctgtggcccagtgctgcagaggtcaaagggacaagcgcagggagcatctttgctttcagaaaaaaaaaaaaaaaaaagaagcacactggtgcactgacctgctcctggtgtctttgtgattgctcttttctttcgatttttggttgtctttttttttttgaaagaggggcttttatgcttttttcctaatgttcatgggtaaaccaatgtaaatgtgtgtatgtttatagagatggctttaaatcgcaattctgcagtagagattgattttttaaaaaacatgggtaaaaattgaagaaaaattttaaaagaacatttaaaccatcttgggctaggggtggatatgcaccaccccacggaagccaaacaaaatctctctgcagataaacatttgcaaaaagaatttccaatcccaatttttgagtcagagatcttttatttccttgcaaattacatatctgtttcaggatttttgactataagaagaatgaatgaagatgtgtttcttacagataactatgaacaaaccaggaaggataataacttgtatcccccaattcgaatccagaggatgggaaggcataaaaaaaagaaatggaagaaactttatttttagtggtaaatggtgggactatgtattttacgtatggtgaagtcaccaagcccaacacttggcacttgtaggcaaggtagtcttctaatctgaatgtgaagtattatgttttcatttgcttggtaatgaggaatattggtgctttcgtcccagttctcgagctgactgacttctctttctgacgtgtgttcctttagcacacctctacactgcatggctctgagatgtcctgtgactgtttcatgtgtaaagttgcctccccaaaggactcacatattccttcagggcagtgagtacttctgattcatccttagcagctaccttcgcgctactttactagatatgttgtagttgaattaatgaacaaaagaacaagcaactttggtgcctggtgtgcatctcagagcagggtggagtgagcctggccaaagggtcatcatgcaacctctgtggctgactccatctggccacggagcttctcagccatgcttggtattcacatgacttctagggcgacagctcaaccagcaaataaacagcttcatatgggaaatattactcagcctttgtcatcaaggagtgagtcacgggcctgaactgaatagaagatagaggagaaaaggtgtgtggactgggtgagacagcgcccagcgaggtgaactcccggcagccctgcctgtctttacctgcacatcaccttgctagggtgccttcggttgtgagggcctgtctaggaagagaagagttgcaccctggcaggcagcactgagctgtctcatgcaaagctgaggaagaaagagtgagctgcccagtgagcctgctggggtggtggaggctgggctgggctgtgcagtctgcagcccccagcagcccttggcacctttctactgcctggtgctcaccagctctccagtaacaaagagggacgtgaagtcagaggggaagggaggtagcacagggcagtcttgactttgaacaaagagctggcttcctgaagtcagctggccgggttttgaagccgattttccagcagtgatctttgatgccaaccccatttaggaattctgtatctccccctaccttctaccagatgtctctgagctcacctttggtgataatcatgcaatctccgtcatccccacgtccacactgccccattctgtcccaccccgggttctgtggtgctgtcggctccccagcgagccaggaagggagaggccagctctgctggggctcctgccgccctggctctgcactgcccttctctggcaggtctgaggcgccactggaggagccacacggccctgaagcagcaaggcagatgccctggacacagtggaggcacagagtgcaagcaccggcctggcccacagacttttggaggggaagtggtattattcagttcaaaagtatgcctgtgtgtaaagagagagcccctgaacatgagtaagcaaaagtctcagcgcagagattagacaagtagaatgctggcccgagaggaggcgtttactcaccctctgtctaggaaggaaagccaggcccagcacgctcactgctatctatcctctcacacagagggattttgaatcgaagccagcatcctgtcctttctccaatgtcccctgctcaggagtcaggactcagcaaggcccaccccagccacacacagatacagttccaggactcagaactcagcgaggcccaccccagccacatgcaggtccagttccaggattcaggacacagtgaggcccacccgagccacatccaggtccagttccaggactcaggattcagtgaggcccaccccagccacacacaggtccagttccaggactcaggactcagcgaggcccaccccagccacatgcaggtccagttccaggattcaggacacagtgaggcccaccccagccatatccaggttcagttccaggtaaatcatctgccttcctccgtccaaaagccttgtttcctgtgtgtccttgtgtttaaaatggaaacgttatgagaaactgcctgccagggcaaagggtgctgcccggcacacagtagggactcaaaatgaaactattgtattgaatacataacagatcaacgggtattgctttctgaaatcttttttagcccaattttgtttcttatagtccaataacaggtcaaattcatttctgatttactagccattcagttgcccataaaaaatggaaagtgatttaagattattagtttaaaaaccaatgaaggtaaaacagttatcattgaaggcacataggcagaaatagattgcaatagttgctgccatgtgaagcctcagtgtcatgctccatatttagagagatctatgatttctgaggccctttcatgtccatgatctcagtactgctcacaactgccctgtgaaattcgccgagctggccccatgtcaatcagagtacactgagcactgagacccagcatgttgagataactggctagagatcatcccataatggtaccatcacaatcttcacactgtagaagtttgatgatgtcactggaagcatattccacagtcccttgtgaactggccttcctgtgatcagaagcatcagtgaactcccaagagggtgggaactcccaagaggtattctcactctacttagtgtatattttacaaatcacaagcttggctttggattcttttaatggctagaaggagaatcatggggttggaagtccaccagtttgggtattctgttccctaactcaaaataaagagatgttattttcaagtcttctgcttgttaacttaattagagatacatgagtttgcagctgtgctgggcatgccgcagcttggcatgtttagtccagaaggcatattataatgtacatggaagattgtcagaaattcaaaaggactttttgagtatcacatgtgtattttcaagttccaatatagattcacattcagtttgacaggtatctttggatgcctatcagttaagaactatttattagttgtggaataaaatagggtaaaataaggaacaactgaggaaaaaacataaaatttgctttgtgaataaaagttgtcttcaaaattatgactttttccatcccacaaaagttttgattaaacccacaatgaaaatttaaataagtgtatttactttggtttaaccacttatttcattatgactcacaactataggttttctagtttccattattacaaactattgtgtggtttaaatcaatttcatagactagtctagttctatagtcacaatttataaaatttttttatgtggtaaattgagtgtcttcatagatgtacatgattatttctcaatttttaaggaatgtattttttaagatagccttctttagccttctttaacactgatttttgtaaattttttacagatttttttaaatttttggtaattttttagcataaagtaatacatggtcactatggaaaacataaaaacacaaaaactatgaagagtaaataagaaaaacacccagaaatttaccattcagaaaaggtcattgttaacaacacggtgtatcttcctcctgtcatgcttccgtgcatttgagcacatttgagatgtgtatacatgttcactttgagattttagtatagcaaaagaaatgaccggtcctgattcaatgaaacctctggcaaactcgctatattttccttacatatttttaagttcatcctataaatgaactatccattcatcttatttgagattttcttaaatctttcagcaagaaagcgggaaaaaaatcctcctctggcctttaaagcctaattaaatatatgactaagctagaaatattttataatgaccaaccagaaagtggcaaggactgtcactcttcccatacagcccacctcctcctctatctccctcaggcacacggaaacgagaaaggcagagaaacccaggacaagtcatccaagactttggtcacatggccatccattgctttcacaacaaaaatataaatccaacatgtgtgtgtgcatttcataccagtaggtccaataagctatctatatatacacatatgtgtacacacacacacacacatccttacagacactccccagcttactacagtttgacttaagattttttgactttacgatggtgtgaaagcaatgcacattcaatggaaaccatacttctaatgttgaattttttatcttttcttgggttagttgatgtctgatatgttactttcttgcgatgccaggcaatggctgggagccagagctcccagtcagccatgcaatcaagaggctaaacagctgatactatacagtggactgtgtcaccagcattttggggatattgtgttttgtgtttttgaatcctatcatgtctacaaaatgccattttcgactgctattttcaatttagggtgggtttatcaggacataaccctatggaaagttgaggaccatctgtatatctggtagggaaagatggataacaaattcataggcaaataataatttcatgattattattaagttattcctacttaataataagtagtgatcactgccagggagcagagaatgcaggataatgtgacagatgtaatggtgggtacttaagctaatgtagttgcagaacaggcttttctagagggtaggcctttaagcgtacctcgaagatgcaaaggaagcaaagatgcgaagatctgggctggggatggaagcagagacaacttggaggccaaggggagagactgacaacagcccagctcatacctcagcagcctttaatgcatagctaagaaaacaacaaattaaaacaattatagtttacttagacgattctaagtgtctaagtggatttgggcaaatctggagaaacttgttctaatactgtgtcttaataagtaatatagatttgcccaggcttgtgggcagagtggtatacaccccataatagcagaggaaggccacagggcctaccctacaaaaccagaggcatttaaaaacttaaaggaggcagattgcttttattttcagttaaaataaagtgaggagtttctcaagaaaaataataacgagaccaccggcccgccctagatgtccaacaagaatgcacagataacttcgtatatccactttcctgaacctgcccctgacagccaagtggagcacaacaacagagatgaacctcaaaactactgtgctgtgacataaggcttgctcaagaggacagtgtggtgtgagtccatctatgttctaaagcaagcaaagctattctgtagtgaaaatggatcaggacagcagttgcctctggtgtatgggggcagggatcgactgggaggggcatgagggatgacagttagggtttcgatcatgacaggaattcagattactccagcatgtgcatttgttaaagctcatcaaatgctacacttaagattaatcctctcacagtttgtggatgttaccttaaaaacaacaatgatgactgcaaactaatattgaactctggttagtgatataccaatgtgaagtatagtgatatctctactttactttaaaatgcatccaaaggcagactagaggaccatatctgacagacagaaaaatagatatgtgataaggtgaatgtagtaaaatgctaacataaggatgtttgcggtacaattctttcagcttttctatacatttataaatcataataaaattttaggacaaaaagttagtgctttgaagtcctaagtcatagggcctgctgctcttgatgcagtagaatttgtcttcagatttgcaaagggtaaggcaaaccactagcattttgtatggaacttgatgcaaatacttttaattgtctggttttcaaatgtatagacttaaagtaatatcaactctttctttgaatcaactactgaaatacctagtcttaaataaatatttttatgtaatccttaaagtactatgtattcatttttctttcttctttcttttctggtttgataaatattctataaagtaactgtgtttaatggccaacatttgagtaagtccatatgcagatccaaacatctcagtttagacaataacttaagacaatatagagtggctgacatcccctaacgtgggtccagatgcatgttatgttatgtttctgttgcattctcaatagttaactttaataaaagaaagtcaaaagcttatatattttttcaatcttcaaaacatttctgggaggttgtcttagttaattttatgttgctatacccatatcacagactgggtaatttataaagaaaataaatgtatttggctcatggttctggtggctgggaagtccaagagcatggcattggcatctgcttggcagctggtgagggccttcatgctgtgtcaatctatggtggaaggtcaagagagcatgcatgtgaggtggtggggaagagaaaaagcgggtttaactcatccttttatcagggactcactcccgtgatagctaacccattcttacatgaatggcattaatccattccttagggcacagctctcatgacctaattataatacctcttaaagtttccacctctcaacactgttgcattggtgattaagtttccaataaacgcactttggaaaacacattcaaaccacagcagagatcaacgttattgtcaccattttcatatttgaggaaagcatggcacagagagcttggagaagtacttcaaggtcacccaatgaggaagtggctaaacaaaaaccttatcttaaattaattaaaaacctcttgctctttgcagttttgtcttaaatctacctaatttgtgactgtaatttttaagtaatttactcatataagtggtctcacattaaattttctcattgctttatatttctaacatgagatatttggtataaggatggaaccaagatcataccttgttttaattagaaaacctagaccaagtcattgtgatcctcatcctagatttcagttaaatgctgctgtctccttttgggtatgtgacaggggaaagcctcagaagaaacaaccttatgtgttttcttttgatactttagtaattaacccaggatagtattcaagattgacatgccttatattgaatcaaatagcatatcaactgccttcttattctcaagtatagacatgttgggtaattgggcatttaagtttctttgcaattttttccattattaacaaaattaatgagcaacattctgcataaggtctgtttcctcagaatacgtttcccaaagtggaatcatcatgacgtagaatttaagcatacttacttgtttaaacaaattgtccagttgcttcccaaaatgttttgtgaattaagatttacatcaagaatatgtaatgttgttactgtctcccaaatacaggatctttttctgaatataaaagttatacatgctaattgtagacaatgaagggtcattatcctcatagataatgaagtgcttctaatacttgtgcttttattcatttattcaaaaagtgctaaataagccctgaaggggcttttggggggtcatttggggcttatttagcactttttgaataaataaataaaagcacaagtacagtttttttaaaatactgttttctataatagattaatcttaaatggcatgttttcctttattttactgacaaaagttacttactctgtgattgaataataaaaattctttggttcagctgagagaaacttgcaagctgacgtccttgattatttaaaatgaaagcagctgcctgttttcatctctctgcatcctgaggaaactcttctgcaacgtgttccagccctaggttctagctgaccctgttcatctgtttggcacgaggggcccaactaacacttgcggctacctggacgacagccaatctagttggaatgagagttagaggccatagtctgtcagctgggaaagcagcttttattccaaggtgtgccaaccgaaaggccacatgttattgtcacaacctggtacctacatcagtgctgacatctttaagaaccttagaattgggaaatcagtttagccctatctgcatgtgtagccgacaaccacacaattgttccaacttgaggttgcattcagagcaacctcatttcccccatactcctgaggaaaagcagaccagagacgctgggtcaatccagagttatggttggaaaaatgatggaataattctgcccctggtgataggagagagggactccatcttgtcaactgtcatggttcccatgtgaaagctatcattatcactgaaattgaatgagaacacagaagggaagaacagggaaatccccacagagttaaagaggatgtgaagattgcttcatgtttaatgtttgtgtaagtgctttgggttggttatgtgctgtctgaacatgtgctcatttccatggctcattgagagggcagacagtccaatgatactctttagaatcattcccatggggaaggaacaaagaagcctgtaaaatagaaatgcacatgtaaaaagcattgaagaaagtgccagtgtattgattttggccatggtttgtgctctaccacctggttactgtgattgcagaagtgcctttgcagatgaggaagaacctggccaaggctcaatccaacatccaaagccagaggccatatttcttcactcttaagataatttgggttcaaattatagtccctttacacactctctgcctcaaaaggcccaagactctcttttgttatgcttgcctaaacatgcctttcaaagaactagttctgtaaatacaactttattataaacctctcctttgcttttaaaaatggatcaccacgtccatttctatggtccaactttgtcccttaatttaaaattttttcttggattaagtttgatgccttgaaacattaggaactcaagcatacaagattgtatgctggtggtgagggaagtaactgtgcctccgcctgtgctgggtggatcaacatggagtgtggacgagcatagggatgtgtgggtttctcactagctgagagtgtttttaaatgttgtattttgatgtttgttattttctgaatattctacagttagacctttgatttattctttgatgcattcatttgaataatatttttaatctccagccagttaggtttttaatttacacttttgtccctgattttaggtgtagtgttgtgtacactactgcccagtgtatgttatgtttgtaaacattcattgcacgcacaacaatgtgactcacaatatttttgagaagtaaaaagttcattatatagttattaactcaaccctacagttatattcgtgaaataccttgtgaaatttattttttgcctactggagctcttacaggttaatcctgtcttcaagattttcatagaattttcatctaccacccacccctttaaatttcaacatttttttattttggcattttaatgcaattcaatgcattatagggacaagctatctcttattatgaattgcaccttatataaacttaaagatcttttatcacaaatttctttgctgtgtcctttagtgagaatttgtattatcagtcactaaagctcactaagttagtaagctttgcgcccagatgacctgggcaggaatgggtgagtctctgtgtggagagagtgaagaaactgctacccttaatacctggaccttgagggattgttttattttagtttttctgcatttctcagtatttcatgtgatatctgtctttttcttccagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaaggttggtgactttgattttcctacacaaataaaattggagaaaatctaagtggagaaaggcctgggcagaattccacttgaagtgtgtttatttttgctatggcaatgacaagtcttacagagctacaaacgagagttttatgagaaagccattttaccagctaatgtcaagtaataactagaaaaggatatcaaatagaaacaggctaatctggagttccatgtcatcatagacactgacgtttatccctgaccattacctcagtcatgatgtgctgccatactcgctcttaaaaactttttttaaaagccctgctttgcaccatttgcctattcccttagtgtaaatactcctactatagctgatttcaaggtaccaagtttcactcagctggtcacagaattcttatttcacgataggcgctaatgaccccataggagccagctctgaaggcttcagagtttcactgaattttggatggggtttacttagccttcttctgtttttcttttacctttcctttttaaataagaaataatgcaagacagatacaaagtaattctttttaatttccattttcactggagagtgttgaaccccgtgaggcatgagagcacagtgttccagaacaatgcttactgctcattatcacaggggtcaaaggctaacgtgcagggattgttgcagatcgtggacatgctgcctcctgtgtccatgactgcaatcgtctacctattttacagttgttgagcactcgtgtgcattagggttcaactgggcgtcctagggctccctggacccattttagaccttgagttcttgagttcctcaaaagagaaatcacgcatttatgttttctcttcttagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggtgagaggctgggatgccaaggctgggggttcataaatgcagacagcagttccgatggctcccagcgagcttgtcactcaattccacctcggagaaggcttttatttttacccagtacacgtgcactgagtgccggctgtgtgtaagatactgcaggggaagttactgagaagatggcagatactggaatgggaagatttaagcggggtaccagtgtttacatggacatgaaaaaatactgagagatagtaagaaatcgtaaagattctgagtaaaagagagtatgaccaaacaagctgagcaggaatcgtgaatctatgtgtgtaggcagtgaataaactgccagtcttattacctggacctcaaggataaaagacatacagtaaaaatcaacccacattgaggacagtttcgagagtcgcgctgctacacagaaagccctgtgtaagttaaggatagagaatgaggtgttctagaactttgaatttttgtgagcaggactcgtgaggttcctgtgagaggaaacaatgaaggatgatagaaaagaagggaaattgattttaaaaaactggagatagcagtgattgtgcctcactgtgcagtgggtttggggccaggaatgttaaattggtaacttcatttaacgcccacaacctttcttcaaagtaggcactgtacagatgccccttgacttatgatggcatcctatctggctggaccccgccgagggtgaaggcgtcattaggtcggatttcagggctaattgaatgtatattgccttcacaccatggcaaagtcgaaaatctgtgttaaatcatgctaagccggggactggctgtgctctgccatcgtacaaataaataaatggaagtcaagtaactcccttgagggccccagctagtgaatggagaggccagctatggccaccactctctgccccagggcgctcaacgcccctcctgtgccatgcagttctgacagggaggcagtgctggtaggaaaggggtgtgatgaaaggggtgcccagcagagggagtcatatccggagtgacaggagcccaacaggggtgcagcgctggaacccaagccagcacctctggtcatggctcctcagttcaccgcctataaaattgtgtggttcccccacaccccttgctgctcagagcagccgcgcacatgcttgtgctgtgcgtgcctcctgtgagatggcctggtacaccggttcctacagtgcgcctcacacgctgtctcggagggaggcagcctgtgcgggtgcctggacctccgagccagaccctctgggttcctgcctggccccgtccctcagcagccagatggctcgggagcacattctccaatccctccgtgtctctgtttcgtcatcttcaaaaatgtggatggcatagctgctaaaaaatggtgacatacttcctaggtggtgcagaaaattaagtgactgtaggaacaggcctcagcagctccttccacttccttggtatgattgttttttaaaccaaggctgggattgtatagatgcagattagttaatgtgataccattaatagctaacctagtgcctgctgcagggtgagcctcccctaagccaccgggaagcggctcctgcagcctccctcacgtgtgctggccctcctctggcagtcattgcctgtggtgtgctgaaggcccagctctgactgtgcctctgtgctctcctcgccccgccccctgctctctctcaggtctttggtctgttgtccgagctgccacagcagcctggacatccctgttggtgtttccagccctgtcctctcctgagttccatccacctgtgcatggctttttcatgagtgttttcacggatggttctgctgtcatctccaacctgataaacaaagcaccacgattcagcccttatgaccccaagcttccttcctcagttccttgcttctgtgcatccactgaagaagcctgttccactgtttccctgcactgggtctcctgtctgcaggaagccttcagccctcacttccacactcctctaagatgtgtgcctgtgcccttctggggaagctcattttcctagcagcctccaggatcttcaggggtgaatccctcctttcccacgttggtactctgtacacacaacatgcccattccctgcctggggagctgggcattgcttcatgaatcagaggtcaattttttctctattaaagtcacagatgctcattgcaccattgtgagaatgaatgaagatagtgcttataaatcagccagcaaggtacccagcctcactgtgtcagggtctccctgggcatgaggtggttagagtgtgtgacatgtctgtccccaagcctgtcagctcccagatcgaagccagtggatctcattcatcctcgcagcgcccacagcacttgcacagggttttgtacacataagtcattctgtcaatgttcatgtttaatgtcatcagtggaacactcccactttgtaaagacttgaatgtgttcatccctgacttttccacatcttgttagttcttctttggaaacagctgtacagtttcaccatcctgtgcatccctggagtctacctgtctctgtcatacattcagattcttcttgtttcgtgtcactctcatatccttttctctaatgaaaagctccgcctgggcatgcaaggtggagccctggatgccagcccctcacctggcatccagggctgtagcactcaggaactgcctccctgccctgcctaccccctacatcatgcgaccattccagtccagccaatcagccccttgggacccagcttaccacatgcatatcatttatgctgtgaccactgactaaaccattctcttccttcctccccatatttctaaatttctaatcattgctcaaagcccaattcagagaaaaccctagctcctccatggcaccatcattaacaattttatctggccgccccccgggaagttcactgggctaattgcgggactcttgttcgcaccatggcatctctttagcagaacataaatgcgaagagcacatgcatccttcatgggaatttaaaggagctggaaagagtgctcaccgcagttccattctcccgcagaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgtaagtgtcgcatacacactatctctgcctccagctcctatgggggacagctctacagcactggggcaggggagagaagccatgtttagtaagtcacattaatcagaaacaaaaagtagtaagcaaaatatctgaccactagaaaagcatgtatttaccacggacatagagatcgtttttttgtggcgggtggcagcccagctggttggcagtgcaggccaccggaggcagatcccctgcagggacagcagagcacttgtgtcctgagaagagctgctgttcatggggctggcagcaccagggcctctcctagcctgccctgctgacactggccagactcctacatgcttctgagtctccagaggctacccggccctcctgaagcaccagggctgaatccacccccagctgagggcatgaacactgccacatggagtcacacacacagctgggcactgccatggagaggaagtctgtccatgtttccttgaatactggtggcctggtccctgtcccattccccagtgaggcagcctgtggggaagcctggcagggaaccaggcgcaggtcagcgtggcgccctgactcaggccagcactgatgggggactctgagacgcaagctcacactcacccagctcccctgggctgcgcccgttcctgatcgcttggactttctgttctttagagtaagaagtgatcaccatttcctgcttctttgtttctccacaactgtgcagtggatgcctgtttgttttctgccctcagaacaaaaaaaaaaaaaaatagagctgacgtgaatcttcaaaatcatcaactacagggctttggatttttgtgtatttgttttattttcattttatggatggattgtgatgaaatgcccgtaatacaagattttccatcttaaccattgtaagttacaatgtcagtggcattatacatccacatgggtgtgtggccatcaccaccgtccacacacagaactcttttatcttgcaaagctgaaactctacccattagacagtaactctctgctctcccttccttcccagcctctggccctggcaggcaacagtccacttgatgtctctatgaatttgactgctctggggctctcatacaggtggaatcatgtagtatctgtccttttgtgtctggcttatttcacctagcaaaatgtcccgaaggtttatccatgctgtagcacgtgttaagaatgtccttcctcttcatggctgaataatattccattgtatgttgacactacattttgtttgtccattcacctatctacagacactggggttgcttccatcttttgactgtttgaataatgctgctgtgaacatgggtattgaggctctttgttttatagacatattattccaccagatacccatcctgacacctactatgtttgcaagaaactgaaagctttattttacattgcaaaatttcatattatgagatcaaggttagcatttcctcagctgtctggtggacaatggggaggttaaactgtgcacattttatttttttttaatgaacctggaacggttatggggccagtgtttgccatggatcaggtcaggcagcccacaatggcaggtctccatgttctgtacaacaactgtgggaaagacccacagagaaagtgctggaaaggggaatgatgggtaggttcatgcagtaaaaagattcaaatactacagggcattgaactataggccaatatagcattgctttaagaataaacaaaaaataagacagtaagaataagcctagcaaaatcaaaagtctataaagaactgacatttcaagccaataagagaataattccttattcaataaattgtctggaatgacttaactattaggggtgaaaatatcaaagtgagagaactataaagggtttttaaaaaggaattaggtatgttgggttagtcgcattggagagtgcaaattcaccatcgacctgatacctgaaatttcctccttaccatctagaggcaagttgggaatgctgccaggctcctgtggtaaaggaagctcctctcttgactggtgctttatggctacacgttcctgctcagaatggatctcatttagtcttcaccaaaaaaaaaaatctcatgagatgatttaagtgttttatggacaagatgtctaaaactcagaaaaatttcacagtgtgcctagcttttatgtttatgttgaagttgggcattagaagttagaatgaatgggtttacttcagagaaaattaaatccatcacccactccttgtactatgaattccaaatacatattaaatacatataataaaatatttaatatatatgtaagtgccagaaggaaacataaatatgaatattttgtaatatcaagttgaagaaaagccaaaatctgacatcataaaagaaaactttcaagtaaaatatgttaatggctaccaggaaaatattgtgcaatgtctgattgccatgaagagggttaatatccttgctatatcactctgtgaagtcatctttaaaagactaagaaaaagatgaatctcttaataaaaacctggcccagaacatgagcagcctctctctctcactctcactgtctctctttctgtcacacacacacacgcacacatacacacacacacacaaatatggccaagaaataaagtaaaatgttatttctaatgtaataagtaggtcaaaatagaaaaagaaagcatcacaccttcctttgcaaagtatttgggttccttttgcttttaaacacctgggtcagctggggtgtcgagaaacagaaattctcacgttctgcttgtgggcatatatgttaataaaaccaagcttggcaatatgcctgcaatatgtatctaaagcttcaaagtatgtatagctttgaccaatcaatatcacatttcggaataagagaaaaagaaataatgaaagtgaaaatcataagagatgtagaaacatattcttatacaagaattccttgcagccttatttataataaattttgtgaacaaattatatatctaaaaataagagattggttgaaaaaattatgcagcagccatgctattgataatcatgttagatagaagcatatttaaaggcatggaaaaattgccatgttttatatgggtttttaaggttataacacaatgtatagtgggattccaattcctgtatatacatagacttatatgtctatattgattaactctggatgagtctcatgtcttctttttgctttcttctattatccatattttatacgatgtgcctgcatttcttttttgtaacagatggtcaatactagaatcataaacagatcttgtttgtttattggcaaatgtttcccgttagaaaaagatgcatttttcttttaaatatttttattttatacaatgattacaagcttataatagaaatttgaaaattatatgtgagtacagggtaaaaagttgaaagaatgggattgcacgctacagatctagctgcttttagcacgcctgcgtaggaccttgctttctctagacctctgttgcagtctctctgcctacctcctcacaacgtccatcccccgcggtcactgtcgtgatgccagcctccccggccttcatgtctctaaggagcaccagcgcggcaattagcgccctttgccttggtggtattctggcttcacagtcacatgggagatcaatcgtcagcttttctgtttgaaatctaaattcttcctgactgcaggggacctcgggacccatgaacacctctagtttactatgtcttcacagtaaaagatatctgcatgactggactctttaacaaatttggtggttaacctactctttctatatagatatagcacttcgaccttcagacttctcaatactgataaaaagaaaacacgacagatgacaggaaaacctttgcagctataatttgtaatcggccaattataaaaactgcaaaaattgaccagatagctaaggttttacacagtcatgaaagtgatctgcactgttaacatttcaccctctgtgcaccattctgtgcttctctctggtttggagtctagaaggttttatttacaggctatgacttaacaatcccagaacggctgacacatgcagtcactcaagactggacacagcaaggaagtagtgggtccatgccaaaggctcagccagacgagacactctagctgtggcaggagatgccagggaatgctccaagcctaagcagattgtaaacaaggaacctcaaattcatgaaaaattcttgcttatgtggcccatgtcagtaattactctctgcctcagtttccgcagctgacatgtaaataaaagcagttcatggttcatcttcttttcttatcggggtctcaagtgattctacaaaccagccagccaaacaatcagagaataagttgaaaagattgtcttcatttattgaatgtgcttaactcaggcccgggaaagggcgtcatcagtttctcatcatttcactgagatatgcatctattacttttacatttcaggccaaaagtgtgatccaagctgtcccaatgggagctgctggggtgcaggagaggagaactgccagaaacgtaagtcagtgaacagcctcagacccatgtgtgaccgcccctctcttccttcacttgcttaggtgattggatttgttttccctctgaagactccaaagagttactttattacagggtcagatgtgaaccagtaggtgaaggacagtcttgcaaatctcaccgcatgcagttaatccagggtgggctattttgggagcttcagcctatcacaaataagtgaacatcagcaggggctgggcgcggtggctcacccctataatcccagcactttgggaggcggaggcggtcggatcacgaggtcaggagatcgagccattctggttaacacagtgaaacctcgtctctactaaaaatacaaaaaattagccgggcgtggtggcgggcgcctgtagtcccagctactcgggaggctgaggcaggagaatggcatgaacctgggaggcggagcttgcagtgagccgagattgtgccactgcattccagcctgggcgacagagcgagactccgtctcaaaacaacaacaacaacaacaacaacaataagtgaacatcagcaagtaccccagccctgtcctctgaacacagcacactttcccaggaatggaagacttgctcctgttgacagcagtcaccagacttcttgtttcctctccctccctggctttctttggtacccacctacacagaagcctgagcacgggttctcatggggacttttccatgtggaccctgctttacgatggagagggccattctcctaggtatggttgtctggctcagcctctcagtggccaaggaacctggggacatgagctcaaaaacggacactatgtccttaagctgaattgtgggggggctgttaggcccttctaaacactacttcccagcaggtatttttgttctttgtatgtgctttctgcattgcccaagatgcatctaattatttagcaggtctcaaagtctagacttgatctcatgagttctcttaagtgattaaaaataaatcaggagaaaaaagaggcaatcagaaaagggcatggtttgacttagtttgaatgtggtttcgttggaagcaaatgtgtcttcactttttcatgaaaaagtctgcaagtgctctgcgacatccctgggaaatgatcctaccctcactcttcagctcacagggaacctttgctctttttcagtgaccaaaatcatctgtgcccagcagtgctccgggcgctgccgtggcaagtcccccagtgactgctgccacaaccagtgtgctgcaggctgcacaggcccccgggagagcgactgcctggtaagatgcccctccagcagcctccctggagcaggctggggctgcacccgccccacccacaccaggacagaagacttcctgtgggggagctgtcaattagcatttgtcataacagacaggatattgccctctgcctggtgacaaagtatctttagtatcctgcctccaccactcactgagaccttgggaaaatgatgggactaccatgcctccatttccttacctgacaatgatgcataacaaagtctctcccagttgaatgcttaaatgatgagatgcctgtgatgtccgtcattaggacctgggcacagaacaagcactaaatactacatgcaagtatttgtcatgaatgtgccttgttgccagcagcacactctctttattgtttgacttcggctatacctctagagacttgacactgtgaggtccctaagagacccatggagagccacacaggtcttgctggctggggctgggttagggcctcctgacacggatccctcggctcctccaccactgctcaggcacctcctgagctgcaccctgccctcaaggggtcctgaagtactcactgtcgccccattgctccagaaagtgccagcagaagccttgctgccccagcgggctctgagcagcactggagggtacaggtcagaagcgtcttggaagtcctggagacgccaaggctggtggatgtgactcctggagtgggagctggtgtgacgaagcccttcctaagactaaatccagagcactctgtggtttcagagaagattcctaaattccagagtttggacccagacccaggaattgtgacttggttggcctgagctgtttctaatgtgagccccagggagaagactgtgcgtggggttggtcctaggaaaagccctcgctgtattgggtctggctcctttacacggcattgttctagcaaggctttctgccattcagcaatacattataaaatataccctcaattgtactttataagggaagcccaatgtcctttataagggaaattaaacataatttcattccatagtcaccgctataatgtgtgaactccatcatctatacgttagtaaacagacgtatttttatcataatccataaattatgataggtgggacagtgcacctaagaaaaaaatggactttttagagaagggtctttctgactctgcagagggcgccagctgggttttcccacactagtggaacactaggctgcaaagacagtaacttgggctttctgacgggagtcaacaccgtgctgcgcttcctccgtgtgtggcgctgagtgtacttacctcacttgcccagcgtgtcctctctcctccataggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtgagtcctcctctgtgggccctctaactggtcaggcatccttgtcccgctctgtctcctgctgagccctggagtatcccatcttggagagtctttgggtggatgtgtttgccttgcttggaggaggcgaccctgtgcccgtccaggcacacaggcgaggggaggggctggcttgctaccgaggagcgggcaggtggtggccatctccacccatgggggctgctcagtgcacagggcagatctgggtggccaggccacctcacaggagaaacacctgctgctcagccctcaccactcatccagcagccacagccgtgggtattcagttgtctgctgggcacaaagccgtgggcatgccactgtttagtgcttgtgccaagcaggtatttaatacaccgaaatcagagagtctatcagaagacctgccttcttgagtggttaaaattctagtgaaagttatgcctcttaggagtattgcagaggttttgtttttgtttttattttgttttgttttaatggtttgggtttgagttttgcttgtttgtacttacatttgtactggtggctccagggtttagggaaattgtgacataaaataattcctgacagagaaagcaaaactttgtctaatgaaagagttttagaagccactcttgatctctagaaggggagattaactgagaaaaaaaattgaaagaacaattatgagggggagattttaccctgccagatttgtgtacatgaaaaattttacattccgtatggaaaaaaaaaacacaaaataataagccattataaggtaaatgacaaacaaagctaaagaaaaatgtgccacagtgatgacacagatatatctttgagatagggcttaacagagctttaaaatccataggaaaacacttcgagcctgagataccaagagcagatggttcacagaagaatcatcaatgtcctataaatatttttgaggatcttcttggggaacttaaaacaggaacaggccaggcacagtggctcattggctcatgcctttaatcccagcactttgggagactgaaggggctggattgtctgaggtcaggagtttgggaccagcctggccaacagggtgaaacctcgtctctactaaaaatacaaaaattagccgggcgtggtggcgcacgcctgtaatcacagccgctcaggaggctgaggcaggagaattgctttaacccaggaggcggaggttgcagtgagctgagatcacaccactgcactccagcctgggtgacagagcaagactccatctcagacaaacaaaaaaggaagacatagagctcctaaaaataacgcagaagtctgctattaatacaaatgaattactttaaaggtgagagcaggtggaggagagggctgaggtgcctgctgggacgcaaaacagctggcccctcaagggacccagtgtttcctgccatgatgaaacacctgtattgtccacattgcggcctagaatgttattaaactcttgaacgggattccttctctatttgcaacctttcattctttgtccttaaagtaaataaagccaaaggaggatggagcctttccatcacccctcaagaggacctggaccgcctgtgtgaggcccgagcacctggtgccaccgtcatcaccttcctttcatgctctcttccccaggtaattatgtggtgacagatcacggctcgtgcgtccgagcctgtggggccgacagctatgagatggaggaagacggcgtccgcaagtgtaagaagtgcgaagggccttgccgcaaaggtaggaagcccgccggtgtgcggacgaggcttgttctcggctgctgaggctgggctctcatgccacctccaaaggaacacatcttcctcttctcattaaaaaacaactatacatatcgtttctttaaaacagaagataaagctgtaaagctaggttaggcaatgggaaggcactgaaggttgtgacggggtggggggctctgatgagaacagtcacagagccagccccgctcagcagctgccaggtgcccagccctggggagaatccagggaaggcagagctggaagcagtgcagctccaagcggcccatgggaaataatgaggagaacgcaaggtcagtgtgaggtgacagggatggcatctcctacaccgccgtagccccaaagtgtactataggtcctggtgtccccccttcccgcctgcactctccccagccccttcagtgtttgttgagtgaatgaaggatgatgtggcagtggcggttccggtgaccggaattccttcctgcttccctctgcctgtggatccctagctattcttaatccaacaaatgtgaacggaatacacgtctctcttatctctgcagtgtgtaacggaataggtattggtgaatttaaagactcactctccataaatgctacgaatattaaacacttcaaaaactgcacctccatcagtggcgatctccacatcctgccggtggcatttagggggtgagtcacaggttcagttgcttgtataaagaaaaacaaaatctgcctttttaactggtagagattggtgatcaataatcaccctgttgtttgtttcagtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaatggctgatgttttgatatttttcaaaagtgcagtttctcctgcaggcaaaaggggacacgttaagtccaggcttgggtcattcactgcggtgtaaacacgctttctccctcccgcccggccccagccagctgccttggtggcccataacccctgagggtagagggaggggacaggggtaggtgacaggcagcctgggcctcaggcttttgaaactggacgccagagccttgtggggccacgggcaagcctcgggtctatgactgccgcctgagctccgcttccttcctctctaaaatgggaagattagaccaaaataacaagactgttttaaggttggaatcaaataaggaaaatttgtaaagctccttgtatgtgataccagatccacaattggcagataatcgcagcaggagcctcttcggggtaatcagatacgcggcgcagcaggggtctcagggccacagccaggggggcggcgggagacatgcggaatcgcagcggaaggcgggaggcagctgtgaactgtggctcggcctgcgtccgccctgcgcatgtacactcagagaagatgataatgaaaaagaaagcaaatccaattttcccacttactgttcatataatacagagtccctgagagtctagagtaatgtctcatacaaaaaagaaactcctacgtggtgtgtgtctgaagtctttcatctgccttacagggtttttgctgattcaggcttggcctgaaaacaggacggacctccatgcctttgagaacctagaaatcatacgcggcaggaccaagcaacagtaagttgaccacagccaaagcctggtagattacatttgcctttttagttggaaattaggcttaacaggagagttgctaagatagggcacagagctcctgcatctctcgccggcattcccaaatgctatctcacatgagcaggcacagggagcaagactgcacgaccactggcacaggctgtccgctaaaccacagacttctcagcgctcgccagtgcttctgcttctgtgtccactccagatcccacattgcacttagttgtcaaatcttttcagtccatttctaacctatattagctcctgtgtctttccttgtctttcacggccttgacacttacaaaacgtgtgggtcaggtactttgcacactgtctaaccatgtctgttcagctggtgttttctcaggatgcaattgaggttatgcacatcttatcacagggaccagagagactttttagcaccactcttcaagaatttccactttttcagctttgacagtggaatagacatgcaggtgctcacacacaagcatctttaatatggtaatggtaatcatcagtttagtggtgtggaggaggagatgggaatctcttagtgaaacccgccttggaagcagcctcgttatgagaactgctgcccctacttgactcttaaagcactagataatactgtgcaacattaaagagaataagagtgcgtgaaatatgcattgcctcccataaactcccttggctctgaatctctgatactaaatatgtggctaccgttgcttcccagaaaggcctttttgctctgaattctctggaatgctttctttgaccaagattcttataaaaataagagatttagagcaattttcttggatggctggtatgagccagttggcttagttgtagggatttaaacaagataagggttacttacttttcacatttaatgagaagtctggtgattccagctcctactgagacagggtggccacacgttccagggtgtgactcactgaggccccagacctgccctgcaaggaaaacctggctctgccctggtgtcctggcctccctgggcatatgtgggggagaattcctaatggtattggttacaggctcctatgcgagaccactcatctgtgtaggagaaaggaaaaagatgggggaaagaagagcagcagggagaggagaagcctctggatgatactctaaccccctgccatccaacacctgaacatcagtctcttcatccagtgctctcagctggcccagcccccagcctggggtcagatgagagcttcctgcaaatgcagatctctttcctgtggctccttctcaattacagacagctcctccacaaggtgcactctggccttgtgctccctccccaaaccagcccagccctcccagcctgcatcatcgtggtcctgtaggggctagaggttctcacacccatcgtggtctggcagaggctggtggttctcacacccatcgtggtccggcaggggcttagtggttcttatacccatcgtggttcaggaggggctagtggttctcacacccatcgtggtctggctggggctagtggttctcatgtccaccgcgtgctttcctgctcctccaggtggctgaggacatccccccttcggtctgaatgacttccatccagtcatctgatatacacattggaccacccaatagcatcctagtgtcatgttggatggtgaagaaaatgccacagttactgctttcagggcctcacaaccttgggcatagctttttggaggaaggccccacttcccaggcatccctcccagacctggtcagaggcccctgctctttgcttccatgttgcccacactcactgtgctcttcacaccggctcaaaatgatctgcttacggggttgtgtcaccaccagatcaagcgtcctggagaggaggaaacatatttaacctgcacagaatttgggacagagaacctctagtgtttgttcaataaatatatgaatggatagagggacaggttgggtggtggatagatggatgaacccacacctttgaagtgtatttggctgtttgagaggttagaatatgttctcaatttccaggcaaaatgaaaatggagaaaatataatgacattaaggcattttattcatcctccccatctgccactgggttaaagatactaaataaacaaggaactatcttttgcctggaggaactttaaaaacacctgcagttttcaaaaggtgcagtgtgtgcctcccacagcatgacctaccatcattggaaagcagtttgtagtcaatcaaaggtggtctggagaaacaaagttttcagggatacattgtttttataatttttcaccacatgatttttcttctctccaatgtagtggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcagtaagtcaccgctttctgtttagtttatggagttggttctaatgggtcctttatttgtatttagaatattgaagggctattcccatttaaattacttttttcagttccttaagaagcaaattaaaatcttaagattcctaactgtgaaattaccatgtgaattccattaaaactttttccagatcattaccattcaatgggatgaatttaccctgaggtttaggctaccaattatttgtaatgtaagtaactaaatttagtattagttatattaccttttagttgtaggtcactctctgctcatttcagcctgtaaagactacagctacacacatacacacacagaggaatggaatgagcactttacatcaacacttcctgttctggctctagagcctcagcttttgaagctggtgagagcctggcctgtgctgggccttggccacgggcagcgtcagctttgagtcaagtgctggtctggcctccctagctttgagcctctgtcaattcccttaatctgtttaggctttggcttcctcatccatagaatggagatatgaatgattcctacgccgtagtgctttgagagaattcagtgaaattcctgtgtgtaaaacccttccatggtgcctagcacacagcacacagccaatggcccaatggctcctatcagctgtgggatttgtcatcagaacaccaccagctctgctccaggctgccctgggtaccatcaaaacacaccctgtgcccagcagcacctgctcctctgcacacctggttccttcagcaggggcagtggccgtgggagcacagaaaacatggagtcccatctggtttaattgatgccattgccaaaggggaggactcacggcaccccctctcgggtgccagggtgcctggctcccaccaggaggaagacctgtcctccactgtcaggcacatttcagtcttcccagcagccagcacaactactttgtccttccagtcacggtcggcctctgggaagcccagtctgtgtcctcctccttcaggggtagccagcatgtctgtgtcacccaaggtcatggagcacagggcccctcccgggaaggtgccgtctcctccggcccctcgggtccctgctctgtcactgactgctgtgacccactctgtctccgcagaggccacaggccaggtctgccatgccttgtgctcccccgagggctgctggggcccggagcccagggactgcgtctcttgccggaatgtcagccgaggcagggaatgcgtggacaagtgcaaccttctggaggggtaggaggttatttctttaatccccttgcgttgatcaaaaataaggctccaggttgttgttatagctttacaggcattctgtttgattttctcttccttttattctttgcccttggcttttggaggttttgggttttctgtggggagacgggaagttgtttgattgcgttatttttggcaaatttaagcacaataggaaataagcaagtattattgcctaatataatccaataatttatagaatctcttttcctggaagtatcttaaatttttctaagctacaaaaagttcctaagacaaatgagacagtcatcaatggttcatctagccaacaccgtggccatttgggcttttctttgtagtgcccgattcctggtgtgtgaaaataaattaacacaaattatattgccaagttaatatctgttttatgtgcccccagcatgtgttgaacatcaaacagtaccagggactttaaatatacccacggacaaagaaataattcataatgatgtttgttgaatttagttgcaatcaataaaaagtgcagtttgtgaatgctctgaggttcttgatattgatgtaaggctttgaacgacaaatgaggacaaaacataaataggaaagtaaaactgaaggatagaggccaaggccatgttttagaagatttaaagaaaaagggaaatttggtgagcaccataggaattacagatggctgtaggaattcttcctgttttactctctgggcatggaccacagcttggatccagaaatatttaggagcaggataagaggaccaagttcaattctataggaatcctttagctgataggctcagaacaaatcacataattgatagtgctgcttcaacttcaagtaaggaatattgatgcaatccttacagctacaaatggacagtggtctcatgttttcagttttcaagtgtttcttaagaggcaaggtgatgaaaacgcccacgtggggagccccatgtccttccattagtgtagagaaacctggtgtccagcagcacctgctccctctgcaagcccagcccccttcagcaagggcagtgacccagagaagaagcacagaagacacaaccctgtatcacattttgtttaatggtgccattgaccaaaggggaggatgaaaggcacacacttttttgttgttttttgagacagagtctcacgccatcacccaggctggagtgcagtgatgtgatctcaactcactgcaacctctgccccctgagttcaggtgattctcctgcctcagcctcccaactagctggaattacaggtgtgcaccaccatgtccagctaattttttgtagttttagtagagacggggtttcaccacgttggccaggctggtctcaaactcctgacctcaagtgatctgcccgcctcggcctcccaaagtgttgggattataggcataagccactgcacctagccaaggcacacactttggagaataaacactccttgttcgctgctggagggtagaactatgcttgactactaggcagagtccagtcttactgacaaacagccgtacatctgttctgtcttttcaatcaaacatcagcttcttgcttaacattgatgtgtacatcttgagggatgtcaaaatattgtaagctaagtttttcatacctgtgttccacactcaccatttttagtaataaccattgagcgagttcattctccctccttcctttttctatcacttaatctaaaattatcatttttccagcttaattttgataaccatgaatctggtattagaggcagggaacacctcctcaggactatcttttcttttatcatttggcttgcttacccaatatgcaaaaactatgctgtagaaaaagcagaaaagatatcttgattatgaatgaagctcctgtgtttactcagagagaagatgacccaggattcagttaacaaaatcagctgattatattactatatagtcctggagtcccaactccttgaccattacctcaagttatttggaattttgaagaggtgatttgtgttcctgcaataatgtctcaggggtgggctgacgggtttcctcttcctcctctcagtgagccaagggagtttgtggagaactctgagtgcatacagtgccacccagagtgcctgcctcaggccatgaacatcacctgcacaggacgggtaagagccccttgctgctatccacgtccatttcatgggaagggccttcacagaagccgaacagtgatgatggcccagggcatcctgtgtgggcaggacggccatcagagccacttcccagaggagacggcaggcgctgacagcgctgtccgggcagggtgtcggtgacattagcacacacattagcctgcgatgaacattcactctttctgctgacacccccaaccttatctaagcttatcaaatcctcacatttaacggaggctgttttcacctggtttcccccatccctgacctagtcagcattgctttatcgctttcatcaaacatcctcaaattcttaacattagcttgtaattaattgaagaatttttaaagaaattgctagcaaaactttttaaactgcacaactttgtatctatatgttcaataacatatagatacaatattctttacaataatcttttaaagaatatgagtgagaattcgggcccctctcacaccaaatgtcctgatgttgttaattctcaatgttattatatagggagctctgttttcttgtgagcttcaacagccagttctaaatctactaactgaaaacattttttagacattctctaaattgggcagaagatgacaggactgtgttttgagggataggctgccagcgtggctgcttacaaagtaaagacttggtttataggtttgcatggtgttgggttaaatttctgtcattaaaataattggcgatattgacatagtcatctaattatgctggctctgggcacacacagcccttgagtggacaaaaccaacatgagagaacttagccaaggggaaagcctttccctgctggttttatttctgctacttctgaagtgtggggcacacaacctgagcagtgcttttatttgagtcccaatgcttttatttgagttttgcaaggttattccaagttttacaaatagaaggtagcgtatgactcagtccttgatatgccaaccactgcacagagacttgccaccttcctgtcactggagaaacactcatgtgggttttcttaaatttgcctccctctgagcttccctttaacttcaactataatatgcaagaaagactatctgaccataaatacacatttgggccaatcaagatggttttgccaaggaaagatgcccacaatggttaagcagaatgcaataatgtagagaatatcatttctttcatgctggtgtatatcatatgcattcaaaaacagggagaacttctaagcaactaacagtgaccatatcaagcaggtgcaatcacagaataactggttttctcctttaagaatttttctatcatttggctttccccactcacacacactaaatattttaagtaaaaagttacttccattttgaaagagaaaagaaagagacatgcatgaacatttttctccaccttggtgcagggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggtgagtggaaagtgaaggagaacagaacatttcctctcttgcaaattcagagatcaaaaatgtctcccaagttttccggcaacaaattgccgaggtttgtatttgagtcagttacttaaggtgttttggtccccacagccatgccagtagcaacttgcttgtgagcaggcctcagtgcagtgggaatgactctgccatgcaccgtgtccccggccgggcctgtgttgtgcaatgctgcacatcacaacaggagggtagggggacaaaagagcacaggtcctggcagctgccacagtctccaggggcttttgcgtttctctccagatttctaaggttaacatggggattagctgttttgcaatgaataaaaggtaacattgcctggaatgttgcttaaagacacttttttaaagctagttgattgttaagctgttgctacttaaattaaaactactttgggccagacgcagtggctcacgcctgtaattccagcactttgggattccaaggcaggcagatcacttgaggtcaggagcttgagaccaggctggccaacatggtgaaaccccacctctactaaaaatacacctgtagtcccagctactcaggaggctgaggcaggagaattgcttgaacccgggaggcagaggttgcagtgagccaagatctcgccactgcactccagcctgagcaccaagagcgaaactctgtcgcaaaaaacaaaaacaaaaaaaaaagctactttgactggaattagcagaagcactctgattgtgtgtatcttatttactggaataataaagctgtcaatcaaactggatcccactcaacaatcagaaagagaagttgagctgtcatatagtagttcacacttacttctgtttctcaaaatcctcagctttgtttggaactgttactcattctttctctgaatccatctgtatgagttgtgtgcccttgggcaagggtcttaccttctctgtgcctcactttcttttctgtaaattgggataataatgctgcatagctcacaggatttttatgaccatgagttaagatatgtcatatacttaaaatggtgcctggaaaatggtgaatactgagtcaatgatagcatcattgatggtgggatggtgatgaggaggtgggagtcacaatggtggtgttgatggtggtgatggtggtgaggaggtgggagtcacagtggtggtggtgttgatggtggtgaggaggtgggagtcacaatggtggtggtgatggtgttgatggtggtgaggaggtgggagtcacaatggtggtagtgatgatggtgttgatggtggtgaggaggtgagagtcacaatgttggtggtgttggtggtggtggtggtgaggaggtgggagtcacaatggtggcagtgttggtggtgaggaggtgggagtcacaatggtggtagtgatgatggtgttgatggtggtgaggaggtgagagtcacaatgttggtggtgttgatggtggtgatggtgatgaggaggtgggagtcacaatggtggtgatgagggtggtgatgatgatgaggaggtgggagtcacaatggtgtcagtgttgatggtccgatggtgatgaggaggtgggagtcacaatgttggtggtgttgatggtggtgatgatgatgaggaggtgggagtcacaatggtgtcagtgttgatggtggcgatggtgatgaggaggtgggagtcacaatggtggtggtgatgacggtgttgacagtggtgacgaggcgggagtcacaatggtgtcggtggtgatggtggtgaggaggtgggagtcacaatggtggtggtggtgatggtggtgatggtggtgaggaggtgggagtcacaatggtggtggtgttgatggtggtgatggtggtgaggaggtgggagtcacaatggtggtggtgttgatggtggtgatggtggtgaggaggtgggagtcacagtggtggtggtgatgagggtggtgatggtgatgaggaggtgggagtcacaacgttggtggtgatgatggtgttactggtggtgacgaggtgggagtcacaatggtggtggtggtgatggtggtgaggaggtgggagtcacagtggtggtggtgttgatggtggtgatggtggtgaggaggtgggagtcacagtggtggtggtgttgatggtggtgatggtggtgaggaggtgagagtcacaatggtagtggcgatgatggtgttggtggtgaggaggtggaagtcacggtggtggcgatgatggtggtgaggacgtgggagtaacaacagtggcagtgacggtgattgagacatgatgatgatttgtcaactttctaggaaaacaatcatataatctccaacagtgatatcttaatatcttttccaaaagtatcagatcatattataagggccaagtttccagaataatatcagacataatgacagtggacatcagagcttggcatctaaaggtaatgggaatagctctaatgtctcagcgtgaaaaacaacatttgctattagtctgagatactaattatctagttaaggaagtactcacctatacctagtttttaactgttttttaaaatctggaattgattttgaattttaacaaatatttccctgggaacaatgtaagattcttcatattttcgcctttgggtataccaacatgccagctctgttggccactttgtgagctcgatgaagcatggtataaaagatgctttgctagtgtttcacgtaatctatttctataagcaattttggagctaagcctctgaaacagaattatattatctgtatagaataaatgttttatcttcccccttttctttcttctggaatagatgtgcatcagtatctctgcatcaatatctctatatcagtatctctgtgtcagtgagcatatgttgctgggcttaggggaggtccagaaagtgattgggttttggcattttcaatacacttactttgtataagaaatagtttgccaaatatagaaagaggggatttagtcaagatttaaattaaaaatgttagtggtcatttttctaatgtctttctattttttcccaggtcctaataaatcttcactgtctgactttagtctcccactaaaactgcatttcctttctacaatttcaatttctccctttgcttcaaataaagtcctgacactattcatttga

SEQ ID NO: 52 - DNA, 28200 bp, Homo sapiens
atggcccccgcagcggcgacggggggcagcaccctgcccagtggcttctcggtcttcaccaccttgcccgacttgctcttcatctttgagtttgtgagtggctcctggccggggaagggacggggtgggctgagccgtgcgctctctcgggcgcccagcacagctgtcggacgggatccgctagctgcgcaggttctgggagcatcggggcagcaggcgcagggcggggactaagccagggaagtcccctcccacctccggtcctttgtgcccttctagaccaacagaatgaggggaacagtctacaggactatggaggaaaaactgggttcccaactggggtcagatgtaggcagcggggcagggggggacggctcttggttcgctggtcccaaagctgcgcgcggggcccacttgacgcgcgcagcgccaccgaagctcccgccgcgctttgcgcggttgggtagaagtgcgcagcttttacaagggagaaggtttcgttaaaaaagaaaaaaaaatcagcaagagaaacattagtattaccaaccgagatttggagatgagagggagctgaatccggtttattttcttctggccttttaaagtttctggcgagggaacgtatttgcgaccaattcgatctggaaatgaggccatcgtttgcttggccgcagtccttctgccccgtgtgcggggtgggggtggaggagatggggggtggggggtggggggtggcggcgagagcgatccgcgcgcctcgactgaccttgggcaggcccggggcctctgcacctgcggtcggtcccgccttgcacgcacggtctctgcctgaggctgcaggaaagcgcttcctactgagaactcctgataagcgctcacggtgtcgcgaagccgaagtgacctccctcagcctcaactccccgggggccgctggccttcacctgggaggggtgtgccctgtatgtcctgtgggtgcggtccgtcaccgcctgagggacaccttttccggcaccccaccctcagaagtgtcagcgtggagagttgggcgggaaagaaaatgtcggagcctggctgtttaaaaattggaccccaggttgttattgcctgattggagggggagggtgtgaataccaaagggagcaggtcagttcatccaaagagggcttgcgggcagaggctaagagggctgcggcggcctgggagcagggctaccattgaacttagggtgaaagtccagtcgaacccaaacctgggtggaaccggtgacttgaaatcctagggataggcggaatcaaagcagttacatttagaagaaaccctggacgccaatgaacgcagccccaccgtttacagagagccagccccccgctggcctccttttagaagttcagcatacaagaaggagtgcccctgagagtaggaacagtccagttagacggggcgatctgatctgcgggaaaggtgaccggagactcccacccaacccgccaatgctgcagaaattacaggggcgtgggaaaccttggaaccatctactactggcagcttgctcttccagcgtggctttgtggcctgccggtagcggggcttccagaagaaacaactccccctcgcccagaacgcttctctcagctgacttagaaagtcacttctccacctcacccctgttccccacctcccttcctcacttcccaggagacccgcaatgcatagtcatctccaggcatcttccacatgctctagattaggggtgggctcgcaggtgcctgggagagaagaggagaaagctgaccccaagcctctcagttctcctctgcatggactgtaaatacgaagctgtatatatttgatgtgtggaaggagtggagaattaaagggcctgagaaggcgctggccaccccgggagagtttttgtttttgtttttgtttttgcttttgagacggagtctcgctctgtcgcccaggctggagtgcagtggcgcgatcttggctcactgcaggctccgcctcccgggttcacgccattctcctgcctcagcctcccagctactcgagaggtttttttaattatggaatattacaactcgacaacaaaaagacaacccaattagaaaatggacaatggacttgaacagaggtttctacaaagaagatacacaaatggccaatatgcacataaaaagatgcttaacatcatcaggcattaggaaaactaaattgaaaccacaatgaggccagttgcggtgactcacgcctgtaatcccagcactttgggaggctgaggtgggtggatcacctgaggtcaggagttcgagaccagactgaccaacatggtgaaaccccatctctactaaaaatacaaaaaaaaaaaaaaaaaaaaaaaacccggcttgggtggctcatgcctgtagtcccagctactcagcaggctaaggcatgagcatcgcttgaacctgggaggcagaggttgcagtaagccgagatcatgccgctgcactccagcctgggcaacagagtgagactcggtctcaaaaaaataaattaataagtaaataaattaaataaatagaaagaaagaaatcacaatgagataccacttcacacccattaggatggctactatccaaaaaacggaaaacatcaagtattggatgtggagaaattggaacccttggtatgccactggcgggaatgtgaaatggttcagccactgtggaaaacagtttggtgttccctcaaaaaattaccctctgacccagcaattccactcctgggtatataaccaaaggattccaagcagggactttagtattggcacatgcatgttcatagcagcagtcttcacaataacacacagcccagtggccatcagcaatgaactgaataacaaagtgcgacatatccaaacaatggatactacctgaccatagaaaggaatgaagtactgatacgtgctacaaagttgataaaccttgaaaactctatgctaagcaaaagacacaaggcacaaaatgtcatatagtgtatgattccgtttatataaaatactggaatagataaatccatagagacagaacacaaaccctggtggtttgccagggaccaaggggagcaattgtttaatcgctatgtggtttctttttgggggtaatgaaaatgctttggaattagattgagttggtgggtgcacaacaccatgaatgtactaaatgccactgaactgtcaacttaaaatgattggtttgatgatatgtgaatttcacctcaagtttaaaaaacaaaaaatagaaatatttcaaatgccacagaagaacatatacaatactttaacagacacctacataattattgcccaactttgtcaaatcttaatattttgccttgtttgctgttatgtattaaggaaatgaagctttcagatggcatctaagcctcctagacatccttctgttatcttattctctctctccctccgtcctcagggccacctgtaggctgaatgtggtgttcacttccaagcacaggttagacttttactgcacacatatgaactacacatggcattgttttacatgttttcgcactttatgaaaatgccagcatacagtacgtatccttctgcaacatgctttccaggcaacattatgttctgagatttatacatgttgactttgtttacccagtcttctgttaatagacactttggatagttccaatttgctgcctttagctattgcagacagcattgctaagaacattctcatatttgcctctgtagttacctgttggaaatgtctcccagagacacttggaggatgtgacttgttgggtcacaggggatatgcacattgtcattttcccaggtgttatcacattgccgtccaaaagagtaattccaatttacacaccccaggagcagatttactgggaagctgatgtttaattaagttcaagacccctacttactcaagccccttccaagactctgcctaattttgtattctcttataaagatggtcctcctgattgtttaagcttcaggctaaacctggaccttccccggcccctaccagcagcacatgaaagtcgccattgttcctcatcacttggtagcgtcagactttataattttctgctagtccaatgggtgtgaaatgcttgattattttttaaatctgtagtccactgagttgttgatgactcatagttcagattcccatgcctgacctcccaacagcctgggaggcgcagatgtccaagctgatccgggtggagcgccacttccatggtgaggggactgcccactggagcaagtgagggtggcagctcagggtggggcatagcaacctctccttggcccagcacccctatcccagacctcctgacctctgaaagctgcagagtcctcacaggaagaggaaggcaggcccaactaggaagtgagactgcctttccaaatacctccagagccacagaggctgtgcccctattgcaggtggtgtggtcatcagtgcagccccatataggccaagggtgaaatagccaatgctctcccctcctccaacaaaacccagggctttgcttctcgtctgctcccctgcaaaagtcccacccagtgaggaacttttccttttggagccactctctgtctctgtctccgtctccattctaagccagggacttccttgacactgggccaccattcagggaatgaaaggttcacagggaaggctttctgtctcagctggggcccccagatgcgaggtctcccacagagtgccaggagagaccccctacccattcaggacttgtgaaggaagtgcctgaagagggttgtgagatcatctactcagccccctcctccccaggccacaaaggaggcagggttgtgagtgagggtgtgaggaatgccgcccagccctccaggggcatgcccttcctcctctgtgcctcagaaacacgaacagaagtgcagtcacatcacgggttggggttggggtggggagacacccgcaatcagtttgcagttttgacagttacagtgaactggacagagtaatgactaaaatgacaccttttctgtgacccaaagtgactggactgttattaagagtgaccagagaggtctggggacttctgctagatttctacctggctggggaatagccagcccgacagagccgggactgggccatgggccagcgaggcagtttcgcattaggtggtccaagctgtggctgcactgagaaggtggcatgggaactcctaggagaccagagacgtagaatgacagaaacctcactttcagagctggcagggaactgaggctcagacagggagcaacttgcctgggtcaccgggtctccagggtccagtgagcacttctggcagtgagcagatcatgcccaggcttctcctttcacctaatcagccacacgagattttgcttgcactagaaggcacactgggatcctgagtaggcagccctgcccacctggcagctctgggcaaggcttggtcccttctctcccccaacaggaatgaagggacagctcaggaccactgggaagctcacacctcctctgggtctccttgtcaaaaacacaccctgcaggttctgagtcacgaggtccagggcaggttgaagaacccgcattgcactgcacaccctccactgactggctgagacttggagcggacatctcgaggccaggccaccctcttgatatttttatgggggatagaatagtgggaacagttctcagggagaggctggggcaagcagccaggtgctctgaggttctcacaagtcagaccagggacctcctctgttctggagaaagttccctgctgtgctagctaggagcctctcctacaggcaccagggagtggggcaggccccgcttggccagaatgggatggtggctgagttggccttctctgactgtgtccactggctcctggctctgtcccttctctgtagctatttagagagggctactgcctgatcttccgtgttttctcctctcttcctctctaaagggaggagaagtgttctagacagagatttcacaggggtttggtggagaagtgacttttctggtttttcaagaccagaggctggctttggtgaggactcagtaactttgagctgctccctggaaactgctaagtgtgatgatggggctcatctccacaggattgtcagacatgtgtcatcacacctgagctatattttaaaagattgccttttagcttttcataagtcactcccccacctcacagggatggggcaatgccagaactggtgcaaaggcaccctttctgtcccagtgctttcagaagtgagtaggaagccccacgatgctgctgccagcagcgctcacactcaggtcggccagggacaagggctgaattttgcacctatactcgccacaccagcaggcgaggggcagagcatattgtgctgccagcacagactagctctgcacagccttagcagtggcttggctttgtcctgggcccagacacattctccagagaaggggctgggagtagggactggaccacctgggacctgccttgacacaggacagagccagccagacttgaactagaaggggctgggggctgacttaagccactccagggcttcctcctggcccctccagtgtcagtgccggacatggtgctttggaccagcaggcctcagggacaggtgctgataggacaccccagagggtgtaccctcctggtgttgatgggtgtgaggacagtgggggactgtgccccttgtccttgaagcaggaacgttctggggtgtgtggccagctccttctcacagctttcagattgttcccaagggcatggagcatggagcaggtccctcgtggtctctcatcaatttggaaggctccaaattgcctttgacaccctggtgaaaggtttgatacccagtgagctcctagctgggcatgagcagtgtagccatttcccttcttggggtcatgaacgtgccacactctgcttctctgcagcacttctccccaggctctctgccgctgctacctcattcacagctagtgttctatgccaggattgggtgaatcattttaatgtacccgggccctgggtcctgcaaaacatatgtaggaaatcaaaggaaagcctgtcaccagccacagcacctccgcagcgggaagagaaggtgcagggtcgcacagccagcctcactgacctgcagttcctggccacagcctccagtccctgtgagaatgcagtgggctgggaggggaggggctggaagggcagggggaggagacagaaagtgaaggtcccagaaccaacttggagggaggcccacggggggcccgggaggtgggcactccaggaatagggccacggggaaggacagaagatgacgttccctgacctgtcagtggagtggggcgggtggggtctgcatggcagcccctccctcttcttcagactgaactacaggcctgcatctgccgaagagggagcgggatcctttggcatttcatcttgtgctgtatgtgtcttaaacacaaaccttgctattgttttcctctgaagaaacagaggatattgagactcattgtttcagtggcgggccagggagggagaagccggctgggagtggcctaaagactaagtggttattcgccacttagttaacatggaggaggctccatgttaacgcgcctgtaatcctggcactctgggaggtcaaggtgagaggatcacttgaggtcaggagtttgagatcagcctgggcaacatagcaagaccccatttctacaaaaaatgtaaacaattagccaactatgatggcttgcacccatagtcccagctactcaggaggctgggatgggaggattgcttgagcctggaggtcaaggctgtagtgagctgtgatcgcatcactgccctccagtgtgggtgacagagtgagaacctgtcatcaaaacaaaaatctcatggccatttccaaagctgaccctagacacaagaggtaactgtcacacccatgggggcctggatctgggcctcagccagctcatcaaaggagcacccggcagctgtgggaacgtgggcaggtaactgtgcctcagtttctgcatcagtaaaatttggacatagcagcacctgcctcacatagctactgccccatagctatcaagtgctgttattattagttgactaataatttaagcatctgctctgaaaccaactggccgacctgtgccgatggcagggtccgcaaggcccgcccccatcacctttgccataggtgccctctgttccattctcaggcaggtgctgcatgaggattgggattgggccaggctgtggagggcacacttgacttttccctggagtcaccgagtcctgcacagacaccaccttcctggggccttcccagtggctctcctctcaccaagaaggaacaactgagggcagaggtcagtgtgtcctcagctaagagcttgatggagcagccaaggggtggaggacagtgtggcagccccagcctgccttctgcccagggagcaggctgctttctaagcctctctgcatcaccctgccagcctggtgccaagatgggcaggcagagctttgtggattctgagtgtgacacatagctacatctgcccgcaggcgtaggaatgaattatcagcaggctcagattaaagctttcaaaagcgatttgtcatcagtgtcagtgtgtcggctgtatgcaagggcatcagttcagggagggggcagcctctggcaaaaacctgtgccctcacctcccccagcctccatcctggcccccagctgcttggcaggagggcatagttggattgaggggcctggcaggaaaggaaccgccgagcttatgggtctcaggactatttctaaaaccagccacagacctccttcatctccatctgtggtcaggttgggggcagcagtgggaatgcttctttgttggaggtgaccctttaggcccgagctaacccatcccctccaccgggaagcccacccttctagcaccctttcctggcactcagagcacatcctgcagacctttgcttattgtctgtctcgtgcctacaccctaagtctgcccacatccctggcacagatcaagaactctgaaacatttgttctcagcaagcatcggtagggaaggggctcgggtctcctctctcacctacctaacactgatgaatcataagatgagtccttgacctcaaaggcggacagagggtgaaactgacaaaggctgccagtccccaagagactctgggagttccatctcccttggaccctcccagaccctgggcgggcagccttctgtcgcctctggcaggtgtacacctgttttgttggtttgttcacattactaacctacctggtgactcccataaatcccttttgtttttcttgcatttaagccactcctgtctggtccagcatttccacggattttgccttttacaggtggcttacccagtattttcacagaacctcttggtttctgtttatcctgctgggtaaggccagcaggtgtagatgtggtaggcagaattttccattcaaatgaagacatgcctatcagaaagcccctagatttgtggatctgagaggagtttttgtgcattcaggaactagtgaccatcctctagctcatgagggaggtgggtgttaagtcagcagtcactttgtcctgctggcagcgtgtgctatgggagaggcttccctggggctcaaggggggtgagattgcaagcctgaacagggggctcttcccagtccaacttgccttgttaatataaactatggccctccactcagctcttagattttttttttttttttttttgagacagagtcttgctctgtcgcccaggctggagtgcagtggcatgatctcggctcactgcaacctctgcctcctgggctcacgccattctcctgcctcagcctcctgagtagctgggactacaggcgcccaccaccacacccggctaattttttgtatttttagtagagacggggtttcaccgtgttagccaggatagtctcaatctcctgacctcgtgatccgctcacctcagcctccccaagtgctgggattacaggcgtgagccaccgtgcccagcaacagctcttcgatcttttaatcccaaatctctatccccttcttcacaaactgatccaaacccgctgagtcctgctcttgccttcagattagataaggaacactgtctaaggctagctgggggtgatgatggcatgaggggtccctctgggaggaagaagcctgctaatgaagaggccaggaggggagagtgactggtgtaggtaaaccaagtcaggtcccagccccgctcccagggttctctttggtagcagtcccaggggtcagactcccaataatctgccttttcagttgatgcagggagagggtcaccacccagagaatctcggacccctcccccgatctctcctcatgggctcaggtggggatcttgtgccaactaccgggctctgtacctgtcctgtgtgacgtttggtatctggtcaccattgctcagacactgacactttcaccaggcctgaatccacccttggtggacccagaactgctccagtggggactgtggcaagactgcatgagagaggagaggaagggagagatgggctacgttcattaaagtgtgtctttgaatgagatccatttccctgggtgtgcctgccttagtgttgaccatgccactgtcagcatctgttaaatgcgtgagtgaatgaatgaatgaatgaccaagtgagtgagtcagtgagtgagtaagagagtgagtgactgagtgactaactgagtgactgagtgagtgagtgactgagtgagtgaccaagtgagtgagtgagtggctgagtgagtgaccgagtgagtgactgagtgagtgagtgactgagtgagtgactgagtgactgagtgtgtgagtgagtgacttagtgactgagtgagtgactgaatgggtgagtgagtgagtgagtgactgagtgactgagtgagtaactgagtgggtgagtgagtgactgagtgagtgactgagtgactgagtaggtgagtgactgagtgagtgactgagtgactgagtgaccgagtgagtgagtgactgagtgagtgaatgagtgactgagttactgagtgagtgaatgagtgactgagtgggtgagtgagtgactgagtgggtgagtgactgagtgggtgagtgaatgagtgagtgagtgggtgagtgagtgactgagtgggtgagtgagtgagtgagtgactgagtgagtaactgagtgggtgagtgagtgactgagtgagtgactgagtgactgagtaggtgagtgactgagtgactgagtgaccaagtgagtgagtgactgagtgagtgaatgagtgactgagtgggtgagtgagtgactgactgggtgaatgactgatgggtgagtgaatgagtgagtgagtggctgagtgagtgactgagtgggtgagtgagtgactgagtgagtgagtgactgagtgattgactgagtgagtgagtgactgagtgagtgactgagtgggtgagtgagtgactgagtgactgagtgagtgactgagtgactaactgagtgactgagtgactgagtgagtgactgagtgactgagtgagtgagtgagtgagcaagcgagtgagtgactgagtgagtgagtgagtgactgagtgagtgagtgactgagtgactgagtgagtgagtgggtgagtaacagagtgagtgagtgactaagtaagtgagtgagtgagcaagcgagtgagtgagtgactgactgagtgactgagtgagtgagtgagtgggtgagtgagtgactgagtgagtgactgagtcagtgagtgactgagtgggtgagtgagtgactgagtgagtgactgagtgagtgactgagtgactgtgtgagtgactaagtgagtgagtgagtgactcagtgagtgagtgactgagtgactgagtgtgtgagtgactgactgagtgagtgagagactgagtgaccgagtgggtgagtgagtgacttggtgagtgagtgactgagtgagtgagtgagtaactgagtgagtgagtgactgagtgagtgagtgagtgactgagtgagtgactgagtggatgagtgagtgactgagtgactgtgtgagtgactgagtgagtgagtgagtgactcagtgagtgagtgactgagtgattgagtgtgtgagtgactgactgagtgagtgagagactgagtgaccgagtgggtgagtgacttgatgagtgagtgactgagtggatgagtgagtgactgagtgactgtgtgagttactgagtgagtgagtgagtgactcagtgagtgagtgactgagtgactgagtgtgtgagtgactgactgagtgagtgagagactgagtgaccgagtgggtgagtgagtgacttggtgagtgagtgactgagtgagtgagtgactgagtgagtgagtaactgagtgagtgagtggctaagtgagtgagtgactaagtgagtgagtgagtgagcaagtgagtgagtgactgaatgagtgactgagtgactgagtgagtgactgagtgagtgactgagtgggtgagtgagtgactgagtgagtgagtgagtgactgagtgagtgagtgggtgagtgagtgactgagtgagtgactgagtgactgagtgagtgagtgagtgactgagtgactgagtgagtgactgagtgactgagtgggtgagtgactgagtgagtgagtgagtgactgagtgactgagtgagtgagtgactgtgtgactgagtgagtgactgactgagtgagtgactgagtgactgagtgggtgagtgactgactgagtaagagactgagtgagtaagtgactgactgactgagtgagtgactgagtgagtgagcaagtgagtgagtgactgagtgagtgaccgagtgactgagtgagtgagtgagcaagtgagtgaatgaccgagtgactgagtgagtgactgagtgggtgagtgagtgactgagtgggtgagtgagtgactaagtgagtgactgagtaggtgagtgagtgaccgagtgactgagtgagcaagtgagtgagtgactgagtgagtgaccgagtgactgagtgagtgactgagtgggtgagtcagtgactgagtgagtgagtgactgagtgactgagtgggtgagtgagtgagtgagtgactgattgagtgactgagtgagtgagtgagtaagtgtctgagtgactgagtgagtgagtgagtgagtgagtgactgagtgactgaatgggtgagtgagtgacttggtgagtgagtgagtgactgagtgagtgactgagtgagtgagtgagtgagtgactgagtgactgagtgagtaagtgtctgagtgactgagtgggtgagtgactgagtgagtgactgagtgactgagtgggtgagtgagtgagtgagtgactgagtgagtgagtgagtgagtgactgactgactgactgagtaactgagtgagtgagtgagtgagtgagtgactgagtgaatgggtgagtgagtgagtgactgagtgactgagtgagtgagtgagtgagtgagtgggtgagtgagtgagtaagtgactgagtgactgagtgggtgagtgactgagtgagtgactgagtgactgagtgggtgagtgagtgacttggtaagtgagtgactgagtgagtcagtgactgagtgggtgggtgagtgactgagtgagtgagtgacagtgggtgagtgagtgactgagtgagtgactgagtgaggactgagtgagtgaggactgagtgagtgactgagtgagtgactgagtgactgagtgaggactgagtgagtgactgagtgagtgagtgggtgagtgagcgagtgagtgactgagtgagtgagggaagcttccctctggcttgctgggactgagttccttcgtaccaggaggtaggtagggctaacacaaataaagaagccaaacggtgttactccttgcctctcagaactggaacagagtcccctatcctccctctcagatgcattttcttaggggaagagccgcaggactttgcggaagccttcagcatttaggggtcttgggtcttcccctgacctcctgctctgtgcatattcattctcctaccacctggtgctcggtgccctcttaacttcatccgggcatcaaagcctgttgtgccatttacttgctctacagtagctcatccttaacccagctctacctacctacacacacacacacacacacgtgcattcacatgcacacacatgcatgcacgtgcacacacatatacacaggcatacacaggcacatgcacacatacatatacacatgcatatgcggcaccatacacatacatacacatgcacagacatacacacatacatacatgaatacacacctgcacgcaaacacatacacatgcatacagagaagtacacacatgtgcatacatacacatacttataggcacatgcatgcacatatacacaagcatacatgtacacacacacacacatacacatacatacgcacagaaaaatgcttcctaccctctatctcactcttagaatgattagctttaaatcaatcaacccatagagctgggcaaagcctgctgagcctctcctgaaccacacagttgtttttctggtcagatgacctacacaaaatgtcctcctggcattgaaataacccttggctgctaagacgactcagtgagtgaatagattgccagaaacatgagtggggggtgctcctcctggtggccttgggaaagcacagaagggctgggagcttcccgcagtcctcccagcagacggggatgagtccacatgcctccctcgtctggcggggacatctcttcttttcctttctggggagatgatttttgccacttgacctaagtggcaggggagctcaacaatggtgcacagcctctgttctgtggctggtttcctttacacctcaagaattcaaggcacaaactgttgttcacatatgcctttaaaggcacacaccacgtgctcggtgctgttgggaattctgatgctgggctctggggaccacaccaccaggtgtgtagatggaaagccttgcctgggaagacctctttggttcatgtcttgatgtgtccttggaagaatttccgtttgtggaggccctaacagagtgaaatggagccccagaaaaatatccagagaatttgagcaagccctctgcattgcctctgttacccagccctgcagcggaaacactggggactgtggatgaagagttctttcagccacagggaatggaaactccagacgaatctcaagaatgtgccagagaatgcgtcttcccgtccttgatgaccaggcccgttgttggaaggaaggccggctcatatcttagtgccctttgtgcttccttgtgcgggtcaggcacatttttctcaacttttggtttctggagaccataggttttctctttttgattcttttgaggttgttttaaaattctggctctttttggacaagttttggagtagatgattgtgtgtattgagatcatattcagactgctgggatttttcacatagttacagaagaggctgcttcatctaatgacagttgtgacaacaagcgcttagtggcagccgggtgctggtcccctgcagatataacctgagtcacaactactgttatcactacttttcagatgaggggacagagagattcaataacttgcccagggacagcaggtcacccagctagtgacacagctcacttcaaactcgtcaaccctggctcccaagtgcacacccttaaccacctcttaagcaccctggctgcctcccatgattaatttggaaagaaaacatgagaagcttctccaagttcacacaagagctcccaggaagacaattcctgacagattttttttttcacaaacatcatttcattgggtagaccatggatgtgaactctggaaactttttgtccagttttgtacattaccccatgttcttagagaagctcaactctgctaaccccccgacaactggacagaattaaagatgggtggtttccagctctgtcataccagggttgggaggggcctccaaacgcccatgcaccctctcagtccccatcctgagacagtgaggctgcatctcagagttcagaggaaacccaaggacgagctagtctcatgttccaggcaagaaagggttccaagctcgaggagaagagaggagaggaggggaaaggagaggaaacactagggcgacattttgcactgagaggctgggcaggacctggaggggggcagtcggctggcatcgctggaaggcaggcagggccttgagacaggagccgtttcctcttctgtcttacaggagttacagagcatcgcccatggccttatgttacggcaacacatcacgaggccttggccaagagtctgggacatctgccccatcactctgcttctttcatgggaatcagactctgggcatgagccctgggctttggtggtttttttctaaaggtgccccaggtgacttaatgtatagtcagggctgaggaggatagagtgtttgctgaggccccactcccatcttctaactcaaggccctgggactcagagcactcaacccttatccctctgcagccacccaactggagacctttgagatcacccagccagctgtcccatctctattttgatggacagtaacagggtgcagctgtggggtcggaggaagtctggccagttggcagaaacaaaggggacacagcaccgtgcctccagggtgccaataatgttttcaaaataattgcctctttgcactgccacctggaggctgggagccacctggagtctccttgatgaaaggaaatgcttgaaccctcacatactcccttgctctggacaaatatttggccagcggggtcctgaggccaggctggaacagattgctctgtgcccaggagtgccttaactccctggtgtgggtgcccttcttactctgtttgctctctgtacatttagtaggtggagcagggcaggaaccagatttgactcatggtttacaacaaatctcagctttgcacacagcggggctggaggctcaccctccctggagccccaccttctgctactccttgacccaagcccggctgcccagccttcagcctccaaagccctcacagctgcttcagcatcctctgagcttggcatgtgccctttctgccctctggagagcccctcccagtcctttggcctggttaaccagttaggtccacctctctctccaaggctcgactgaccctatgcacctgtccaggctgctctgcccactcggggctggttgtccacctgcatgttaagtggctgcttatgcatctgtttccactgagctgtcagcctcctgcatgaacgacaacttattcccaggtattggtagtgctgggctcagtgccagaagcttcatactcacatctgtagttttagccagttcacaccagcccccagtgtggggagactgctgtgagttgccatttgcagagaggaagctggggccaagaggcagaatcacttgctgcagcgtcccacagtgacttcggaggacagctcctctgagaacgggagtcccctgccaaggggagggagctggcagggcgcctctgcattagaattctcccagagaagaccgcggcaaaggcctgtgctccaaaggcaaggggcatgactcagctgaggcaacagctgtttctgttccacagacacctagccgggaatgaaatctctcctgactcggctgtgcctttcccgtatcctcctcttcttctcaggattgctcttcaccctcctccgccctgtcccccagatggcccctgtgaccctgggctctgcagtcctccctgggcatctcctgggcagtgctgagcggaaggtcgaccgccccactgcccatcccctgggagcaaacccctggctttcatgatgtcatctgtgctgagacatctgtgactaccttcaccttcatatgtttctgggacaggcaaggactggtgtaagagcgtccctaggaacgtggttcctcagaggcttctgggttggaggctccagggacatgagacacactcacccagggccccctgaatggtggggtccaaaaggggcactgtgcagctgcaacggtagagatattctgtgtaagtccccttgagagagaatttctcacctgaagacattatactaaatgaaagaagtgagccacaaaagtccatatgttgaatgattccattcatatgaaagttcaaaatatggaagtttgtagagatagaaagtagattagtggttgcttggaatgggggcagggaagccacagctcatgggatttctttccaaggtgatgacaatgttccaagattgactgtggtgatggacgcacgtatctgcgaatattctgaaaaccagggaatcataccctttcaatgggggaactgcatgggctgtgaattatagctcataaagctgtttaagaaaagaaaaagataatgtctccccaccatctcactatgaaacatactgctataaatataccatgcaaaggaaaaaagtcggcctcattttttaaaggactcacttgcaaggtgatgcccccagaggctgggtggggtcctgagatctgtcaggagctggggttaaacccatagtgggctttgttctatggacaactgtggacaaggttcccactatagactgcaggaacctgcgagccagtgtggggagcatggaatttcccagggagctggaaaatagtcttcatcaggttggtaaaagcacacactggaacagggcagagtctggcctgacctcaaggccctccgcgcagctgccggaagctcagagcccaggctgtggctgcagccagcaaggtgcacacaggaggctgtgaccagctctccacacactgacttcccctcacttttcctgccattgattcctcacaccagtcacatcttaagccacgtgggaagaatggagtggagtgagatgactctgcagacaggagctgaggactaccttctcagatttgccatttccagctgccatctgtgcattaatttacctcatatgtattttacagttaatttttcccaaaataatgacattgcaaccataagcatagaaacaatgtcactatccggtttacctttgcctatccacgctattagagaactccagacacctggctccaccctgagcccttcttgccttcatcagaaaaaccaaagagagtaaaggaggaggaaaatcgtttcctcactgtgaaattcagtgttcctcgatagcatgtgtataggtcacccgtaagcgcctctggcccacggggtcccactgggattccataacggagtctcttcccaaccatgtgcaacccaagctgctcctttggggtttggttcataagtggctctagttcagccacacccaggtaccaggagaccaaggcccgttagctgacttggacaccgatgcatggctggatgggtcttctcctggtccccaccagtgaggcagctgtgagcaaggcagacctcaagcccaccatcacctggtcagggaaagcgccatgttatccctaacccaatatacctgtgtttgtgctgagtgctacagagaagacgtgcaggactccctgagactgtgtgaacgaggaagcaacttaaattggtcctcctgggagggtcacgtagccaccaggcaaaaggcacttaggagaggggttcccaggccagggcctccctcttcccactggatgtgcccgctggatcctcctcctatttctccatgccaccctcgcatgcctcctgaatccaagccctgcctgtaccaatgtgctcctgtccctccgtcagtgcccgttatggaaaaggccacataatctgttgaatcttaaactcaactgtggatgaaatctacacacacatcttattccatggtggtctgggcatttttatttaattgattttgctcccatttttgtaagatgcacagtgcatcccaccggccctgccacgtgccttcaggcaacctaagatccatcagcagaggacgctttctggtcagagatgcccacatctgattccttagggacaacttggttttaataaatccaaagtcttcattgcactgatttttctacccaaatgcaattctctcctgattgcttctcagtcaagcagctcagagaacacctgtgaagacagcggtatctctcacccagcaggtgggcagcaggtgcagggaggtgggggggtcaaggtgctatgtgaattcaaaccacaggggacataggcctgggagggcagccccatcctcagccccccagacacttctgtagtaccttggagacttttggctgcaaaggaatctccacataggcctggagtgcttcgagcccagtcctcatccaagtggggaacatgtggatgaggctgagctgattcttactgggtgggggtggcgctgggggagatgaggagaagggaaagagaagtgcagaaagtccccgctggggtttgtacacgcctgtccacagtgaggaacggagtttgtacgtacccatccgcggtggggagcgggtttgtatgtgtccatccacggcgaggagcggggctgggctactgaggggtgctactggcccccatgtctgctcctctttgactgtatggggctcactgaccctggcgacatcaactggggtgtattctggataaccacgggactgtactttcctcatgcccatcctcagccatccaaagagacaaggctgtccttggttactccattccaactccaaatctgatcatcagaacacttcctggacttgggaatataaacagttgaatccagaaaaagaaataatgagcaagagaaagaaagagagagaaagagaaagggagagagagagagaaagagaaagggagagagagagagaaaagaaagagagagagagaaagagagagaaagaaagagagaaagagaaagaaagaaagagaaaaaagaaagaaagaaagaagaaagaaagaaagaaaaagaaggaaggaaggagagggagggagggaagaagaaatgaaggaaagagagagagagaaagaaaggaagggcagggcaggggactactgacagtgtggttaatttgttttgccaaataaagaccaaaaagatctgctggtcactaccattgcataaaggaaaggacattttaatatcaaagcaagtaggagggctagaatatcagaagaaatagcagctcttctcatgacaataccaaatggcataaatcctttctcagaatgatgaattacttaacttccacctacctcagtttcctcatctggcaaacaggtcagcattgctcagagggttactgtgagaatcactgagttattatttgtaaagtgcttaggatagtgcctggaatgtaggtctgatataagtgtttgttaaataaaaaaattaaacccatatttaaaaagttactcaggccaggtgcagtggctcacgcctgtaatcccaaccctttgggaggctgaggagggcagatcacctgaggtcaggagttcaagaccagcctggccaacatggtgaaaccccgtctctaccaaaaatagaaaaattagctgggcatggtggcatgcacctgtaatcccagctactcaggaagctgaggcatgagaatcacttgaacccaggaggcagaggttgcagtgagccacacgccactgtactcacgcctgggtgacagagcaagactctgtctcaagaaaaaaaagttttaaaaagttaatcagggcaagcgtgccggggattgggattgagatccagcacagggccctggggggactaaagatgcatttttgcagaggaaaatgcctgccctgttctctttgcctgcttcctgtgtttttgcactccagtcaccccatgtgaccgctggtcgggggcccttcctgggctggggctctcctctaggccaaaactcacccctcctcctcccccgcagatcttcgggggcctggtgtggatcctggtggcctcctccctggtgccctggcccctggtccagggctgggtgatgttcgtgtctgtgttctgcttcgtggccaccaccaccttgatcatcctgtacataattggagcccacggtggagagacttcctgggtcaccttggtgagtccagcccagggtggctgctggttgtaggggggcgcaggaagtactggtccctggcccagtaggatgggcttttccagtgccaggtgagacttctccgtagatgtcaccccaccatgttccaaggctgagcctgcccagggctcctggcagcagaatcaggagaggcaggggcagaggcaaggtcgccgctgccaaccctcactggacctgttctgtgttctcctgcatgactgcctttccatggataaccagctgcccagcccccacaccacctgtacccgccaggtgcctgcctgcccctcccatcacctgcaagggctgttttcacctcaaggcagcagggccccagaggccgaccaaggtgttgggctccagaaattggccctggctctgagggtcaggccatgcttactgtccagctcctcagccactgccttccaagcagggctgccagagagcactgggaaacagaagcggcctttggtcattattctgtataaattctgctttgagacccatgaaaaggtaacttttacatgtaggacacttgcctgttacctgctgtaggggtggtggggccatttggccaaggctgtcactctcaaaagctctgctacttagacttttgaaatcacttccaaatcacaactacacaaaaccctgttttagtacctttttgctttcatttattactttattttgagttgggggtctcattctgtcacccaggctggagtgcagtggcgcaatctcatctcactgcagcctcaacctcccaggctcaagtgatcgtcctgccacagcctcctgagtagctgggactacaggcatgtgccaccacacccagctaagatgtattgttttgtgtagaaatggggatctaactatgtttcccaggctggtctcaagtcctggcctcaagagatcctcctgcaccaatctcccaaagctctaggattacagtcatgagccaccacgcccagcccttttttgcttttaaatataccaggggccaaaaataagcaatgaaacaaaacaaaacaaaacaaaacaaaacgaaagaaacagcatggtcctccctcaccctgcactggtcagcgaggccacacccaacctggactgtggccatgcacgacacttctcagatccaggaccagcttttccctgggacaccccaagctgctggcccttcctccacctctcccttgacccttcctcaggggagaccagtgtcccatccccagcaaagtgctcactctggccccacagcagtgaagtgagactcagcacagcagggcaggcatgggacctccgtgacaaggttgggaggggtgggattcaaaggaagtggggggagaggcaaggggcgggggtggaggggacctcagctctgcatctgggccccgtctctctctccccatccctctgacaccccgtctgccccataggacgcagcctaccactgcaccgctgccctcttttacctcagcgcctcagtcctggaggccctggccaccatcacgatgcaagacggcttcacctacaggcactaccatgaaaacattgctgccgtggtgagtccgggcacctggggctgtgtccacagcgggcggctccgtggctggcagggtgtgtgtggaggctgcctaggcccttggtctgttttcagttcactaacttttgagtgaggtcaaaccttgccttcatgcctggagcaggaaagcccccgagaagggcagtgtcatgttgtgcccaagactccgcttagtcgtccggccagggctgcatgccccaggcctgcgtgggctttgcagagggcagatgtgtgaggggatgcggctgcccagcgccctgtccgagtgctccctgaacaatcttatttaacatccatggcaaccctacaacccaggattatgacacccatctcacagatggagaagtggggccagagagtgtgactggcccaagatcaccagtcattgtgggacctggcatcaacgctggaggcccagtccccacactctcagcaccagtttggggctgtgagtctgacctcatgggtctcctgactctccccaagtggtcgtccattgaagcatccagccaggggtggggacgctgaggccaggtggattttcttcttaatggactggatcagaatgacagggtaacagaatatattgtttcatcacatgtttttcagagctgtgcatgtgtgcccttgcaccagtctacgatataaaacatgcttctgaccatgggtattgttaaaaagtaagaagtttcagaaagagcactcttcagatctctagaacttaacctatgaattatgcaaatcccaaggtagaatgtggtgacagatcctgagataccagctctagtagccaaagctgtgtcatcccctctttttggaaagtgtagggcagaggctgagagaagacccacagataggctttagaaatggggttggtgaagtgcctcttcccactcccagaaggagggccccaggggaaaatccctcaaagcctcacttgctggtccccttgcacagtcccctgccctggggaaaccacacactgccctcaagctcccagcctacaatcgctcccctaaaaagggccccctcaggatcctggcatccccccaggggtcccgcggtgtggaaacatctcccgtgttggcccatctcccaacatggctggtttccaagcagcagcacagccagggggcatcttgactgatcttccttcctggggaggctggtgagccaccctccatcttcttcacacaattccatctcatctccctctcccaagactgcctcatacctcccccatcccagccaagccttctcttttaacaaacatcaacaaagtgtctgacaataatttccataaaattgttgtgaacaaaggttgcgaaatgtagatgggatgtggttagtgggtcagcacttgatggaaaaacccagctaggggaatgaacaccccttcccgctgggcaggtctctagttgagaaccactaggctctactgccttctgactttcctcttttaccttttatcaaaggcagcacacagccagagaggtgtgcagttacaagcccacagcttgatggatttcatacagcgaactccctgtgtggatggtgtctggactaagaattagggccagttaccagcgcacagtctgatgaattctcatagagcaaactccccagtgtagttggcatctggactaagaattagggcctgataaacaactcccagaaatcccctcaagtcctgtccccatcactgtgcacccccaccaccacccaattctgatttctagcaccatgttcagttttgcctgcctttgaacttcatataagtggaattatacagtgggtactcatgtgtggcttctttctctcacccttgtgtttgtgagactcacccaagtggctgggtgtagatgtgggttgtttgttctcattactgtatagtattcccttgtaggaatagaccaacatctatttatccatcccatgactgaccatgttcccatttttttttagttgagttggatagacacgaatatgttcacgcagacaggagcgttagaattgagaaccagagtgttctcagctggcagatgtgcccagataaaaccaccaaggggaaatctgcacggcgttcgatgtaaagtcacacctttcaactcacggtatcaactgcatccgtctgtgagagagaaagaagttcgttactcaggattcaatcccagacccgcccaaccacagcatgcccagtccaggggatacttgggtacagggaggcacctcacaccctctctcacacagcctggttttggaagcagccagcctgcctcacatccactgtgtggctactaattagggtctgttccaagctgagctcctccctctctcctttgtgggtggcggagctgctttgccaaagggaccccagggatgggtggaagtcgcctggggcgagatggaaatttctggagaaatctggaggtttctagattatacaatggtgggcagtgatggctacagtttagggagagggctttctgaagccaaaatttgcccattcgtgcccagctctacgtgttcccagtgggccatttcttgaccccacttggaaaatgagtctccactgctcttcctgctggggacttccaaggtgcttctgccaaaggctttcattggtctggaatgcccaccttttatggagggctgcccactggtgtctgactgctcctgcccagatacgttctcttaaatgtgttattcaataattcagcttactcaccgcctccaggcaatgagggaaagggcttggccaggtgtaggggcaggagagcaggcaccctgagggctgggattgatgagcattttcaggagtcacagaggcgtagccgccctaaatggacgtcgtgcctgagctggaaactcttgacccctaaccaaggtcacaaaaccaggtgcagagattggacttggcagcaggcaggccttcagggagtagggtgatgggagcagacagtgcccaggaggacacagcaagtccccagaaagcagggccatcgctccaagggccacagtggctgactggatggtcccaacagtaaggcccctcctttagacaaaagctcaaaatcccttctccccttctctgtccctcacttcctatgaagtctggctctctcagccacacctgtgatattaagaatcctaaaacaaaataatgatagggtgagaatgtccaggcagcatggagactttcaccagggccagcaaacccaggtatttacaatctctcaaccgagctaccaggaccacagctggagggcgctggtctcactggtgttgggggaggaagttgtccctggagagttacctgcctgagatgctttcattggaggggtctttgaggactccatctcaagtcagccgaaacctcaagctgagacgaatgtgatgctgggtgatagtggagagtcttaccttccacaccagatccaggagactgttaggtcacatggagctctgtactgagaggatttggtgcacacctgggctcagcagggagggcgtccatgtgagggtgagaagcaatgacagcccaagctctctgggtctggccccccctacgccacgtggggctggatgcagtgcagacgctgtgcctcgccctccctacacaaacccattaacggccatttctcttggttccaggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaa

SEQ ID NO: 53 - DNA, 436905 bp, Homo sapiens
ggcgccgggcggccggcgagtctggagcccgcgccgtcgccggccgcgtcctccgggcatggaaggaggcggcaagcccaactcttcgtctaacagccgggacgatggcaacagcgtcttccccgccaaggcgtccgcgacgggcgcggggccggccgcggccgagaagcgcctgggcaccccgccggggggcggcggggccggcgcgaaggagcacggcaactccgtgtgcttcaaggtggacggcggtggcggcggtggcggcggcggcggcggcggcgaggagccggcggggggcttcgaagacgccgaggggccccggcggcagtacggcttcatgcagaggcagttcacctccatgctgcagcccggggtcaacaaattctccctccgcatgtttgggagccagaaggcggtggaaaaggagcaggaaagggttaaaactgcaggcttctggattatccacccttacagtgatttcaggtgagggctcccggtcgccgccccaccctcccttcaggcgcgccctgaaacgcgcttccccgcccttgggtggggggcgtcccggggactaggagggcgggcggggggtggcgctgccggcggcgtcggctcgggctaagcaggctccactcggcgcctccgggtagtttccacccaggaggggctcggaggatgtgctcctgttgcccgggaatcccggacgggctctcctccttggcctcctgaacttcggggacagatcagggaaggatggaggccacggtcaccctcctgggaggaggcgaagttgtacaagggaaacttttacttcagagacgagagcgtgaggaagcgggaagccacccttcctcgcgcggctccctcaagtgtggtctcaaccaggagggaaaaggaggcttctggggctcagaagaagactgggtaaccggagacagcgattcacaagcccgagcagttcctgccgcgctcgcccctggggagtgtgtttagtctgtttttctttataggcgctggttatcctcgctgtgtttactcagaaacagcggccggcaggcaaaagaagggcaatttgcacttggatagtccctgacgtgaggtctcaccaaagccaggcgcttccaggcagggcaggagcgtggcaggaagcctctagttcctgaaacagagagagggggcgttgacagagcccctttctgaaatagagcggcaccctttcttgaccttgactgcaagtctatttcaaaaatctttttcacgtcctccagctcgggaagaaggacaggaaagctgtcagcaggaaaactccgctttggagaattaaaattaagacgttttctgatcttacttgtcgctcaagtattcgttcggtgataagcatatttagagattgtcaaatgaaggtcgtgtagtagatcctcttattagcgtgtgcacgattatcttagctcctgaacaaggctggacttcccattttaaaatccagaactagtaactcctaataactcagggtgatatttatttatttggccgaactcgttcgaaaagaaaagaagaatcaactaaaggagtatgtgcatatactaagtattctttataggataaatatagcaatgtaaagcagccttggagttagtttagaaactaagggaaattgtcaccaactacatgccttaacgggagctgtccacagttctgaatgacattagctgtgaaaaatccacagtcccgccacacaaaggctcagagtgacggtctttgccttctttgagatatttatcgtctcagaaatcagtagcctccgtgatctatgcaaagagtgaatggattttagaaagtgtataattttaaggtacttatttgtaaaaacacacagcaaagtccaaaggagaacttataaaacctaatgacgtttatagtctagagaacattaagagtttgattgaaagaacgttcattaaaaattttaaaaaaaagaaaatgttcatattaaaaagatgtaataaataatcaaacctgtttcctccagtaggaagatagggaagcaaacttataaatgaccctgttctaagatgtataaggttgtcatgttctttagaattttaaaggtgggaatcaagtatagaatattatcttttcctcagtccccaatggaaatatatttcacctcattttaaaatttttaaatgaaaataacttacatgaaaaaagtctccagtcttaatagcaaaaataaatgtggtatttccagaaatgtaccaggttcaatattaacatgcaaaaatgctgaacttttaacatttaatttcactcaataaaatgattacatatgatgcttttattttttcagcaatgtgaaaaggactatcccttatcaaaatgataccacacatcaagtaattaaactttttcccacttgctaaataaaaacatagggccacttttcaggaattagaatagcatgcgaaagtcttttgaatgaatggaattacaggattctccttattttcccaaggaaatcttctgagacaaaatatctctttaataaaaacattgttactgaacaaaggaacaaattgaaatcaggtgatgatttaattttattatccatttcaaagaaatgggaaatgattaaaaactgagctaatactctaaattccagtgtggagtagtttggaatatttgacttttcccttgtataaatggaaaaaagaaaatggcaggcacaaattaagcaattatcattatttagatctttttaaactgaaagatatctgaaaaaatagattttaaaacataattacaatatacactggtgttctaaaacaaactgcaaaaataatcatgtacttgtttacattcagaatatatttacatcttattgtttcatttttttgtatgatctcaaaaccaatataagattttctaaaatctataacgtcaagataatgtaatgaaagaacaaaaataggaaagacaaaattctagcggtagtttttttctacagggaaaggaatgtgtgagtaattttcaacagatactagaaatttttgcggtcatgatctagcctttactttaggccctttcctgaaggattatttcagggaggtgctttactacaattcctaaaatgtcaaacttaagttcattaatcatttaacaactgagtgaatgacacttaagagtaatttctatgaagagtggggagttattacaaatgaagatatccagaggattcttttccttgacacttttaataaacctttacatggccagagaagtttactatgttcttactccagggcatgtcgtgactttaacactgtttctagtttccctgctcacgataatttttaagactgatagctttctactttacttacctcaagggacaaggctgtgctcccactgagactttcagagagctagctagtgcctcttttccccaccagagcccaagagtgctattgctgtgtctggcaggtagttttctctacccctggcgtaagtagggcagagttgctgtatttacctttttcctcagcagaggatgacaatagaaaccttcagagagtaaaaagcagtccaatagtataggtactgtttgaaataactgggtggaagctacagaatttagtaaacacaacaagctcatgtttttgtttatgctgtggtatataagcacccaaactagggaaaatagggatagttacttaaaaacaaatgtagctcgatttttctgtagtgacagtatggtcttagtcttattgaatttcatgtgaacaacacatagacacatttaatttggaggttaaatatgatttttaaaaattcatggtgattttatattaattagctagaattttactaaggtttaaaagtgatgcttggcaagcattgtgcttccatagccaattgatagttatgatataatcatttaaataggttgaaagaatatttagaatacttttgtggatgatttttattatgcaagcaatttatcttggaagaatttatcaccagactatttgccattttagggattctgtcattattttgttccatcatgcttacacaaagggacttttaaaaagaatgctcctttccatatgtattgccagccaacatcttgctcctcataacggaggcagttttgtatcttgacttcttatttttttcaatttcttttcatcattagtatgagtgtgtgaaaagcttattttgttgtaagtactcaaggactctagagatgggagttacttcctgaagataccgtcacatccgttcttccatctctgctttgaattgcagccacaactgtactgatatcagagatcactgatgtgttcattagggaagggaggcttcacccatattatacagttcataatagagagaacatttgcttccaggagcttctcacaagaaaacaattcaaccttctagggtttaaagacgaattagcctactgttatgttatctttgtgctgaacacactctgtatctgccagcaatgcttattttatttgcttttcatatcaacatagccaaaattaaccataagaatttattttttttctatgttaggtgaacctttttgtgctttaagttcaattacatttttcttagtggctctagcaactgttagacacaacatgaaatttcttcaaagatttaaacgtgtgaatttatttagttactttttcttagtatacatgtaagttatgcaactttaaattttagcaaatgtttcactgttgcatttagtagatattatgatttatactattaaaatattataagatagttttcatttttttctgagcaactttccctttaaacctccttcggggtatgattataaattgagaatcagtaaagaggtacactttactaatcatatttaattatgtggacttgggtttatgaacgtgcctgttgaataatgaaagaaatttaaatgcactggaaagatatattacttattatttgtatcataggttcatttaagaaaattatattcaactatatctgcttgatcaaaaaccacaaaccaaaacaacatcaccaccacaaagcaagataaatagtatttgtaattctgcattattatactcaatgcacctatgtcctatagtgagcaggaaaccagcagaatgcatttagtatgattttcaggtgataatcttatcattctgaatataattcttgtgtttagcagataattcacttcattatttagaaacaacaattgggctccggaaaagaactttcaaatagagtctcttgtaagtacagtgcaaattattgcagatcattagcactacatgaagagtactgagcatttgcagggtctgtgacaaattttcattttatcattttgtgtaaaggagtaacaaactatgaattaggctgacactatatattttagttgtagaaatagtgataataaagaaaaaagtctgcatgcactatgaaaattatattttctctaagtacttttcttctaaaaataattttctttgtgaaggcatctggatgtacaacttaccattagttttacaggaaaaaaaaatcaggattcctggtgcatcctggaattttatgtttttgcaaaataaaccttcatggctctgttaattctatttgtatatatgtgctacagaaactattcaagggactttgtagaagaatatatatagaagtaaagaatatatatagaagttgattatttttgagttgagtgtttatctgacacatttcacccaactttgataagattgatttcatgactctttcaagttatgttagttagttttctcatagtatttttctattttgtctaatagttgaccacgcagttaaagcaaggaagcaacattactcatgctttaaatttacaacttataattttatttatataaacctaattttattttcaggtcactagctgtaactctaaaaacataaggctaattttacatacatacaaagttagtaaatatttataaattttagactatcagctttgttgtatacagttattcagtattttttaaaaagtgctgcaacaaacatcttcgcaccttactcttcattgttttggctaaagttcagggaatggaatgactgcctatgaacattctagagattctatacatattgatttgaccaattaatactgcctccagtttacagatttcttaaaatgacacgaataacgtaggttctccaaggttgacattcctgttatgatatttacaggctgttttaggacagaaaatgtaacctgtcctccatttcattcaacatagagtgacaagagtgatctttaaaaagcaaatctaataatattgttatgctctttaaaacctttagtaacttcccattactgttagactacattggacaaactttctatgagcttcaagaccctgcataatttcagccgatatatgcagcctcattacatgccactcattccagctctgtgttccagccacttgggtaaatttttagctcctagaacaacctgagttctctcctgcaactaagattttaatgtgacattacccccaagcttgaaatactcttttcactttttatcactccacataactagtttctactcatcttttagatttccatttaatcattgtgcacacacttatttttctatctaggctttctgttcagcagaatttataattatttttatatgtgtcctttccctggaatttaaaccatgctaccttatgaatcttactcagttttacattcccaatgttgtaaaaatgcacataatagacttttcttgccaaactttcttagaggcttcatttttttttcttcaacttttattttaacttcaggggtaaatgtgtgggatgtgcaggtttgttaaataggtaaacatgtgccatggtagtttgctgcacagatcatcccatcacctaattattacatacagatatggtttatttttaacagcttttttgagacaaaattcatataccatacaattcacccatttaaagtaagcaattcaatattttctagtaagttcacagttatgcagccatcaccacaatcaattttagaatattttgtcatcctaaggagaaaccccatatgcattagcactcactttctctcctctcccgccctcccgctcagccttaagcaaccactaatcctctctctgtctctgtagatttttgcttattctgaatattttatatcagtgaagtcatgcaatatatagtattttttattggcttctttcacttagcataatgttttttcaaggttcattcatgctgttacctgtgtcagtactttattcatttccttgctgaataacattccattttatggatatactacctttaatttattcatttatcagttgatggacatctgagttgtttctgctttttggttattgtaaatactgctgatatgaatattctcgtacaagtttttgcacagagatgttttcatttctctttggagtgaaatttctaggtcatcataacagacctgtaataaatatttattgactgaatggacaaagaattattctccaagcaggtcatgagaacatttaatcttagagttaataaattcagatgaaagcaatgaaagctcttattttttcctacagtaatacctggcatctccttcccactggcacctgcaagtatgtgccccaactattacatttccctgcccaatacacagatgaataaatgaaactgcagagaagttatgtagcgtgaacatggtgacatagatagatagtaagaactgggccaggaattcagttcttgtgaatattaattttgtcacttcaactcttttacataataagaaacaaggctgccagtataaataattctccaaaccttctgggaaacgtgatggattgaacctaatcatttatacttcctccctcttgaagtcactccaaaataatatgaaaaagcacagacacattggtaagtagaagaaagaggagacatcagagaatatagatctcaagaacatttgtaaaataggaagttaatggacaaattattccacttccacaatccttcacccattgaaatccagaagaattcaggacttggaaatgccagttatgaaatagttccaggaaagccagactgaaaacagaattaaataagggtttccttagtgaatacagaactccctgtgctcacattaggatgcttggagccaggccaatttttctcagtcgggaaactggagaaaatacctccaaagggagacatttcaaagtcttcagataaaaaatcatgtttattgcctaatcactctgcaaaaattcccgcatgtgtacattgaggctgtgattatatttttggtatggcattggttaatatggaactgaaagcaaaagataaccagacatttgagaaaagtctcatgagggaagactaaatcaagcagagaaagactaaatcaaacagccaaagaaggtccagagggatggcataaggagaaatgacagtattataaaaaatactccacaaatgatatcttcataaatattttatctgcacaataagaacacgttgctatgaaaaaaatagtaagaaatttaaaaaacagctcttggatgaaatgtgttagcagataaagtctaggaagcccgttagaattagaacaaaaagacaaaagggaataggaaatataagaaaatatagcaaaaccaataactaatttataaggtcaaaatctaccataaggtattctagaatgataaaaaagtgaaaatggacatatggaattaatagagacatttttgataaaattttccagatagcagcaactgaaatgtctgttctgaggaacttatggaatacttagcatcatgaaagaaaaagactgtccaaggatcattacacagaagctttacaacaccattgaataagcaacaaacaaacaaatgactaagacttttcaaagaaaaagttacatatcaagaagtgggaataatactttaaggtaaatgacgatgtaacaaagtctgcaaaattctgagagaaagtaatctccataagaaatccataccttgccataatacaaaatttaaataaagatattcagaaattaagaactctagtattaactacccatgtaccctttcttagaaagttattagatgacatgttcctgcaaaacaagaaattacaccaaacaacatgaagacatagaagctaggaaatgggctctaacacagagaaacctgaagtcccaggagtactccaaaatagctagccttgaaagaaaccagtccagactggggcggtaaagcaaagcgttctggaggaaggccttcagggtaggaaaaacaaatagatggatatcagcatttgataaataatgttactaggtgttccagagatcatttggaacaatatattgatgactttcatattttgtagagtacattggagacaagtaaataaacaaaagaactttattaactccagaatgatctaaaggtgtctaaaaaagggaaaagaatcacagttccttgcttggttcaacagtacctaatggttatttggtcataataatgtaaacaagttgactgttttaaataaagattgtggtgcaattattctaggttggtgggagggcaggagaaacgtaaatgtggtttgggtgatgtcagaaagctaagtccttgtgttccacagttggcagctaatgaatagtatttaaaattgataaattaatttgtctttgaaatatgaactaaacactaaaagaaacaattatggtggttgaatttggaaagtgatatgtagggtaaaaggaaaagggagaggcttatatgttctccttataatccttgatgctgttttgcttaaaaaaaaaaaagactgggcatatattattttgaggtaacaatattaggaactgtttgggtcagaatctgagcttcaccaccttagtaactggaccttaattttctcaattataatagaaaaaaatatatatatatgtaaaattcatggggtatatagtatatatagtgtgtatatatactgtatatgctatataaacatttctatatatgtagtgcttagaagttatgctctgcatttaatgctatttaagagttagttatttgtatgagtgtaaaattaaaacagaattaaggcatgttagttgtttgaaaaattaaatattctctaagtacatactctaaccgtttccataatttctgaagaaaaaaatatatgaaggaatggccatgtaaatggtgtgctgctatttcctttttaccttcatgcaatccctggcagcagaagccctgatgtgcaatgccatattttatatatgctgtgtgaaattggtctagtcatgaggcagttagcactggaaaacttttttttttttttgagatggagtttcgttctttttgcccaggctggagtgcaatggcacgatgttggctcaccgcaacctctgcctcctgtgtttaagcgattctcctgcctcagcctcccaagtagctgggattacaggcatgtgccaccacgcccagctaattttgtatttttgttagagatgggtttctccatgttggtcaggctgatctcaaattcctgaccttgggtgatccgcccggctcggcctcctaaagtgctgacgttacaggcatgagacactgcttccggacggaaaacttttaatatatcctgtttctgcaaaattttccagtttaatctctttagttggtatagaatgctaccgtattgaacatttggaaatagcttttagggaaaattataatggcattcattgggttgcatgtgctactttctgttcatctttcttttcatcagaaaatggcatagttaaaccatttgggatgttatttcaaatcagttaagtattacatatgaggcaaataagatgagttataacctgataaatctttccttttcttttttattgtcatgtttaacagtctaaaaattgttatttagaaatataattatttctagttaggaacgtaaaagaatttgagaaatctataaatttgacagaattaaaagaaatctttgtgatatcatttctagagcagttgtcacttatacccttgcagaatgttttagccttattttattaaaaagacaatgcaccttattaaaatttacactacctaggttgtttgaggaacatgagcagagactgaaaaaatgaatatagaaagttacttgattagttttttgtttatttgttttttgagacagagtcttgctttgttacacagggtggagtgcagtggcatgatcacggctcactgcaacctccgcctcctgggttcaagcaattctctttcctcagcttccagagtaactggaattacaggcatgcaccaaccacacctagctagtttttgtattttcagtagagatggggttttaccatgttggtcaggctggtcttgagctcctgacctcaagcaatccacccaccttggcctaccaaagtgctgggtttacaggcgtgagccaccgtgcctggcctatttgattagtttttaaagggagaacaactgttccttatttttcctatagaatagtcattctttgtttaaatagtattttttaaaagttgtctctttttctaaacaataaatttgatatttaccctgaatatccatgtaagtgaattagaatgaaaagtttggacacctgtattttctgtgatctggatatatatctaatgtataaaaagcagaaatacatgctagaagcaccaagttatggttgaataagtattgcacaatataaataatcccataattctattggctataattactgattatactaatcattcatgattagccatttgtgttagtgattctaggcttgaagactcataaaatacttcacaaatcacattaaagctattgaccctctgacccatgcatttatttacaatattttgcctgtaatttcaaagatttgtagtttccttgaagcacatttatttttggaacccaaattaagacttcctgaactatctaatattgtcatgaagaaatagagacactaaaaacagtgtatggacgattcaaagatagagacttttgcttgggcaagctacttaagaattatagctgaagcgggaccaggcacggtggctcatgcctgtaatcctagcactttgggaggctgaggcgggcagctctcttgagctcaggagtttcagaccagcctgggcaacatggcgagaccccgtctctacaaaatatacaaaaattaggcaggcatggagatgcatgcctgtagtcccagcaacttgggaggctggggtgggaagatcacttgatcccagcaggttgaggcttcagtgagccaagatgacaccactgcactccatccaggctaaatgacaaagtgaaaccctgtatcaaaaaaaaaaaagacaaaacatatgtgtgtgtgtgtgtatatatatatatatttaactggctagaaggagtttccttgagagggagagaattctctataaacaactggtttagttttgaggctagctacctggtgagcaggaattgaagagagacttgttctggataggtcaggcaatacaataaggcacacaattctaactagaaatatacttgggtgaaaggaacctaaattattttttgtgaacattaaagagttgattgaaccaacagataaattatggagttaactgctaagttcagtaagatggctgcttctaagataaatacattaagatatatcagtaactttcctatatatcaacaatgattggaatctataaaagaaaagaaaatcactgactaaaaaaactaaaaacataagctatataccctaatttggaattagaaaaatgatttactgaaataattgagtaaaatccatttttattatttttcagcaaagttaaatccaaagttaggtttaaatttataaatggtaaaaaaaaataaaaaaattaatttataaatggtaaaaataactgaaatcagaaatcctagaaaaatattagtgaattatttaataataaagctatggagggggagcttgccaccatatgacactaaagactgtaaattattctaacctttctaaaggtcagcttgatactttatattttacaaatattgaaaatgtatagggtagtaagttattgtaaagaaaaaatatgacaagattgcaaagacatgagaacaaagatgattcctgtggtatttttcataatagcacaaaattataaacaaatataatctcattaaaatttcaacatattttaaactccaggttatcatctatttctcatatctctgccttttttttcatagaacatgtcacaatttacacaatttatcatacttaatgtttcgtttctttacttcgagtattgtttatcaccccctccatctggaatttaaggcccactaagatgaggtgcttttttttgtttgtttgtttttttactgtttgaattactgcactcccaggctcccaaagctagaagtaagcagagtataaagtaggcacttaataaatttgaaaaaataaagagacttttagcaatattatgcttaactttggtttttatatataatttccaacaacctttttccctatgtgccctataaaaaacaataatttagtgtggacatttaatctgcattttattccttcacagaaacatacatttggaaataagagttgaagccattacaattaaataaatgcatatttctatgagctctatttactataatgcttggttttatgtagtttttaaaattgggatatatatatgtgtatatatatatatatatgtatatatatatatatgatatcttgttgtcttagttcttttgagctgctataagaaaataccatagactgtgtggattataaacaacagaaatttatttctgatggttctgtaggctggaaagtgcaagatcaaggtgctggttgatttgctatctggtgtgagtctgcttgtcacaaatggctgtcttttcactataacctagcagggtagaaggggtgagggatctcttttaggagggcaccaaacccattcatgaaggctctatcctcatgacctaatcacctcccaaaggcccctcctcccaacaccactatcatgtgggttaggacttcaacacatgaattttagggagacataaacattctatctattgtatttggcatggcccttctttcacagccctataaaaactatttaaatgtcattgcctttagaatcagtgctgtcttaatcaaaataaagttgagaatgtatccctttgggcaatgacatttagaaataattacattacttttaggtatgtatcatttattttctgttccactttgccaaattgtgctatttgatttaacagtgcacctttaaaaccttattgtacagggatggaaaggtaacattatgttcctcttggcttaattaataaaatattgagtcaatattttgaaaaaggatttttttaaattttaactttttggtgaccaggattttttttttatcgtgtttaccaaatttacagtgaagaaataatattccagtgaaaaacgtcctgagtgagcagtgttaaattagcccttgtgtaaatagaaaatatatcatagatcttagtaaaggaaattgaagttgacatgattttcaaaagcaaaaagaacttgagtctgaaaagatgcaaaactaagatgtcagcttagtttttgcatataaaagacagagcaagatcaaaatccaaacaaacaaacaaacaaaaaatcatgggcaactttacaggaaaactatccccagcaacctgaaaaataagtgacacaaaccttcaacaactgcaagacctgattttgcgctatgtgttggaggaaggaagcagtggtaagcaagggtgtctgacaaagctgagaatatgggagactcccacgcagccaacaggaatgggatggaacagcagctgaaactgggatggaatttgcacaattggtctgccttaatttgaagaggagaaatgtgtgatcccagttcttgggcaggcaatgtatctgaagagcctggaaaaacttgacataccagatattaaggaggttatcaaagactaccagggtaatagcaaaaagaatcaggatcccacttgaagaagccaaagataagcttcaaaaagggtaagaatttctatgatttcaaacccatcagatgtttaaatttgagttcataatgatgtaaaaaatgattacctaccttcacctaatacatgaagagataatataattagaaaagcataattttaccaaccctatttaattaatgagcctcacaataaaaaggaaggggaaaaaggaagaggtcttaattttgaaaaggaaagatcaaggctataattaaaggacagtacaatattattatttatctttctgttttactcacagatcttatttgtatttccaacaaaactctaataatactgaggcaaaaaaacttaatgcaactttatgcagggaaaatatcccagacatagtctcagaaggatcagaatcttaactctttttattggatttgaatggattttccctcttttctgaagagtgaaaactttcatggctaccaacattttgggatgcaaatctttttattatttggttcatgtagttcaaatagaaaggaggtattatgtaatggaattgaggaagcctaataaattcaaatcataaataatcaatacttttttagtataaattttataaaatagcaattctttacttgttcattgttacactgttgtgattccagaaagcgtaaagcattttcaggcttgttttgaaagtcagtcaaatgtagaattattttagaattgcacgtcttctaagtgtacaaagagaaaaatccactggaaaacagcaaaataatttagttgactgcaatgtggcactgcttttacatttctttcctatgtaaaataaaactgatatatattccttctgtatcaacaaatcatgttggaaagagagagaaaagctcttaacctactttcctattttcaatttttaactttatcatgcttgttaattgcctgggtgtcctttaaccatctagttccatgattctttcccagaggcttggtttaattttaatagtgcagtgtattcagccctaattatgagagctcactgcaggcaaacagcaagagatagtaatgaccaaaatgtgttcttaaatcagtgtcacagcaacaacaggcccattgctatagacatttacgaaatacagccatgtaaggcaatatttagaagctagtgacatttgaaaatagcatttctcccaagaaacaattttattaaatgtgattttttaaatatctactttttgtattgaaagtacaattttttatcaattaaagccagtccaacactcacatatttaaattctttcataatcaataactagacttgagatggttccatgacttcacctgagttagaatgttcacaaaatacgctgtgtgactagaaatactgtcatttttattgaaatgcatgcttctatgttgttttaaatacccaaaataagtagagattttaagcattctccatcatagttatttttacatttatttagctgggggacgatttcctgctgaaatgttgttttaactggtcacacgggaaaggcaacacagtcagtgagatattctacaaaaagtgttccaaatgcagtattagctgctaagttctaactaggtgccaggtgctagtccaggtgtctttatttctgttacctcactgagtccttagagcaaccctatgacaggtactgtttgtttcctatttcagcttagaaaactgaactatggaaaagttaggcagttataatgatagcttataaatggagaaactaacatttgaacacagagacctggctcagagcccaatatcttaaccactatgctttgtcccagaggtattcagtcatatgctgatccaatgacttagtcattttctcagacttttaaatttatacacttttaggaattatacatattttttgttctgggtatatgaattctagttatttaggtgatattctccagtgggaaatggtgcctttttagtcaaagattggctacaattttctgggagcttcatttgtagttcatcatgttggattagatcctatgtgttaaaacctaactacttcagatgctcatttgtttttgcaaaatgttaaatatttgacagtaaagagttaagggcaaatcttgaaaatagaaatgttcttattcaggaagacatgtaaaaaagaaacaaaacttctttagactgtacttaagtttaatactccagaaaactacaagaaccaatgaaaacattcttcctagaaatacttttaatttcctttcattatgtgtttctgtatccttttgaatggtggtgcttaagtaccaaaatgaacagactatttaaatgaaaatagcaaagaagagctgtactcacgatgaagtcattgggaggcacatgaaaatagaaggaggctctaaaactttagccacaaatattgaggagagacgcagttattatacaaaaaggtcagtgtttgtcattaggttgcaatctaccactatataaatgttatgtattagcttataaattggagtttattataataataatggattacaattgcttggtaaaatttaggagagttgttattagactttgagtctgctaaagaaaaggcaactgagaaaagcaagaaacaatgcatacggtttcagatggcagatgcccaagaaattcctccattaactatggtaccgttgtacctctgagactgttccttctggtttcttgtggtctgatagcaggatatttcacctaagggaatcactgcatccaaaataattatttcataagtagccatcacttatttggactgtagagctatgtaaataatccgaggaagccgaaccccaaacagaattagaaagaaacagatgtactggagaatttgggaaaatgctactaaaacttttctgtttaacgttatagtgtgtgtgtgtatgtgtgtgtgtgtgtgtgtgtgtgtatgtgtgtgtgtatgtgtttaatctttggaaagatgaggtaggtatcaccagtcttcaagatcagactatgctgtaataatggataatttaaaaatacatttcatttatcctcctaacttgagtaaatttaaatgtaaattctttctctataagaaacatgctcaaaacattttaatgtaaattaaaacaaacccttggctctcagttatgtttgctacttctgtggttgacgtttgaccttcccagactttaagaaaggggaacttagatttactcgctctctttctctctcttgcttgtcattactctttaatcctgtattaccatttctgtaaccctttcattcctaccttgaagaaataaacaaaacagaacaacaaaatgaaattaaacaagccaaataagtaaacagtaaatgtcatttaacctccttctttttaaatataacacacacttcctagaatttatttaatttaaccccttagtggcacttaataccccttttggaggtctctgtttcttttctctttggattgttttcctacatgtctgcacactgcttctcaaatttcccccaaggctccagcccttttgcatttagttttcacctttagacaaggctctacagataggcaatttgcttcaatacaggttcttgatcacctagtatgtgccagccactgctcaaccagagtagagcagtgaagaagtcagatatcactctatttttttgtgaacttccaatcttgtgaggaagacatgcagaaaagaagtaatgagaggttatcactgataacaaaggaagactacagggtaatatgtggcagggtagagctaggggtttcatctaatccaaggggttaggaaagcctccatgaagatgtgggagttgaacttagaattcaaagacaaataggaattagccacatgtttcaggcatctgtgaagacagaactgaatacttggcaagttaaagttataatgaagcaactgctgaaaaaaattttgaatcatttcccaccagtattagttggattatatgatatatggattgctagtagatagacagattgatggctagatgatagctgatcgacagatggtaggtaataattaactacctctcaaggataatactgcatgtccatttcttctataatgtgtcatcacaacctttgcccatttttcctctgttatgattgtatttgaatatatttccattcaaggttaagatttcccacaaatctttcaacatgtaaatgaccattcctttactttgcattctcttagaacttatttataattcatatctcattatcttgagactgcaaatattctctggttattttagaccttctattctttcctgtattttatttcagattccttccagagcatttatgtcttctacctccttttgatttagtttccttccattatcatttatctgaatggcctaagtgtcttgttccaagacatgctccaaacatatcttgctctgaacatgttaaaaatttttctcctgattttcttgtacagaaatacaaataaaaaatattttaatagtataattatggatatactttacttaatatgatctctaatgtatctgattgaccaataaaaatataaggtgtatatagatttgcttatgcatatatgtgtgtatttgtctagtgcaagttatgtctatattctttatgtacttataagacacatattacaatatggttgatttcctgaagatgtcataggcaatattcatgatgaaaaagcaggtcatactggaaaagcttaagtgacaaagtatatgtgaaaatttgaagtaaagtgatatctcaaaaataaatatgagaataaagcttgtttatatgaagttcaaccatataaaaatatacatacacatacatgcactcacatcctttataaatcatgtgaagcagggatgcatgcacacaactgcaatggacagttccatatttgtcttgatctaatcaatgaccaacaggactgagtcttggaaaagttgtgaagtgtgataatccttggtttgctcaccaaccttttcttacagcatttctcttttcactcttgagcttatcttatattaaaacagaaaaggacctgacatcaaccatttattcatgctatttagattgaagtatattcacactgaaatgactttattgaacttttatactttaagtttttatgtctaatggtataacataattgttcacaatggaaggaaatgaacaaactgcttggatgcaagtgggtgatgggagctatagagatggccttgaaatcatattagctttacttggctctttgtgaagctaaaggtgatttaatactttggaatggtccagggaatggtcaaaaggtactgtccagtttgaaaaaatggggcagatgttgaagaacataaatttgtcttgctatctttggcataattgtgtgatttttttctctactagttcagcatgcctgtgtgtatagagagaatttagatgataggctcaaaccacatttgggttttggcttttggatgtgtttgaatcaaggatcactagtgactcagtggggctagagaatgagtgttctggataattcccattatgagatccagtgtgtttagggaaggaacagccaacaaaggtttgtatgggtaatagataaaatgtgactagcagacagaatgagagaaaggacttggctggcctaggatatcttaagggacaaaagttgatctcatgccacatctgaattgggggccaagctactatcagactcgatataagatgggttctacacattatctgtaggtatgtgacagtatgcttcttgcaggatatatgtgataaaattcagagtagtagtgagaacactggttccatcagggtcatcaagtcatattttctgggaaaccatattgccacttatatatattttctaagtagcaatagttgggaatcctgaagttatgtgccacctacatacaacatatagtaagtacttatatatgcatgcatatcttattatttttattttaaatagttaaaattttttatagagatattgtcttgttatgttggccaggctggcctagaactcctggtttccttccagcaatcctcctaccttagccttccaaagtgttaggattacacgagtgagccactacacccagcccatgcatatcttattgaaaatgcatttattctatactttcttattttaaattccacaaatattgtttattgtactctaaaatgtattaataaaacattcagcatgtgtgacattgaaaaatcttgtcaactgataacattggctttcaatttatctataatgactaaaaatacagttgatattaaattaagtgtaagttgtagaagaggacacaaattttcttaagttgtatctaataaatggcattatattaatacttgtgtaattaacaaaataaatattctctttcattcttgcaaaactttgttagagttcataacataagcttaacataaaattataaacaaatactgtgtatatgtagatagaagatctgtataagatcaatcacagaagattcctagaatgaatgttttcctctttttattcattatccttttatttagtgattttgatagctgccttctcagagagttctgtggcacttaaaatatagacttctaagttctcctcataaaattgttttaaattattaagttttaactagagaaagtttaggattatagttatttatcccaaagagctaatttatataattcatagaaagcaacttaaggcatatatgtgatatatctatatatctatatatatacatatatatcaactaaaagccaatgaaaactagcattttaatattaacttttaaaacataactatcccatggaaagctgagtataataactaaaaggttttcacttaatgccttggtatggtcttttgtcaaagagaaaaatttattttgccttaaacattacacaagagatttcacttaacatacgtaattaacaatgggaaattatttaggggcacataatttcatacttgaaatcacgtttcatgaaataaattagtattagaatttcatacttgaaatcatgattcatgaaataagttagtactagaatgattctgctgtgcctttcttttggtagagagcatatggtcaattttgtgacctttgattaaggggtctattttaaaatgtcttatcagttaattgtagctatagaaaactttatttgaagacaaatacatttctttatcacctctaacccctacttgtgatactgatataagcaaagaattgtattactcaaaaaagccactaatgagtagggatgcttgggtggaatttgaaaagataatctaaagagcttctagtggccaaagatggaacaaattgaacaactgaataataaactaggattgagttataaacccaaagtataatgtaagtatccatgagatcatactgatataaaaagtattgaatcaataaataaatggtgtggggggactcaaataatttgtgtagctattataccctcagggaagtgggccattaatgtgcattccttacctgtaggctgtcaatagtaatttctttcaaataatgatttgagaaactggactaacattacagttaagtgatcaaaattaacagtcataagtcatgttgatagtatatacacttgacatgatgtagtctttgcctctgtgctattcctctgcaatacccataacctcagtctaatcatgagaaaaacaccagataaatcctaatttttaaggtcattttacaaagtatatgacgagtaccccccaaactgtgaaagtgatcaagaagaaaaataatctgagaaaactgtcatatgaagcagaactaaggagacatgctaactaaattgtaatgtggtaccctggacagcatgctggaacagagaatggacattagatcaaaagtacaaacatgtgaataaagtatggacttcagttaataataatgtataaacatttgttcattatttataactgatgtaatatttaaaaatagagaaattaggtgtgagatatatgggaactctattattttctgtaaacgtgagactattctaaagcaaaggtttatttaaaaaaaaagataaaacaaccttttagcagcgaaagactcagggcagaattaattaacaaggactcagagaacataggtaaagctacaagcctctccaattaaaaaaaattggatcttttgcataacatttttttcttattttttatgacatcatttgcatttctgaattattaaatatggcaaccgtctgtttcaaacacagacaacaagcaagtcttttcaggcaaaatctactttagtttttttttttttttacttaattcgctaaggactttttaattttttgatagaattcagttcctttattgcaaactgggttgataatatatgtactgatagcctgagaataaacatttgtaatacaactataaatactagcaagtacttaacgtagacaagtggcatctgaaaacatccttctgtctgttcaagctcactgagtcctaaagaagcttttactatcatttctagcttttgaagcttattattattaacaataactttaaaaaacaaaattctgtacgagaataatataatttctagtattttctgcataaatatgctaataattaagacagcctttgtttatgcacagtagatatttgatttagtaacatgttcacattttgctttaggcacaagcctagtagtccattgttcccatggtgttttttgactggtcaagtgcattgcaatagtcaaatcaatttatacatgtaggtgcagtgttgaataatttatattccacaacatcctctctctctttctttcctctctgccacccctgtttccccatgacattgttgaaattcaggaaagaaagaatttcaaaatgcagattttaactaaaggatttaatacttttcttggcgtaaatatcttatgtgaattataaactttaaaccaattgagaagaaaccctattatctgcaaacttacatttagtgactttgtaaagataaagtccttaaatataacaataacagatttttgacagtcctaactcaatttaaattagtggtaacttagaacagaaccatgtcagacttataaaatatacagtcttaatatttaactattgtttatattggaacactttacatagcattttactagtgaactataaatagttatacaactattgaaattgatcttttttctaaattctaccttcatatttttttatctgacaagtaatcatcaaaggactgctagtcatcaaagtgataagtcctcacttatcaaaatttactcagaatgtaagtattgaattgcaactatatgtaaccatgtattaggtgctgaaatagattcaaacaagagtaaggcatgaatcttactcttaaggatcttacagtctagtgggagtgtggggatggggtgaagcgattatctatagctatatatatatagtactatatatagtactttaataatatataatagcagataatctaatgcatactgaacatgatttgctggtaataaacattagggttaataggacagagtaattacttcaagctggaaagttctggagaactagtgaagggatatgacatttgagctggaccttaatgacaggtgggatttgggtaatggagtttggagagaacaggcctttcacacacaggacagaacatcgatgataacagaatagtaggcaagggtgatggggctattaaggaaggcatatggaaaataaacttgttttctctaaaataactgaggaatttatttgagtttactgattaataatgcatttagtgttttgccacttttcaaggaattaaagctcttggtgttatattaaaaataatttgattgtataaaatgtactttagggctattccttttttctgttattcatatgtatcagtaactataataaagtaaccgagatttatgaatatttgtttgaatctgttttgtaaaatgtgctgtttgcttcacatttttagtaaaaactgatcttagatgatattgtggataaattaactgtaatttattgcatggtagaattatgttagtctatgtgttggccctgtcctttgaaaaatatgcattgaaagaaggatttaatcatttcctataaaagatacgacttttttcccagtagacagatcctaaagcaataaagtttatgttggatatagattgaatattagagaaatgtatgtttgcatgttacagcagagtaaattgagacttcgttagattaaaatagtgtaggggcatgacaatttaagaaattattcctgttaaaaaatgcatggtccaaaattatatcatatttttctaattgaggatgattcttaatgacctccagcttgggaactaaaatgcctacatcccttaaggaaaatgcactgctatgtttataggctcctttggtagcaatattttaaagaagcatagggccagaagttggaattaaaattctctcctagcttcagttgtttaactgcaaaacatatgaaatgtgttggatttagaatgtggcaattaacttttttcattattgaagaaaaatgaaaagctccagtaaagcgttatttggagatgcagttttttgggttttgtttgtttgtttgtttgtttcactttgttcctaaatttgcctttccttctttttcttctgtctgtgtggcagatacattacatctatgattgaaagcaaatttctccattttggtgaatgtataattttttctcttcatctatgactacattttccacatttttactcttcatatttattttttattaagagtttccatactatcagccttcaaatgtaatcaggtttttcctaatcttgaaaaggaggaaacaactttacacctcccttcattccaattacagagggggatgggaaacaccataaactcatctaaataaataaaagaataatcaaatttcacttattctaaaatgttttctatgactttcctatctttgactttcatttgttaacagccccatttcattaacacagtctataatatcatgtatctccacacaaactgttgttcactgtttgcaatttgttcttcagtacaacctcattaccattgctttcataatgctaacctatctttgcatgatcaatctaaaagtttgttctttatctacatttctctcagagaaattttcaaatcagtctcatttgctgctccatcttcctgttggaacaaacttggctcatgaccaccattttggatcttttcttctttctatgtatagtttcccctttggaggactcatgttcctctataggttcagttctcaaatctatacaattcctaaagctgtttccttggtcctggcatcacttctgagttttagaatattacagttccaactgtcttctgccatgtgaatgtgaaacatgttaaagtcattatctccaaaattgaacttatgatctcccccacatctactctcaaaatgttcacattatcatttcctagcttctctggcataagacctgagagttatatttgactccttcaacttcctctcttcaagtacaggcaattccatatcttactaatttttctctcacaaagactcctgactccatctcttcttctttgccttccccaagttagttttttatattaaatttctttaaagttgctctaactctctcaatttcttgctctgacacatggttaatttctacaaactaaaacttttagatttgagtaaactattggaacttttctgggttcactttctataaggaatgagatagagacctagaacaggaggaattttctcaagattttaagatctaggtatactaaatatgagaagttcagcccttctacattcattctaatcttctttcaactatgccatagtactgttcttaagtggtttttcccccaacaccaaagaatttgctttggtcaataataaacatgaatagagctgacaacaagatactagtggaccacgattttggcttaagtgcagaattttttttttataaaattgttttaagggaaagagcaattaatttggaaaatagcaaagtggaaaacaagcatcatgcttattacgtcaagttcttgtcacagaatgtaacacttgcttatctcctaacatccataaaggtcagaatttagaaatggctatcatctaaatccaaattatgaatgtatcacataggaatcttatgcattttcagtaatatgtatctgtagtggagctagagataaacatataattttgcatgtgtgactgtatcagtccgttttcacactgctttaaagatactacctgagactgggtaatttatgaagaaaagaaatttaattgactcacaattccacatggctagggaggcttcaggaaacttacaatcatggcggaaggtgaagaggaagccaaacacttcttatgtggtggcaggagagagagattgagggaggaggtgctacacttttaaaccatcagatcttgtgagaacttcctattatgagaacagcagaggggaaagtgcccccatgatccaatcacctcccaccgaatccctccttccacacacggggattacaatttgagatgagatttgggtgggaacacagagccaaaccatatcagtagctatctattttgataataaatacagattatttttcattaagctactcttaggcatataaggaaattgtgctattatttgtggcataaaaaagtttgattttgggaggtataaaatacaaaatcaatataaatctgatgcatgacattacataggaaagagccctgggttagctaccagaaaatctgcctccaaatcttagatgccattaaccagtcaagtgatcttggccaagtcacataccattttaattgttttagatttttcatctgtaaacatagaatgaacaacacatttttatatgtctcatagaactggtgagaaaatgcaatgaaaattaatactgtgaaaatactttatgaataggagttgtttttttagcaactgggaacatggctattgtcggaagaactacaatgtcatagtagcttgacaaccaagttgaaacataacaagagagctataaagcttaatcaccttactaatgttagttgtgtttattcgtaagatttcatcaagttttaattcaaagtattctagaatgtttgagtttataacttgcagacatttagattgatcctaggcatgattttctttcaatgcatgttttaaaattcactgtaaatttgttaatgtcagcagcctttgctaatattttcccaaacctatagtacatctgacactgtactagtacttaaaatgtttttcaactcattacttttcttggaacttcttggaattatagttttcagtgtgatgggggttgtaagtcttaaatacctttattttttttaagtctgatatataatttttactcaaagaatgaatagtataggaaactaatagatttcccttggatatttgttttgcagcaaacaattatgagactgggagcttctacccaccaggaccagcatgggtctctggagagagattgtaggccagagaataatccttgaactctgaccccatgagaaaccactaggtgactttaggggctcctgatagttgaaagtatgcccacaatcattcttactgtgtccctatgtggcttatttcttgaaagcaggtgaggtttgtaggaccagtgagcccagcctgagttccatggctcttcctcttcctcttactatactgatcaaactaagttctcactttaccttcaaggatgtgtggaatatgtcatgttttttcatagctttaatctagccaagttttagatatttcactttttaaatcttctcttagacattaggctttccatttccttaatcattcccacccccctgattttttctggatatcttccaatttgtctgcattttcatgatattgaggtgccccaaacaataaaatattcaaggaacagacacatatagactgattctatgatgcagtgtctttatttattaaagctgtggtatttatccactcatttattcaatttatttagggagttcactgtagttgcatacactgtgttagatagacaatggtgatataatataatgggaagtagagatagatgtgatccctggccatgttacatttactgtagttggagaaataaacctttaaaaacaattatccacatacatacaaaaatacaaaatattttatgtatatgaaggaaaagacatgattcagggaatgtattactaggccacctgaccaagtctgagagtaatttcttcagtctatgaatgctcatttgggtttattatgtacatattgtggttgtggcctttctttatatgtaacagaacaatgacacggttgttgcctaatatagaagtatcaaggggtagcttatgagaatttatgcccaaacaaatgtttttgtaatcttatgtgaagtatgaataaatatctttaggacacattgctatgtttcattgactagtaatttaaactctaagcaaaaacagcatgctggctaaggaaacagttttacttcaaatcctcctaaactacttttttatattcccggtttgccaccccctcattttcacctaaatagatattctagaggcaccactacttgtcctgggattagatttaacacattctaagattcataggctacacaagttcagcagaaagagtacaatgactgtggctcagagaccgtgggattatgctggaggagttggtaagctcaattgggcatggagaatgtcaagaagagaacttggggggagagtattacaagtacttacagggagcggttgtgcagaagacattttaaaaaggaggtgtgaagctgagtaaatagactagcttgtctaaagctccttgatcaggttgaggattagtgagagaaaaggtcagagaaattagagagattaggtagaaatgtaaattaagacatttacatcaattttaaattgccaagagttttggcacagtttaattctcataaacatattctataggttggtatttctcttttaatcttttctgttatgtgacaccatatgggttttgaaataatgacttttgagttagtaatctgcaaacacaacaaaattattattttaagaattgctatttttgatgcatttataagatccattcttgagtctttacttttttttccaagtatctctctggtaccaaaaagagtctgagaatttatttcttcacaagttttctgtttttgttgtttgctttttaagctgttgaagaaaccagatacacagcctgtcacttaaattacccaaaggtaaaagccatatcttttttttattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgtgccccttcctgtgtccatgtgttctcattgttcaattcccacctatgagtgagaacatgtggtgtttggtttttagtccttgcgatagtttactgagaatgatgatttccaatttcatccatgtccctacaaagtacatgaactcatcattttttatggctacatagtattccacggtgaatatgtgccacattttcttaatccagtctatcattgttggacatttgggttggttccaagtctttgctattgtgaatagtgccacaatagcatacgtgtgcatgtgtctttatagcagcatgatttatagtcctttgggtatatacccagtaatgggttagctgggtcaaatggtatttctagttctagatgcctgaggaatcgccacactgacttccacaatggttgaactagtttacagtcccaccaacagtgtaaaagtgttcctatttctccacatcctctccagcacctgttgtttcctgactttttaatgattgccattctaactagtgtgagatggtatctcagtgtggttttgatttgcatttctctgatggccagtgatggtgagcattttttcatgtgttttttggctgcataaatgtcttcttttgagaagtgtctgttcatgtcctttgcccactatttgatggggttgtttgtttttttctcataaatttgtttgagttcattgtagattctggatattagccctttgtcagatgagtaggttgtgaaaattttctcccattttgtaggttgcttgttcactctgatggtagtttctttttttttttttcttttttttattattattatactttaagttttagggtacatgtgcacattgtgcaggttagttacatatgtatacatgtgccatgctggtgcgctgcacccactaacgtgtcatctagcattaggtatatctcccaatgctatccctccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaatagacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtgaaagtgttcctatttctccacatcctctccagcacctgttgtttcctgactttttaatgattgccattctaactggtgtgagatgatacctcatagtggttttgatttgcatttctctgatggccagtgatgatgagcattttttcatgtgttttttggctgcataaatgtcttctcttgagaagtgtctgttcatgtccttcacccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgtctaggttttcttctagggtttttatggttttaggtctaacgtttaaatctttaatccatcttgaattgatttttgtataaggtgtaagaaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattcatctatatctctgttttggtaccagtaccatgctgttttggttactgtagccttgtaatatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtctagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcatttgaatgtgtttgctcttgcttttctagttcttttaattgtgatgttagggtgtcgattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcaccgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtatgtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcttccatgcttttattttgagcctatgtgtgtctctgcacatgagatgggtttcctgaatacagcacactgatgggtcttgactctttatccaacttgccagtctgtgttttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctgctggtgacaaaatctctcagcatttgcttgtctataaagtattttatttctccttcacttatgaagcttagtttggctggctatgaaattctgggttgaaaattcttttctttaagaatgttgaatattggcccccactctcttctggcttgtagggtttctgccgagagatccgctgttagtctgatgggctttcctttgagggtaacccgacctttctctctgctgcccttaacattttttccttcatttcaactttggtgaatctgacaattatgtgtcttggagtttctcttcccgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgattgcatcggctcctgaggcttctgcattcttcacgtagttctcgagccttggttttcagctccatcagctcctttaagcacttctctgtattggttattctagttttacattcttctaattttttttcaaagttttcaacttctttgcctttggtttgaatgtcctcccgtagctcagagtaatttgatcatctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatgttgatgtacagatgggttttcggtgtagatgtcctttctggttgttagttttccttctaacagacaggaccctcagctgcaggtctgttagaataccctgccgtgtgaggtgtcagtgtgcccctgctggggggtgcctcccagttaggctgctcgggggtcaggggtcagggacccacttgaggaggcagtctgcccgttctcagatctctagctgcgtgctgggagaaccactggtctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctcagccaagtgtgggatatagtctcgtggtgcgccgttttttaagccggtctgaaaagtgcaatattcgggtgggagtgacccgattttccaggtgcgtccctcacccctttctttgactcggaaagggaactccctgaccccttgcgcttcccaggtgaggcaatgcctcgccctgcttcggctcgcgcacggtgcgcgcacacactggcctgcgcccactgtctggcactccctagtgagatgaacccgttacctcagatggaaatgcagaaatcacccatcttcttcatcgctcacgctgggagctgtagactggagctgttcctattcggccatcttggctcctccccctctgatggtagtttcttttgctatgcagaagctctttagtttaattagatcccatttgtcaattctgactttcattaccattgcttttggtgttttagacatgaagtccttgcccatgcctatgtcctgaatggtaatgcctaggttttcttctagggtttttatggttttaggtctaacatttaagtctttaatccatctggaattaatttttgtgtaaggtgtaaggaagggatccagtttcagctttctacatatggctagccagttttcccagcaccatttattaaataaggaatcctttccccattgcttgtttttctcaggtttgtcaaagatcagatagttgtagatatgcggcgttatttctgagggctctgttctgttccattgatctatctgttttggtaccagtaccatgctgttttggttacttgtagccttgtagtatagtttgaagtcaggtagcatgatgcctccggctttgttcttttggcttaggattgacttggcgatgcaggctcttttttggttccatatgaactttaaagtagttttttccaattctgtgaagaaagttattggtagcttgatggggatggcattgaatctataaattaccttgggcagtatggccattttcatgatattgattcttcctacccatgagcatggaatgttattccatttctttgtatcctcttttatttcattgagcagtggtttgtagttctccttaaagaggtccttcacatcccttgtaagttggattcctaggtattttattctctttgaagcaattgtaaatgggagttcactcatgatttaactctctggtagaagccatatctttaaaaagtgagccaaaatgtgcaaattacaaaacctttttgcagaacttagtaaatttataaataatttaaaaatttcctctaagttactggcctacataaaaaaagcaagtgcaacatctgcctactaatgggattctgttatctattgagcaacatcatatcatccatatgtgtattttctgttgaagcaaaaaagatttaataagtaccactaaattatgaaggaaaggatgaaagaagataggacaaaaacatttcttgttatacctatgcagaaacatacatacatgagttctttgtgggcactgtagtgaattggagtggatattcattgaattcgtttgtaagtgatggaaaatttctcactatactggcagttctgcttaaagtatgctgtaggattggtgtgaattgctcagaaaattaaagaaactcagtctttaattctttaatattccacagcaaatgttggtctgcccacacaccctcgatatttgttacagacctggaaacatatgctcctggtagaatcattttcttccttgacacatcacccattctgctccatcagataatacgcagctgccagtgggtgaaaacttcaatgcagtataatatcaaataacatctttaaacatactgttttagggaaaagaacatatactagatagaaatggcattcttatttatccctgtaggacactaaatatgtagaaatgagtagtatttaacttcaaaaatttgttgttaacataaataagtagaggttgattattttagaaaatcattttgaaggaaaaagatattatgaaatttataaacagaacttaacactttttaaattgagattttatttgatcacattcttggctgtctttgatcatgagcctacattttaattgggaaagcaaagacttgaaaatatattaggagcaaactcttgggatagccttggatttattttatattataacatctaaagcattagctgaaaaagtaaatatgccactagaccttttaacttttatgcaatttaatccgtttatctccaccttgtttctagttctcttggtattcctcctggcaacccatggactagcactatgtttgctgctcaatgaatgtttgcagtgttgtcatgtacacagaagacttgatcactctcctttgtgtcttttaggactgccctttataaagcctaacctagaacttgtactgttttataagacattattgatttgttcatgttttcttgaggattaggctgtatctaattctctttggaggcatagtggcaagcccaggaagcagcacatatttgttgacaaattaatatttgtgccatgcaacccccggaactccttagcaaatgctgtctttaaatttctttaataccagaacttacttaaaaggtgaccaattgattatctcttttggaaacccagagtacctatggtgtgcaatttacgaacatgtcttaaattctcttttagtcatatttaacttcttcatattaggcagattaggtcttcatttttgaggggctccttgaaggcagtatttgcatatagtttgtgtatgcatttctcacagtacttagaacaatacctgctgtgtacatattttttgaaattattataatgtaactatttggagagagtatttggtactacatttgactcttgcttcccaagtgtttttttgcatttagagcatctgaactgactttggtcaatgcaccagtgagatatctttgtgggctaaggcagaaataattcagaaatcccttttgaaataggtgatctcatagctcctctgtttagaagttgcatgctactatatgggcataaggacaagggagctatcactttgagcctctgggaatgtaggcaaactctcagtggcttctatatcaaaagacatagagaccaaaggccagacattgagctatacctatagcatcatagcctatgccccttctcttgtgaaaagagttgtgtaaaccacctgctcagataggtgactgataagaataggtggaagtattgtcattgcttctctaataagtgtacgatttttaaaaagacttttcttaaattcctaaattatttatctgaatatggtggagagagtgcaagtacagaaattggtcttgggttcaaaatcaatttgtataattttctgattacaagaaattaagaagcgtcctaaactagatgatttcggttttcctcttttcaaacttagacaaggttgtgtacctctttggttgtttgagtatcaaacaagaccatgtctttaaagtgtctattagctaataaatattttatttattagttaatactttatttaacatttaatactttattgccctaatgccgcctccttaatattcagtaagacaaattgttatatccagaaatcagaatcattaacacattccaaagcttccataaaacgtgaacattttaaagactgaagggcacagttacgtgtttgattttgtgctgtccatcacacctgcaaactggaacaataatccaaatgatatgtatggcattggcatcttatgtattaataaagagcataaagattctttgacatctgtagagtaacaaaaaacacagggaggtgacttatattatcagcaagaggaaaaataaactggatgatttgaaaatatgcaatgtggtgggaggattacaatagcaatgagggaaaaatctatctgaaattaaaactccaaacttgaataaactttaacttagccatgtaattagacagaaaataattcaatcactattttcttttcataatttcacagtggttagatgaaagtatatcagtaaatataaaactgtctgtaactcacagtcattcagttgagcttcaaaataaaatgtcttcaatatatgtgtcataggactatcttatcggtaagataaccaaatgtcagtattctctttgtccttctttagaaacagctaaaacatagacctcagtttactgaattgtatactagagtgaatggtactagaatacatttttgttgagaacgacatgaccactgacagtatttttgctttccttaaaggaataaattgtcaagagttagaagcaggaaataaaatttaaaaaccactcagtggtccatcaaatgaaaatacttagaagttaaggagtagttttagattaaacttctagaagagctctaaatttaaacaccaggagctattttatacattatttctaaataatttaaattaaggattttttaaatggaaaatctacatgtcattataaagatagaatgctacaggatagatgttcttaataccctgggagttctgctccggtctgtatcctttaataaaagctatagacttacagaaatataattcatgggttatatttagggaggaacagatgtttggattctgcaaagtgaaacttgtggccttcatttgaagtgattttgaatgatgcaatataagtccccttgaaagatatctttgttcttgttgtctaaagcaagaagattaaaatagtttattaaaaacgtgcatcataattctaccatttgaggagaaataaaggcttatacctgattaattttgaaatcatccaaaagaacaaatgattatatttatttatttatttattattattatacttttaagttttagggtacatgtgcacaatgtgcaggttagttacatatgtatacatgtgacatgctggtgcgctgcacccactaactcgtcatctagcattagatatatctcccaatgctatccgtcccctctccccccacccacaatagtccccagagtgtgatgtttcccttcctgtgtccatgtgttctcattgttcaaatcccacctatggtcgtatttatttttaactagaattgtgtaatgctataataaaccctcattaacacagatactaatttggaatttgatcattgggaaatcagcagtatatatactatttgctaggcaatttaaaatcattaacgcagatactaatttggaatttgatcattgggaaatcagcagtatatatactatttgctaggcaatttaagtataaagatgattggcatttaatttggctaggaataagggctaaaacagtatttttggagactgtttattaagcagtctttatcaaattattgttgacatcatattatggcagagtattcactgttcagtagtagatgtgctcagatgctgaaaatcatgtagagaaattacgataggcatttgggacaagaggagatcaactccaactgggatagagatcaggtgaaagggagttctgtgaaggaactggaatttatttgactgttgaagtaatgtaaggcaatgtagaggttgagtttgggtttaggaaaaggaaatcccagttgtcattttggggtgggggatggcaaagatgatgactctgaaaaagagtctttttaatttagcttgggactgtgtatgtgaaaaaattccaggtaccgaattgggacatacttaagaggattttgagtggttacatttcattttgtaagcaataggaaagtctagtggatataaataggaggcaatttactagggcaggtagaaacaggaaaattagaaaacataataatgatataagaacttcatccaggatgatgacaatggaacaaaatgaaaagctgaatttgaaaaatattgtattagggaagatatagagctgggcaagtaatcaaatgccagagctgggcagagagaagagtcagggacatttctaaagttttatgcatagtggatggatgaaagaaaaaaagctatgctataataaacagaaataaaaatatcaggtgaattattttgagactagaagattaattagtctagatttaagtctggtgagatgactattctatcaggaaatttggaagccactaactatacaggatatatagttatttgtaactatatatcctgcatagttagcaatgcctaacttcatagtagaggttaaagctagtgatcgatttgaggaccatttaccttaacatattagttaaacctgtggaggttggagaggctgaaggagagagtgaatagaaggaagaagagttgggtagaattgagtcatgtgtaatgtccacattgttaatggtagaagaggagtcagataagaattgagaaaaatgagtctatgctaatacagaaatatgagtgaggaattattataatgtagagtcatagaaatcaaagctttgggagagtttcaagtaggagaggtgagcagctgtagttgtaaaatcccacaaacaagagtatgtgaagcaatataagatttttaatattgacagaaggttaacaaacaataaaaaaatacagtttcaggagaagggggaaatagacaaaacatgtttacttttgcttggattggtacacaacttaatactttcataggttttaaatttctatttcattagcttaatttaataaaccattttcatgagtagctaaaacaatgcaccacccacccatctcatattctcattggataaattgctagtttattggaagacatctaaatgcctttaaatatagtctaactttgttttattcattacttaggctaaactttccctcagataggatcattttgcaagggtttactattttaagaaagttagcatatttccactccaaattgcctatgtttgagttgtctggatttttaaaatatatttccttcccaccctccatggataataaatttggccttgtgagacatcaaggcattagaccaagtagcaaacctggccaatgaaacttttttgcgaagtttctaaatacacatattttacaaaatatctttcccagtgtgaatcttagtattaagaggattgggaagaggacctagcatttaagagaaggcaccttatgctagttttcaaaacatatgtaccaaatcatcaggctattagattttaaaaattgaatcagttttaaataaaatttgggacatgattttgaggactattgttgttataaaaattaaatctagctgggtatttatttgcttatttatttgtttatttatgcaggttgataagttgttataaacatgctcaattcatgtttcatatttataaaataattgatatcaagaggccattcttctaaatgcaatggtccaaacttttatattgtggctaatgatgttaattagtctcccagaataccactaattttgaaaccagtaacagatcacagaagcagcacactatggctgtatatcagccaaagaggtgctatatttcatgagaagttatcaaaagcatttatcttttgggaattctatttctttcttttagaagtgaatcttaagtgtgagttgaggggacagatttatgacattatttgacttcaactgtagataaaataggagcgactgtaaatctggtaccgtgtcaggaaattaaccataaatatttttattcaattctgctcaatgacaaatatttatttcatcacagagaggggagaaaagaatttttcattcaatatttagagaaaatattgtaaatacaagcacctttagtagtagtaaagtatgacgattatttaaatctcattaaagctttaggttagaaatgtctgacatcaggctgtttcaagtagagaagataacgtaagcaactggggctgggaaaccttaagaagagtgggaagttcttgttaggaacaaggaggagttctccttaccacaagccttaaagggttgcatgtgggtagagaaaaaaaagtatgactgaatttgaaattcttcttgatttagtatcatggactaatctttacaacgccactttatctcttctagaaacctatagggagaagatacactctacataaaaaataagtggcctatgaaaattattttattagtagttaatattatacttattagtgataatattttatttagcctattctatatatttccagtgaaaaaggtaaaatagttacctagattatgattttgctgtaattataaagatcattagttttccagtgagtgtcctctctgctttgctggtatttcagagaaaggaagtttctacgtaacagtttctttctccatccccttcagttgatggggttttattataaggaaggagaaataagtaaagagtcctatcattgttgacgttaggctttgtggagaactggcaccttattcaggataccacagagattccagtgtaagatagaattccgaagctatcatttttgtgtcgtggcttctcttcatacaggttctatatgctacactttgcatacactattgcatgtagtcctcacacagagtaactctaagagtagtagaaaaaaatgaaagtttatggcagctaaatatcttgctccaaatcatccagttagtggagctaggattttaactctggtctgccttcaaagtccaagcaagttcttttacaaatactttttctctggggcaggatgaatagaagtaggtagatatatgatatgtaaaaacatctcaaatacacaactcttttgttttttagatatctaacctaagagcatatttctaacctctttgtttcctattttatttattttaacatattctgttgtaaaaatgaaaacccttaataagtaaaatccagatctatatgcaagacaaataagaaattattatttactttgttaatggctctttggcttattataaaaggttttctttaaatatcccccattaaagtgtatgttttcattaaaaatccaattaataaatattcttaacatttgctatcttagatgctatctatcttatagcagaaaatatatagaagacaagatacagttttgaactttaaataacttgaatcagtaatgatggaagaaacacatacaaatagtaacagaatcaaaaataggaaacatgttgagaatatatgctgctctgagggttgtaaaaaaaaaaactaacaaatgaggtgaaagaaggatgaataggaaaagcacatgtgatttttagggcagtgaaactactggtgtatatacatgtctctatgtatttgcccaaaccatagaatgtacaccaacagtgaatcctaatgtaaactgtgggctctggttgataatgagatgtcagtgtaggttcatcatttgtaacaattttttttttatggtgggggatgttgataatggggagggactatatatgtgtaggggcaggaggtatataagaaatctctgtacactcagttaaagttttccatgaacctaaaactactctaaaaataaagtctactaaaacaaaaataaaacacacactcacacacaaacaaactaagaaactcattgccagaatgggatttgagggagaagtagaaagggatttgaggggatttgagggctgttaggtagaaagatagctggaatggaagtaatcatatctcctgtatgtgtacccaggtaggcatgagggcaaagcatgagcaagtgccctcttgcctgagatatgggatgcttgtcctcagttgttaaaagagggggatggaaaggcaggaggaggccatatcctggagtgccttgacaaacagactaagttgttttcgtttaattgagagagtcagtgctggttgttgacctagcaaattgattgttaggtaagttgctttgggagtggtgggacttgattagagagaagaggcaggagactcatgaggaatttcaagcagaaggtggctctgcccagaccagagaaataagaatggaaggaggggatagataggaaagatgatatggtaataaaatgtgcaagacatagaaactgagagttaaggtaaagaaggagcttgggtatctaagagaaattttgagagtaaagagctagaaagaaagactcatgggcaattaggtaagagattttcatgaggtcaatttttaagaacccatttactttttttaaagaaggtatattgcacttctagaacaggtgatgattgtatttttttgttacctaaggaatgaatccatgctaactaaagacaatattatgtaagcatataaaagcacctgtggttttgtctgcaaaatagagtcgatgttactttaaaaggatattatggggtttaacagagtttcctactggtattgagatatctaatggcttcagaccatattaagtattgctagcaaaaagctatagtgtgataagcattattactgtagtaaagaatgaatggtgctttcttttcatctctattgctctgagggatgggatattagttttccttcaaaaaaagcttctatcttaattacagaaatgcaaagatgtctgtagaaatgagtatttttcattaggttgctgggtgcttcccacaaaattggatttcttgtggtaagtgaggaagggtaaatgggtagtgactaggccactggcattgtgtgccacaattatatgccaggccctgggattagcatatatcgtctcgtttaatccataaaaccctgtatatttggctctgtaataatcttctttgaacaggttagaaaatgtaaaataaaatcatttaattggcttgtatttaaataaaacagctggtaagactttctgaatgaggacagctgcagtgggaatagtaaagtgcaaatggatgaatacaacatacatttaggtgtgagaactaaacagccttggtgatcaattggatatgggtttgagcagatttagggccaggagttatttaggatggctccatggtttctggcttgcaaatcacacatagagttattccattccctgagataggggatatgtgaggaatatatgtgggagaggagattatgagtttgagcttaggcatgctgtttgagatgagtgtgagatatgccaggagagagatttaacgggctactgattatgaggattaggaggcttagaagataggaatggactgaagataaagcttttggggtcatcagttacaaattaattattaaaggcatggataagtgtataatatttctcaagggcaatgcgtagaatagaagatgaaagggctatgtgtgacacccaggggaacaacagccttgaaggggagggcagagagagaagcttacagaagggacttgataggagtgcccagaagtgaaaaatcctcagggtacacacagtttcattttagagtttagtggtgccatttctttgtgaaatagctgttacaatattgctcctcctctacatctctcctctgtccttattgtgttgaatggtatattttgcatttccattgtgagaagatataaaaccatttcatttaaactgccagtacatgttgtatggctgacatgggtatttgtacagttgtttcaaaaattgcaggcaagttttgacagaaatactggtgaaatcttcaaaataacaaacgcttatcctttacaacatcctgaggctggagacaggggagatagggcctattatagttttttcttcaactagtacttttatttcaggagtcattcttaattacagatgatagtaactttgaaagctttatacacatgtatacctcaccaaaatgtagctcaaatagtctaagtaggagtattcatgtaaaacaaaaatatcttggtaaacagacatttttatcatggaagtttatattgtttatacaaaactcctcaaataacatacctatgactaggataaagtaactcatgtttctggatacatttcatgattatacagttgtgtttattttttcatttttgcaagtatatactgtaacaactataaatatttgattaataggagtgtcaacagactgaaagaacccttataaaaataacactatagttatgtcaagtgaatttagttaatttagttaagctatataaaccagcaatgaagttcctggttttctctcaattttaatgtaagttgagataagaatatttcaaaaggtacttagtagtcataggcatgttcagaattaaattagaaatgttaaagatttttttttagctgggcatggtggcacgcctgtaatgccagctactcgggaggctgaggcgggaggagaatcacttgaacttgggaggcggaggtttcagtgagctgagattgtgccattgtactccaacctgggcaacaagaatgaaactccgtctcaaaaaaaaaaaaaaaaaaaagaaagaaagaaagaatttttatggaaaagtagtggcaatatatttgaagtagttgttcaatagagtagtaataaaaacacaaattttaggtagattctagtttcaaatatggagtagaacttgctcagttctttttagcatcagaccaaaattagttttcttatttcaagcaaaagaaaaataaagcataaaatatttggagtactgcaaaactccagtgtattctagattccatggcaaaactaatctgtattccttgagataaatttgcataactaaaattgttagagtatcctatttatttctgggtttttttttctaatctatgattggtaaattgacatctaaaataattcaaaacatcttcaaagagccttcccaaaggctttcttacagatcttctaatcttatacttctttctagtttctgtctatattttgtattaagtataaggtaggttgctttttttgcctctttactaaataaatgggggtatgaatgtttttgattttatttgtataatgcttcatatcacataatttttagaattccataatcataatgccttggtttaagaatatattaattttacttagatttaaacatatagccatttaaggaattacatttttaaaaaataaaatcatttctttgttcttttacttattgatctcactatatatcagtaataatttttcatgggggggataggctggttattttctatatcttaaaatctgatttttttatttgttgtaggttttactgggatttaataatgcttataatgatggttggaaatctagtcatcataccagttggaatcacattctttacagagcaaacaacaacaccatggattattttcaatgtggcatcagatacagttttcctattggacctgatcatgaattttaggactgggactgtcaatgaagacagttctgaaatcatcctggaccccaaagtgatcaagatgaattatttaaaaagctggtttgtggttgacttcatctcatccatcccagtggattatatctttcttattgtagaaaaaggaatggattctgaagtttacaagacagccagggcacttcgcattgtgaggtttacaaaaattctcagtctcttgcgtttattacgactttcaaggttaattagatacatacatcaatgggaagaggtaagatgcatctttttcttttttaaatctatatcatgaaattgttaattatggctgttttacaatgaacaactgtgcaatgtgtaatgagttttatgaaattcaagtagaaaaatgtattcgacgactcttttccatgcataagtgatatatttgtatccctaaaatatatgatcaaataatggatttgaatgaactgaaaaaaatagtgatcgttttatgccaatttattttatttttaaataaatgcactttaatcagcaattattatcttgatcaatacaacccctttcccaccttggttttttttaatctaatataaatacatcaagtaccattattttgataaagatgtgtagggtctgattgctaatctggcacatcattagctctgtgagatagtgtggtttttgtatcctctaatattgaagtttcattgaattcatgattgggtaaaacagattgtttctttatttccaaattgtatatataaaggctttgattttagcatattaattttgcttattgttatgccttgcctatagtaacttattttagtttctccctattagttcatttcataatactaaaaaggaacatattcatgagggacattagtacatagaaaacacaaagagtatagtgaataaatggagtgaatctgaccaatcaggcccatattttgctgaatagagcatctgttgttaggcagtgggtgggacctgagagggctcagccaactggagtttccaaagatctgagttaaaccatcatcaagcaaaggagttcatatccctatcttcaaagtctgaatattaaccattttgacttccttttcttcctaagtctttttgtattaattataacctgaattttatagtctgcataagcgtaagagtccaaaagacttgtagaatgcctaaatcgacactaatgaaagtcatataaagtcatatactggctatagaatattgctttcctccctacagaaatactttttagcattttcaagataaattatgtttttaaatatgtcataaaatggaagttctgtttgatttctgtgaggcggtagcagtgtttttgtatgtgcttgtcagtgacattttggttcacaggatttcaggaaatgacatgcaataataaaacactgcataatacactgataaaaaggcataaaaatggatcattcttaaaatatagatatgggatatatttaaaatcaaatgaagcacatttgagaaatcagattcatcttgtaatttttctctatatagcacattccatctaaaatggaataaatgttcagttctcaaagcctttttatgctaatttgagattaataccaaaccaagatgattcttgctaataattgctaatatttattgaaggcttattacacgtcagctagtatgtttgattctttacatatattagctcactgaatcttcctaacaacacaaagatgtaaatataattattgtcattattttacagatgagaacaattaaatacaataaggtaactcgtccagattcatagaactagtaagaagtggagctgggattccaaacttggcaatcagactcaggagccagtgctcttaactgcaaaactatataggttcttactatgatatataatgttttagttataaatatcttaatattctaccattttatagattgtctaacgaattatagggaacttttcttaagtaagactgtgggccatgcaatacaacagagttgaatagtacctcttaaaacaaggccatggaaaaatattttaacaaatatcctgtgagaggaaagtcactgatataaacatccagtcaattaaaaatacagtagcaatgtgactatttttaatatcttgtggttttagcccagttaccctagagaatggcagcaggatgaacagatggcatcctatcagataaaatggcaggccatgtggtcatataagagtatactccttaccaccaatgtcctttggcttctggcagtaattacaggcacctagatctgtgtaacatgatgtgttttaaagatgccatgataaaatttaggaacatcagctcactgctatcattattgtaaaatgcaatttaatatgcacttacagacatttggtaaccaagcacattcaggctagagttgtgggttggcaacatgtttcttataaataaatgaccttggtaataaatgaaccataagcccatttaggtgaagaatgttttcttgattatatgatacccccatataatatcatatatcatgggtatttaatgcccattagtaatgctgttcaacagggaagaaacagagtcataatccagaatttaatacaaattaatctttccatcacctacatgtttctaaccataatctccaagaaacttgaatggttccaaaactggaaatctctctacctgatttttctaaatgtcaccaggatgtgtttacaagtaaaaatacaacaaataaatcagaaaaagtagctctgtgagcttttgcaataaaaattcagaggaagatgtgagttcacccacatgtctttggttctgggtgttttagtatcaagctggctaatgctaaattcagcaaatttggggaagtaatgtgtgaagtctggaagctgccactgttctaaatgaatcattcctgaggaaagctgctgccttctataggaagctgcttccatcttcaacaatacatttttttttttctggactgaattagttcaactgaaaaacaacaagaagccctgatgccagataaattagaaaaatattatgaatgagatacagaagctttaaatttttgtgcttatgttattatcattactaaagctgaattagtggttaatacaggaggaaaaaactgatttgagcaactaatttatgaaacacatggtgttaagaagtgaggagggaagttgttttcatgaaccaattataagatcaatagatttgggatgtaaaaatagctttctgtgacattacactgaaactttatatatattgccaggtgaggtaaaaaccagagacaatttagataaatcaagccagaaatttcttttcttgtaatagctagaaagctgaggtgaatctttccaatttttatgtttggttttaaaaaactattatttgaattcagcattgtcgttgttgttattgtgtttaaagacagtgatccaagccagactgctatttcataacctatcacaagggtaacaaattccttgtgatcttcctaaaagagacatacggtgaggaaatccctggaaattaaatggaatatgtgacaatcacaagccactgaagagataaagagtagattaagggcttagtgaataggagattattcagtttgtaaaggtgaagagttcctttacagctgctgatctcagtcattttatcaacaggagatgaccttcgaaattttttagaggtttaggaaatattaattgcaaatacaaatgctactctgtaatgattatctctttgtaggacttaatgtcatagataaagcataaattcttcttaattttaaaaagtgggaaatgcatcattatataataactatggctttggaatatataactataatattttactttttattcatcatttcctatctccccaacctcctttgtatagaactgggacatattacaattaattaaatacattttgggacaggaaagagggcctgtggttttgatcttttgtatctatagcaatttcagatgaataatgtgtcttgaacatttcaatgcttgtcttgaaaccaatattagatttttatactggcttagagatagtttaatatacaaattatgtataacaacagagcagtaataaggaaatttattccatagggagctaatgcagattacagtttctatctttggttaattttagcattcaaattggtgtagagtagaaactaactgttactataaattgcctatctataattatacaatacatattctaattacttttatatttttaaaaacacataggattctaagacttgccataagcaaacagcagagttttcccaaacctgccctgtattagaacttagagaggctccctattgcttatcacatcaaatctgtgtttccttgctgtgccttcaagtctctccagcacattgttccctggtctcaccattgtcacttcatatttgcacccaactcttttctgtttgtgtttcagttttacagtgctgcttgcaggaaatgattctttctgcttctataattttattcctgctacatctccgatttggaaaggcttttttttttttttttctatcactcctttaaaaatcatagttaaggctgggtgcagtggatcacctgaagtcaggagttcgagaccagcctggccaacatggtgaaaccctgtctctactaaaaatacaaaaagtagctgggcatggtggcgggtgcctgtaatctcagcttctcaggaggctgaggcaggagaacagcttgaacctgggaggtggaggttgcagtgagctgagatcatgccattgcactccagcctgggcgacaagagtgaaactccgtcaaaaaaaaaaaaaaaagaatcagacttcaactcatttccagaaggtattctacattgacacactctatcgtgacagtcaatacctttccagtgaaaatttctactggctctacatgcatttgttcatgataatttggttactaatgctttattacacacattttgctttccttttgccagacatagatatcatagggaagaatcagtgtcaaattttgcccttgaatctttttgtatattagtgcagggttataaacacaataaataatcagagcatgtttatccgctaaatactggcaatctcccatgttctaaatccgttaaataataataagagagtatccgttcttcactcccaagcatttactgagtaatctgtatgtggagatgctgcaaataaggatagaagactgatgccagttttgtaagaaaagcagatgtgagcaaataatcacagatgatgtgggaagtagtggcacaaataagggagtgagcaacacaattgctttgcacaagaggaggccttgaaacatactgaactgaattttgaatctggagaatggattaccaggctgaacaagtggaccagggagaagagtgtgttccagaagacacgagatacaagcagcctagtgcagtagatgcagattcccagattgagtttggagatgtagaccagaatttgtgctaatgatggacttaatcaaaaggtgccattgatacattttaggcaggggatttacattttagagtgctacagaatgaagggggttggaggccaccgtggatagagctaacaccaccagttagaagagaggtttatcacttcctcgcatttttttgtatgcagtcggtgtcaaacacagtacttttttagatagctaaaaaaaggtttatctttgccaagtactcttgctgtcaaaaaatgtttgtatcggttaatgaaatatgataaggccttctatgaagtctatttgcagtgttttacaattttaaatatcaattatattggaggtttcaatttttatgatggtatggaatggattctataccagaaattagtgtatatttcaactgcgacattattttctatgtaatctagggaaaatcacataaagtgacttatttatgcccatgaacaatcaaacagttgtgaagttcaaatgaaatgaagcatatggaagttatctgaaatatttaaactgatatttctgtaatatttataaatatatgatgacatctttctgaaattagcacatctactgacaccaacattattgcatgtgtgtgaattgcctgatattttctgcaagcaaatattgattctgctaaagaccactaggtgtcctctattggttatgttactttaaggttctatcttttaaaatgccggactgttttctttgaagttattcatttacactctcctagaatcatctatttgcttggctagttcatttcttgaaaaaaagaaaaagatgactatggatattcgtatatgtaaaatgatttctaactatactttcttctccaattaaacagagttttaagttccgtctctaaacaattattagtattgtgagataattgttttcaatattatattatttactttttaatgtgatagcttaacagatatgctgaagttttaatgtacaatgtaatgagttctatttggaaatgagatgttaagtcaaggcaactgctatgtcgcccaggctggagggtagttggttccatctcggctcactgcaacctctgcctcctgagttcaagtgattctcctgtctcagcctcctgagtagctgggattacaggtgcccccaacacgcctggctaatttttctatttgtagtagagacagggtttcaccatgttggccaggctggtcttgaactcctgacctcaggtgatctgcccaccttggcctcccaaagtggtgggattacaggcatgagcctctgcgcccagccccaagacaactaaaaagttttaacagggtgtgcgtggtgtatatatacatatgttagaggtaaggcttaattttatgaatgctctttggtcagcgccccgtggcagatctgtatcatctcagtgcttttgacatggaaatctcagttaaatgtcagaatataagatctgatttgaaatgttcatgcttcccattttaagattaaaacattcagccttcttaattagcccaatccttgtcccaatctgttttcttgttttgcaggtttttctataattccatggctatatgttgataataatcagattgatatccaagtttctaaattatatacccagttgcctcaatgtccacatgactcagtgacatctacaaaggtatctcatgagttcctcaagctcagtaggttcattttttctttaaatctccttttcccttatttcctgttgctcaagtcagaaatctaaaaagtgttcttctccttctcttttaatttctaagaaataaccaagtcctactgattctactacttcccaattgtggttggaatcctgtaacttcttcacttgatccccttatcaccatcctagtccaagccaatttgtgtctcatttggatttctattctccattcataactattttaaaattcacccttgcttgccttctcaggaactcaaaagtggtagttttgaagagtaactattaccatattacccacctgctgaaaatatttctgtaacatttcattactgtcaatatacaatgcaatattcaaggccctttgaaatttgtttctggccaaactccctcaacctgagaaactctttgctcatattctttaactatgttgaacctctttagtttgccaaataccacatttcaaatcctatgtttcatgttcatgaaaatatgtgttcatgttttctagaacttttttcctttcaacagtttcagattatccatctcattttatttacgcattgcttctttcaggtagaattaactaatctctcagacacaattagttccatctataatggatctagtatagctccttgtgcttctgctttgtaacattcatcaatttgtaatctctctaaatctgtgcctttacaattacatattagattccaaaagggcagatatcatagctttcctgcatcttcagttcctagcatagtgtcggggaaataactgggctctaaagtacttgctagatgatttcagttattccctcaatggaatttcaattcagcaggaaaagaaaacatgtaaatagacaaaccgataaataaaacaacaatgtcttgaatccagtattacaagcatttatagtgtaaacaacaaagccaagagaaaggtattgtatatgagtgtgtggtagggagtagaagagaggttctagggaaagcacactaaatatggccactttcatacctaagtgtgaaactatatgaccttccaagtggcaaagtctgggaaatcttccaagggaatttagaaatcatggaaaaattaatcaacttcctcattgacagtatggggatattgatgattttctgtccaatctcatagaatctaaggttcaaatgagatgttattgttgaacatacactttgaaactaaaaagtttattgaaatttaagttatattatgaatgtttctatgaatttaaaatataaaaatctcaaaatgagtttgttatccctttattgtgcttattgccctgtcagatattgaaagaattataaatactattatgcattactctttttttagagatagggtcttgctcttttgctcaggctaaagtgcagtggtgggattatatagctcactgcaaccttgaactcctaagctcaagggatcttcccacacaattgggattacaggtgcatgccaccactcctggctaatttaaaaaatttttcttttgtacagacagggtcttgctatattgtcctggctggtctggaactcctggcctcaagctatcctcccacctcagcctcccaaaacacttcaattacaagcacgagccagtgtgcctgacccttattatgcattacttatccccaaaatataccaactgaagaactgaagcagcagatgaatcaggctaatttaggacaaagcacatttagccttacatttgtccagtttccgaatagatgtcttagtttttcctttctctgtgcatgcagataccatatatattatggctactgctattttagactcatttgtgtgctattagagtgaaagttgctaatactattggtttatgaaagttggagacaaaatttgtgatgtgcttctggtttaaacttgaagtctggtttaattgccagagtgttttataataagcatgggttactttaattatcctagtaattatctcagttgaacgagtcactttagttggtcttgtatatagtgcccctatctacaaataagaaaggtgtgatgatacatgatggacattggaaaggggtacagtgacatccaagaatattttattgttacaaataactaggtgaactcaaactaatctctgatgaaaatgttaaatatacttatctaatgaaaaagggaaaatacatgcttttttactatcattttctaataaaccagtctttcactttagtctgattcaatgtcaaaggtgtttttactaatttaaaatttggaaaacaagattatgcctgctttatttcaaaagagtgattgatttaaatataaacatactttttgaagtatatcaccaattgtcacagaaagtcaatttatgaggcactgtaactgtattatgaaagctcaagagtaaataaaattagagcccttcagttgcaacaggtaatggctgagaaagacctgctttgacttctttttctgtcttgctgatgtgtgcaatttagattttgtatcagatgagtcgtgtcttagtgtgaaaaggaaatacatttggttggttatataattctggtggctattttgagttaagtctgccatttagaccattttttaagacagctaaattctttttcttattacattttaaagtgaaagtagacgttgagtaaggaaggattctggagactggtcccagggctccagataatttgaagcagctgcaaaataaaggaatggtagctattttgatacaatcctatctaagtcaggagtagtgggatcagaaagggtttcccattgagattgtttataggtgggaatttttacaataattatttcaattttgctctttttgttgtttttgtggagatgtgagttgagaatgggggaattcagaattctgaaatgagaatcaggagtatcttgtgcaagtcattttcagacatttttctcatttttaaaaaatgtgaatgataaatggaaaattcatatgaaagtgctttgtgaactctaaaattgaaagtctaaagagcatatttatataagatataattagcttgtcaagttaattcactgattctttcacagaatctatgaaagaatgaaatttttttcttcctcaatattctggatcgtagctgagattaaaatagtagaatctggattgtggtaaaatgtgcttttaaatttagaatccaggaactataactacctaacagtacctagcagtaatgcttgggagatcaactagctttgtgagtgtgacagtttcttagtgtgggaagtggttcttcattgtgtgaaaatattcattttggatgatactaaggagaaggataaatgttcagaacaactcctttcagttaactggcaatgaatcacaagcattcgaattcatagcttttaacaatctggtacaattaaaacatattttctcatttttatctagactgaaattgagagaaatgtagctctagataatctttaatctagtaaagatcactcctctttcttctcctgacacatatttgttgtagaagcgagacaactttgtaataacagtgattaccaaggagtgccagtaattaccaatgtgttgggaaagagttattgaagaacttctagatttgtaatattttaggctcacataaacactgactttagaataatattagatgatgtatagattgcaaggtagtagatgcattcactctcttgactgctaggttatgagtaatggattcttgaagttctaagtgaccagttttctgctctcaaacatttcttgggaattgtgatattaataactaaaatttcactattgggaatgattaatttatgtttcaagatctttatcatcttcaagagtatcatagaagatatgaaatatactttaagctattactaggtaacatgttagcaggctgttggttgacaggtagctgagagtaattctttatacagaaaggataggtgtatgaatgtgagtgtcacaatctgagggagagaatgttcatttgtatgagcagaaggttcatctagaatgtgataagtttagattgactggcagaggagaaaggagggcaccagtaagcaataaaaatttttaaaaattcacagttttgctgaagtcttcctgccgccctattacccagatttgcctaatgtcaaagatgattgttttattgtttctaagtgttattgggaacttaaccaactaaatccttcacccttctcatttagttgaatcattatttcatatatttcagacattttcaatggcttgaaagtaggtaagcttatgacttaaggtgaaaaaaatttttagtgagcacatgtcgtggtaaaatgctgcaatttttgaagaactctgtttagtactacatttcttagatatgtgattttatacaaccagttaaacattgcatatgtaattatatactagctatacgaaataaaaatgagagactttcatgtgaaaatttcatatctttataatatcaaatatagaacttaatcatatattaattggccatatgtatatcatatgctgagctgtgctatctgatataaagatgaatagtaacccctgctaaaagaaaatttgtatttttgtggaggaattagaaaaggaaataaatgatcataacaaatatgtatgaattctcatgtattgtgaattattgaatagaatatttcgagaatggctctaaagccacattttggctccactggaaagacctccactatctatttagaaaggcttctaagagagcaggagtggggaatagtgatgttttggccagatgattacaatcctttgattagtcaattgaaataaaaaggggctgttacataccatgctttactaaaaggtgagatttcctgagttaaaaaaaatatttaaaataatattaatatgcttttgagattgcaaaataacttccttatgctagaatataatatgagacattcatttgcattcaaatcatacacatttttgaaagatccttaaatggtttttttgttgtttttagggagaaataacaatatattttaattttataggcagtcttaaaaactctgcatttagtcagagaacttaacaaaaagtgaacctagttcctctctctctctttttcttgtagtatggatgcccttgtaggagactcttaaccaggaaattttcacaattactaaataaacaattagaaatatctaacagattatcaagaaactgctgcattcaggcacttgcatgaccaacagcaaatcagttatcctgtagttctgaaaacacttaccttattcaaaatgcttcacttgtcttcacattttccatgagtatattattcatttacttgtaccccccagcttctatttcagcatggagtcacttccaacacctgtgtctgttgtggctattgtcagagaatccatgtattgatagattctgtttgaaaaaccaatgcattctttccaccaaaagctgttgtaaaatatctcttcagttgtaggactgtttattgatggtgtttttattgtcattgctgttgttactcttgtttgggggagaaatagcaggcagtgaaattaaccagaatttcgggttagataataatacctattttctaataagtgagaggtcaaaggatcccagctgtaattcgtactcttaggaaatcaattcctgtctctgtgttccaagaaaaacaattcttgctaatactatgaatttttaaaaccacttttacctttatggaagcagaattttttcctcatcctcctcttttgtcacatttctcaccagaagatttgctaacagtttgtcagcaaaatatctattagtcatttttcttataactgggagaaaataaatataattgccttatcaggaaacagacacacacacacacacacacacacaatggaacattagcattggatcaaggaagtcctatttcagagactcaggctgctataaattccattgtaccttgaactgaagaatggagtattgaggttgaggaaaccagtatgatcgaccccttagttgaagaaccattaattttatgtttttattaattgctatatcattcattttctgcctctcaaaactgcaaaaacccacaacatttgtataaaaaataaaagcaattaaggagatgactaaattcaagatagaacatttccaaattggcaaagtatcttactcaacttgcaagaccaaacgtatcagattaattattttcctttctacccagtataaatctctggatgataatttattttgttcagttattatttgacatgaaaagcaaatgcttcagcttaagaactacaacttaaatttgttaaaattttacaatagttattctagaaacatattctcctaaattatatgattttttaaagttcatttttttccaaagaaacaatcaaaatagtttcctcatagctctgtcatgcaaagaatgttattgttacagacttgagcctacaaaataatacaaagatttcatagaatttgggagagagtttccttggagtgttttcccagagtttttagaaatcttgatccacatgctccagtatgtagtctgtgagttgtcaatagtttcctgaagacaatttttttttcaatattgggaatgttatcatgcaggcaaaaatatcttagtagcttctcacagcaaatgataatatgtcactcccactacataaccatcataggtgggctagcggtcctgcttcttgtcatctcatacctggatgtagactgactaagcagctccatcatgaccactgccagtcattttgacagggagatagatagctctgtagggttttaaacaatcagactcagaagtgatatatttcacttcttataactttttggccaaaatgtcacatggcctcaaccaactgcaagaaagtcaagaagaacagtcctaccaagtaactgggagtcagagaactgaagcaatttgcttaatagcattacttcagtagttggacttgctgagagatggagacagggtatgtcttgaacggatcaccaagtaggcctgtgactaacttatattacctttgtaactgttcaaaataaaatcaccaaccaggttgatctctttgtttttctctcatggatgtttttggtcccagacaaccatctagctagctaatgaggtcatagtggaggaaatgtgatctacgtttttataatatagctcctgtatgacccattaattgattattcatttttttaataaatatatattggactcatatgctatgcatatacattacaacaatacacaaaaattaatttcttaaatagcctaaagtctagtcatatgagtaaaagacaaataaataaaaaatttaaaaaaaacagttctctttgaggatgtatcacagctttagaggctaaggaaggctccagggagaaagtgatacctgaaataagacttataagaagactaggacttatcaagaaagccaaagaaatacattctagccaaggtaaattccttaagtaaaaagacatgtaagggatttttcaagaaacttaagtcctcatagcttaggtatacagagatgaggtttgaaagataagttggtgttttgaaagtcaaattaaagagtatagactttgtccctgaggacaataagaaatctttgaaaggttttaggcaacaccatgatatttttagcaaacacattgtttactgtggagccacatgctattctaagctcttaaaaatattaatttgattaggccccatagtgactctatgaagtaggtagtatcattgtcaccataaaaaagtgaagaaattgaggcacagagagattaacaatttccccatattgcacagctagtaaattatagtgccaggatataaatccatactctgttgttcaaaatcttgaatagaccttgctccctctctgcttaaatatgactgaaactggtatatactagttttggaaaagaggcaggtaagatttgaggcagggtccctattgattggcgtgtgctataatttgaacaagagtggaagcattagggggccgatgatggtgctaccatatgatctccctcccaagctcacaaggtgcttagaaagctgatagacactcttttaggtattagcaggaactggcacttaccctgggggactccctcagagcagcctctggggtatatcaactataaattaatctttattttacttactttttgtaagtgaactcaaccttaataggaatttacattactccattaatggaagtaccaattttcaggtttcaaaacattagatttagtgtgagtttaataatttattaattgtggatgaatattagcataatttaatttcctaactttcacacttaagataattacaattcttaagatttagttttttgtctaaaccaatagggagcatgtcttataaatgtatgatataataagagtaatttttttataaggaaaacttactgacttgaaattttgagaacacttgaaatacaagcaataaaacccagatcttaagtgttactcacaatatgtacattttgcttataatgtgttacttttgtttggactttgttttttaaagaattcagacttagaaagtacttacaaattaactactttaggattctttggctaccagtaaattatattactatcatatatttaattatctttgagttttacaccttactctgatttatggagaatcacttcattgccaagaatatggtctgtctcagtgaatgttctatattcactcaagaaaatatgtttttctactattatttattagaatgttctgtaatagtcaattaggtcaaatttactcaattaacaatgttgttcaaatcttccatatccttactgattttatgactgcttggtctcacagttcttgagaaaaggatattaatatactaaacaatgattttgcctttctccatttcccctttcagttctatcagtttttattgtagatactttgaagctatgctgttaatttcatacatagttaggattgttatgtcctcttggtgaattgctgcctttatccctataaaatgactctctttacctctgatgtctactttgttggatattaatattgccactgtactttaataattgtataatatatgttttttaataatttcttttattttcttttttttttttattttttattttgagttgaagtttcactcttgttgcccaggctggagtacaatgacatgatctcacctagctcactgtgacctcctcctcctgagttgaagtgattcccctgcctcagcctcatagctgggattacaggcacccaccagcatgcccgactaattttttgtagttttagaagagacagggtttcaccatgttggccaggctggtctcgaactcctgacaggtgacccaccgccttggcttcctaaggtgctagaatcacacgcgtgagccactgcacccagccttatattttattttcaatgtgtgtgtttcaagtgagctttttgtagataatatatagttgagtctttttatttatcaaacctgaaaatctattccttttaattgtaatactaaaatcatttatattttaatgtttttgttctctactaataagcattttatcctgaattgtatacttattaatatgcttctattcaccaaagtttttacaaagattcagaaaagttttttccaactttttagcagtttttgttctatcttttcctttgtgatttttttaagtaggtgattttttgagagctttatgaaagagtttacaacctagataataaaacaataatagtaatgagtattctcagtaagcagggccagggcctgcattattcaggtttaggcttttgatggtgtgggaacatgtgagccatgtgaaatagtgatgttagggagacactaatgtgttcacttttttactccagtcactctctaccttgagaggaccaatttttatcacaccaagagaagtaaagaacaatgtatgaaaatacaagttgcttggcaatttattgtttgcttatgccaccaatgttccagtgctctctgtagacagaagtgttcaaaaagctgctagtttttgagttctctactctggtgtggaaatccattattatttatttgcgtctatgcttttgtagaattcacgaataaaatttgatatatttaaataaagttatctaaaatttcacaaagaaactaagagtattgttgacactttggttgtaaatggcttatggaggtgatcatttttccaataaatgccacatttatgattatgttatgacatttttcttgtacacaagctcatggataatgccctgccacttaagtaaagtaaatatatgtttatttccattcatgtctattttccctgaagttaaacatagtattcacagataaaactatatatgatagactcttatcttgactctaccctgaaatggggattttagattttattttataaagaaggaaattattttcttctaacagcatatatgtggtgcaaagtagacatgataggtattattttgacaaaaagtgacttaaaaatttgccatctactgttatttcagggttgtgttacagcagaaatgtaggatgccataatcaactgttgatgacagtctcttttgcttccccagatcagtgaaaaataaaatcaccatggttgcacctcgtccataatggagcatttggagtgatggctcagtataatgcaaatcataatgaggatgagggagaacactatacatctttctcacatgatgcaaactgatcacatgcaatcatatccagattattttggagaaaaaatgacatgtgtgacttagtaagaggcaacattcctgctattcagatgtgaagccttctagtgacttggtgtgataaatggctgattttgcaggttctatatttcaatgtcagttaccaaaaagaaaactgtcatctagacagaaagaacaagatgaatcagaattaccagaattacggaattgtatttcttcctgcctgaaggcatagtcatcttatttggcatcagcccttaagagtttgactttgagaaatatatttggaacagaagtgcaggaaaatgaatggacccagttatatatatatgtacacacacatacatatatatatatacatgttatatatacatatatatatggcatgtgtgtatatatatatatggcgtgtatatatatggtaatcatatacatatgtatgtcacatacatatataagtatatgaaactattaccttctctgtgaggtttttttatttttatttttaattggatcttataactctctgcgtcctccaaatgaaaccttctgataacttagaattaacttgaccagggccctgaatgattccctgctgaccctttcaaactcagcttgtattgttttccccttttgcagactattcactagctttattagacttatttctgttttttgacgcttggtccttccttaggaatttttacattggttgttttctctgcctccccaatcttagctcagatcttaaccttcacaaatagatatttcctgaacacctttagctaaagttgctactcctttacatttaccttcacatcatgagtctttgtttgttggcatttagaatggttttatttatatgtttactgctttgctactctgtctctagtaggatgctggctggttcataattgattagtacacaattctcagtgcttagatattacctgccacatggtgagcactcaggagtgattgttgaaggatgtttcccaggagcagcacattgctgagcgtagtatttcagtgatttccacgtcaatattcagaagaggtggtctaaatagttatataattattttcaacaaagaagcattattagatgtttatttgtaattgaaattaatagtctttcacaattataaaattgataagtgacagcaaagtggtgtgattgacatacacatgatttgggttgaaattttctttctgcttctaatgagctttgtcatcatgagaagtgtatattttcctatctatacagtagggttaagaatagataactcataggaacgttgtaaagactgaaggagctagtatctctgtaaagagtccaaggcaagacctgaacacaattcctggcacataaaagaattgttgtgaattgtgagcacaaaagttttgcctgtatcatcccaaattttcttcatgttgttgtaaatgtgccttctatgtaaacaaggtcaaagatttaatattagagaatgatcaaaatagtgtcctaataagacaatgaattttttttttttggttttggttttggtgtttgcaataaaataatacattttactaagtaccctatgccaaagcttagctcattacaattttgaaattttattttattcgcactgaattgatctattttattaacacattactgttctatgtttttcatatcccttttagactttgaaaaaaaagctgtagggttttctttcttttttttaaagttttctctttcccaggtgagagtgctttttattctataattttataggttaaaatataaattagagctcttcatgttttttttcccatctcttacctaatcaagaacaatagcatctataatatgtgaaggtactaggcacagttggtattggtatgaggtatcaggaagatatggacaatgaggcaagcctggggactggggtgccctaccttatctttgcaaatactctaggaaatggcagactgacactaattgtacatattgtacatgaagattaatagttttttttgttttgttttgttttgttttgttttgagacagagtcttgctctgtcacccaggctggagtgcaatggcatggtctcagctcattgcaacccctgcctccaaggttcaagagattatcccacctcagtctcccaagtagctgagactacaggtgcctgccaccatacccggctaatttttgtatttttagtagagatggggtttcactatgttggctcccaaagagctggggttacaggcatgagccactacgcccagccagatgaatttttttaataccaacatgtagccttgctttaacagctacacactattagatcaaacaattttatgaggaaaactaagagaaatattttgaacaggagcctgaggacagaagagggtgcatatgccttctcattatctcagaaagccacagattcatggcaagaagaggccttgccttcccctagagttattcccagcctcattacttaccacagttgacctaaggtaccatctagacttgttccagtgtgccctacatccctgcttgcctccataaacacaagagggcccaggctactagatgtttctcattcccaaatggctccatacatccatgattctgaccccatctaatgcccctctccagccccatccttcacactttccactaggtcctgtgggttttgaggtctctatcaatagaatccctctgtcttccaattcttctttaaatatcccactcacttttttttcctgttaaaccaaaacccagtgacacttgaggggcaatgcttcacctgtagcccttgcaagtggtgactttctcttttcctctgctcattctcagggtatgcaagtgaaataggtgcattcctagatcctcactgtcaattgtagtccattctattccactgattacttaactactctttctcactgtttccatctctaatgcattggctctattttcaaaataaatctggagtctgaccacttctaaccagctatatacccttactattgtatggagccaccataatctcttgcgtgggttattgtaaccctcctaagtgttttattacttctacacttgccatacttaggcttatgtttcatacagcagccagaacatttctttgagagcctaagccaaatcatagcatctcacagtttcaaatgttccaatggcctctaatctaatcaagaggcccataaggtcctgcattatctgacttggctacctctatgacctcaccttgtattacagagtccttgtttatttcctctagccacactatctccctgcactacgtggaacttgccaagagtgcccttgactcatggtttttatatgagttcttaactctgccaggaatatgctttcaccaggtatcttctcatctttcacttctttcaaatctctgtcaaatgtcaaattatcattgagatcttccttgactactttatataaagcaataatcctctcttcatcattactcatccatcctgctgtgttctattttttgttcatagcatttatcacttcatgtagtatacatttgtttctctctctctcttccagaatgagagctctaggaacatgagattttgtttcattattgtgttgtcctctttgcctaaaacaacgtaaaggagttagtaaatttatagtcattatttgttgaatgaatagttaaatgatctcatcacacttttgaattataatagttaggattctttacttcaaacacgaggagatgtttctctacctgaaagaagaactgcctttttacccagctgcagaaataatagaagatgggaaaagaattgaggatactattattgtagtacttgagattaaagtttcttgagaatctcatgtctaaatcaaacaaagggtattagataacctatttatgaaagtctcagagatggaagtgatgtgaggggaagctaagacatgaagagacaaagtgaacttgtctaaaaataatggaactgattagtggcaggcaggattgcatctctgactcattagtctctctccaggaatcattcattcagcaatgaatatttactgagtgcctgcttgttcagtgtcaaggagaaagacacagttctcctcttatggatcctacaatttaacataagacatgatattaaaaacattaaaattaaacacatatattcttgggctatgaaggaggagacagtatttgaaaagtggtgtattatgaaaggagactgacacagtctgaagaataaaattaatctttggctaggtgtaatcatgaagctggtggagttttgagtgatgagtggggagttgagaagagaaagaggaaggagatatgttcccggcaaaaggacaagacactagttcctgctgcaggaaggagtggagtgccatcacttaatggaagaaaggcctagttgtcctttgataaataccagactcctgcttcggtatcattattgttctatcgactacttacgaaagcataataggtattaattgtataaccttatatacaatttgaccatgaataaacggtttactcttttaatttcagaaatggattctccattagctgaaaagtctaacttcagtcctggtgttcatgttgatgggcttctttttatctctttttctttcatgttgatgggttcctttttatctctttttctttttttcaaagaaacccctccctggcaatctgtttccttgcagctcatcctttctcatccagctagcttcctatttttattgctgagtcatccaatcagctttaattgtctctctctctccagctggctctgtctttttggagaaaaaattctgctacaggtgcattttttaaaattaggaaaatgtgagtgtctaaatatgggcacagctagactttaatggtgaattttgaaattataaaagatgattagtaccttgtatctttcattatggtgagcaacagtttttaaagcattcatcccatccacaaactgacccatagcactcagaaaaatcttttttaaaacaattcctttcacatggcttgtatttgttgcttaattatttactttcttttctttttagaaagtttagatccatttaaaattgggtccctttttttttttaagacgaagtctccctctgtcgcccaggctggagtgcagtggcgcgatctcggcctcctgggttcacgccattctcctgcctcagcctcctgcgtagctgagactacaggcgcccgccaccacgtctggctaatttttttgtattttttagtagagacggggtttcaccgtgttagccaggatggtctcgatctcctgacctcgtgatctgcctgcctcagcctcccaagaaaaagaattaatcttaagatacactattggtcgtctacagttgttcctaattagtggatttcactaaatgataagtaaaacaattttttttctgcttaggttattcaaatgttaatactcaaatgcttatattaggttaaactatttattaaaaaatccacttatattgccaaataatgtattttgattcttgttggcaaaatcaaagattcaaactactagattcgttatgttttttgggtgaaaggtttgtatttatgtggtattcaaaatgtttccagaatgctttatttatcaaatatttaattcccacttactgtagtcatatagacctagttctacaaattacgttttactaattgtcctctgaacgtaaactgaatatcctcatgtttttgggttcataaataaataataaagctccattagattttttatcccccatgctttacaattattcaggacaccttttcctgatagagtactacagaaaaatataatttaattcagtgtgataacatgaggtgaaataaggcaaacatgaggaatcaggagacttctattttcagctttgtcactatctcattaaatgagctcaaaaaagcatttaaccttccaagcctgacttttcacttctggaggaaaaaaaaaagaaaggtggaacaattatgagaattacctaacaagaattttcagaaattggaagtgtgagtttccagtttctggaataaagattgctagaagcaagaactctttgaatgcatcattatcttgaactgaaatcacccttttagattgaagaagtatttcctagttatagagaaaacaaacacatttacacctctctcaatgtctgtcctcaacccagaatcattgtttgagttgagaaggctggtgaaaaagagactggtttctaatctggttctgacattaagtttctctgtgactttggtttacatctgtgatctcagtttccttatctgaataatcagaggattggattatgtactgtgtattgtctaatccagttttaactaggattgatgtatcccaaccatctggaaggatgcctggcacataagagatgctcaataaataatagattgaatgaatgaatagatccttaaagtaccttcatttggtttgttagatagggtactgtagacttgtcagatacagggactgcaaggatacttgtaaaggagcaatattatggggatgaagtttgaatgaactaatgattttctctcacttgctcaaacatgaagtggagggggaggctattggaattttgctgagatttgcttggtcattttttgtatttatgttcctatcctccctccctttcgactgtaaatgaatttatataacagaactggctttgataataataatcattatatatatatatgtattttaaagtttcctcacatagtttagttccataatgctctccgtatttgtcttctgatactagtcagaaaatttaaaaaaattaatttgaaaataattttagatttatagaatagtaaaatattatatagggtacttacataactttcactcagcttctgaaaatgttaacatcttacataaatatagtatatttctcaaatctaagaaattagattgggtatattgtacattgtacattagtacaacactagctacactacagagtttatatttcaccagtttttccactaatgtccttttcctattgtaggattaaatatgcataccacatcactattagttgtcatgcttctttaggaatatatgatgtttcttagtctttccttgttttttgccaccttgacgccttgaagagtactgggcaagtattttgtagaatttgttcttttacaatgttttcttatggttagactgcattattcacttaggaaaaatgctgcttagatgaagtgctcttctcattgtatctaactagggttacataacatcaacataacttatcactggtgatattaaccttcatcacttgattaaggtgatgtttaccagatttctccactgtaaagatactatttttcctttcccatactctgttcattagaagaaagtcactaagtacagtttatactcaaggagagagaaattaatctctaccacccgagagaggaatatcaaagaatttgtgggcctgagttcaaatcaccacattaattaataagtattttggggaagttatatttaggttatgcaaatatcctgtttgtccttaaagtttagtccactaattttaacattcttcaatggagcttggctgtagcaaatattactggggtattctagtggtgattttttttctatctccctcatttcttctatctccctcatttattctgcatttattatttgaaattcttctataaatgaaatcttccccagctaattcattcattcattcatttacatcagcgtagattcatatttattcagttcctattcgatactattgtcatttattttgtttctcaaattgatctagctttagctaattcttttgttaggataccgtatattttttagcacttccttattttctggcactacacaatgttcgattcaccgtgtattctctcttccccagtttgaatctgcaatttttctagggatccatagttatttttgttgaagaacagtatttagaattgtgatgtgggtgccagatacgctcattgctaccagggtatagaagtggcactgcttctaggcccttccaagacaatggaagcaattttaaacgagattagtgcctgtgtatgaaaatatttcttaggaggcttggtttctacttcttctcattacttctactactttaggagtttgatgtgactgattatagattcctcacttaagaaaaaaatcaatttttctaccagttaagtgctaaaaccattttcaaagcaaataccaggaaggaataagatttcactactactaaaatagtaattactctcaaaatgataatttcaccctagattgctgtttcagactttcatgtttaactccccaccgaatgctcctacctgtaagtctgcatggtgcttcaaacccaatatgttaaaaagtgaactctttatatcccgtctagattgctgtctctcctttttttttattttattttttgatcagtctcaactgcagcaccattcatctagccatttaagttagactctctatcagctcacctatacaatcaattattaagtcctgattattttacttcctaaatataatatggaatttgttctttcaaaatgttttctcatgattagacttgagtcattaatgtttagaaagaatactacagaccatcttgctctagctcataacttcattgccttccttacattgggtgaattacacgtgttctctaactgctctttgtttatgttagccttatgtttttcaaatccgttattctcactgctctagcaaatatcttgctatgctacttctctgtttaaagcctctcaaatgacttcccattgtttacagaaatcaatctagctccttaaaatatcatacaaagcattctaaacctctttgttcccacaatcactataggcttctagttcaggtataagctatttccattttgtaatgcctctgtgcttctgcttatcacatcctcttagcaggaggaatacctccgtgtccctttctttagtattcatccccacccctcaccacaacacacacccgtatcttccaggattccttccctgacttcattttgtaagcttgtttagtagattttcagtgcaacaatggcttcctgcacttatgtcactattagtattattgattgcttataacatggcaagaaatctactaagtgcattagctactttatctttttcatcattcctaaactattatatctgaatttcccatctgtgttctgcctcttctagtataatgagctcctgagaaaatgcatcagagcttacgctttgttatttcaccagagagaacagtttctgacagatagtaagtctacaatatactttgtagcaaatgaatgagtagactctggaacaggttgggttggggagggaaaagctatagtctcattggaatgtctttttttaaattaatttatattcctagaaattggtaatgcttgctgctaggaagatgttgatgagaactagtaaaacaactaataatggttactccttagtaaatatttacaatatgaaaacatttctcctaaatttgtcatctgcattttctcaagtaaccttcacaaaacactacaaattagattttctctcaattttacaaaaggaaattaaggctgtggcagaaattgttaagaggttcctctagagttcaccataccattttgttcactctacctaaaaagtgggaaatgaagtggcagggccaagttcatgccaatggaatatgaatggaaatagcatgctttatttctatgcctggcccataaaacttcaccacactttctcttccattctcctttccattctctgacttaacccatggtcaccactcgtggaagacagtggaaccacagatggaaggaacttgagtcctggaatttctacttggagaagagacagttgtccatgaggtacatccgttggactttaaatgaacatgattaacttgtgttttaaaaacctgagatactagtgtttagttgttgaactcctagcatcaccctaactaatgcagaggttgacagacattattaacttgtccaaggtcacacatttctaacatttctataaaacatgtgcaagcaattgaaagctggtttggtctgactttatagcttgtgttctcttaacttatatggcagccgttagtaagtataaatatatatgtttttctgtttttcaaaatttgatttagggcttgccaagtatttttgaaatcactgctcccacctctagctcctactaaaagtttgccattataaatgataacaacatttccacagacttgcctttgtcacaggcatctttaagactacaataaatgctgaggtatttaggacacatttgcgggataagtagagtaagcaacatttctaggtttttgattgtgtttggaagcatggttgtatgtttatggtaatatagttactttattttgattaaaaaatcgaaggaaaaatggagctatttttcctattttcttttcctatttggatgtatcacacatatatttcaatcaaccaagtttgttttttatttaatggaagagccaaaggatattttttcattaacttctctttcttcttttcctggatcttcaatgtaatgtaaaacaaagattatggttttatcaatgcaaaagacttaaattttgtggccaacttccaacattactgaatatatcactttgaaagtgttctttaaacgctgagaaaatcttattttctgtaaagtaaaaataataatatcttactcatagaagattaaatagaataaactatttaattatagttcttaacatacaggagccaaatcagtacatgatattagtgtttattgtccttgtgactattgttgttattttaattttttactattttaggcgcactctcagcccttaaaatacccttaacttttctcaaacttcaaattgagcatctgataagtttttctacttttccattattcgtttcctgaaagttgggtgatctcatagattataagtgctccatgtattatcacgttatgcccacagtttggcattgcattgtgaagatttatctgagaagttattcccagtttattctttcctgttaaatgtaaaatgtgtatgaactgccagtcttccaatacttggccataaaagcctttggaggaaaaaaaatgccatcttttttttttttttcaagaaaaacattgttatataccaaatacctcttttagtcattttcatttgcatacttcctgggtatgtaaaattatttagcatagtgcttttaaaaatgtctttatagacgttcttttattttagttcatgatttgctgaagtcattttggaaaaataattttggtgttttgagttgaataactgttgcatttcaagctattttgcaagtcatcaccatagaagattcgtttgtaatcagaatttcttgaggacggaaatgagatcaggccataatactcttccttcatctttcttctgatcagagaagagccaagacatagataattgaaaatagtaattaacctcaaaccacgtgtatttggctttaaagttagtttcatgattttgagaaacagctgtactttttaaattagatatattcagaaaatcattaatatagctttattccttaagcttataacaaattttatcaaggggcttcaggcgagaattgtgagaagaggctagaatgatccactgagaatgctttcaatcaactgttttattctgtagtcttgcaattaaacactacattctgtacccacactagcatctctatgaagtttcagtgtgttttcaataagcctttctgcaattgaggcataaaacatatcccagtattgtttctggctttggtttatatttggaataagatattaaatgtccagagcaaaacctatagccatctgcgtaaaatgaatgtttatactttacttctctgaggtcactttttctctcactctctattcccaaaagatcatgattcactatattgagatgcctagaattatcaggtcagagtgcttaatttgcaaagatttctgttaaacaattaatgtaaatgtgattgttttatgtgaataaatacttgactactcattgttatttatatcatcttgcttagaatgaaagcagtgaaatctggttacaggaaatgatgttttgttttgttttgttttgtttttagctcagaaactcatcaattgagatatagagacaatttccagctttggaaaattaaaaacaaattaacgaagttgaattacgtttttttttttttctctgtggttttgaaatatattccactctccacctgtgaatatgcagtttccaactaaatgaaccaatagatgaatttccaaatttgaatttcaaattattgggagttgggtggggtgacataatctggagtgtgaaatatggaagtggggtaacagaaaattgaaaattcaaaaacatatgagcacaaatgaaattcttttgcagtactgtttatatgtatcaaattttgctgctttagcttcttttctgttttcatgcagctcatttagtattaaaacgatttaaggaaataggcagaggagaaatcattagagaaaagaggagaagccacagggatagttcacaaattggataatcagtccctaaataagtgagagatgaatatatttgaaagatttatcaatagcaaaaaagcctgaggtaactttaaaccacaaccattgtcaacgtgaagaagtgacctatttcaagttttcgctttctttttgtgtctcctttggcagcttttgtgaatgaatatcatgacctgccaccagcattacaaaatacagagaactctagtttgtattcagacatggatattacaagtgtatttctactttttaactgaagtttatcactgatttcattaatatgacggatttatgttttcctaggaaattaggagacagacggataaatagttatgtataacaggaattaataaatgggggaattcatcatcttccaggatacaaatgaaaatatagacttctgatccgcaagataagatattgagggaggaacttttggaaaatagcagtctgggttactaaaggattcttgattgtcatggatgagtatcacatgaacaacagatgtccattgttactaactgccttagccatacaggaaaaacagtatttggggagccattggtacatcatttttccggacctgctatacataacaagaataaacctaaggctaaatagctatgttttaaaaatgattactggacttattttattacagtaaccatttctccctacacttgaatttggagtgctcataagactgcggattatctgcaataccctgaatcataattgagactatttctaccacagagtataaaacatactaatttggtgatgactattgatatggcaagtttttttttctaattttactgaagaatttttaataaaaataaaattacattaaagaattccttccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttccagactttttaatgattgccattctaagtggtgtgagatggtatctcattgtggttttgatttgcatttctctgatgtggcacatatacaccatggaatactatgcagccataaaaaatgatgagttcatgtcctttgtagggacatggatgaaattggaaaacatcattctcagtaaactatcacaagaacaaaataccaaacaccgcatattctcactcataggtgggaattgaacaatgagatcacatggacacaggaaggggaatatcacactctggggactgttgtggggtggggggaggggggagggatagcactgggagatatacctaatgctagatgacgagttagtgggtgcagtgcaccagcatggcacatgtatacatatgtaactaacctgcacaatgtgcacatgtaccctaaaacttaaagtataataataaaaaaaagaattccttcctccaacgtttgtattgtaaataattaactatttgaaaatcatcatagggatagctgccagttgaggatagcttaaaatataaatatgcatcttccgatatttagtttccctttgtttctctggaacacacactttgtttctctggaatacaataattgggagagctaagtacctctccttgtgaggtcatttccatttagctttttgaaaacagaatggggcaaagtgatctataataaagaagaatggctactatacttttcagtgacatcagctggtatcctttggctttgagacatgtactcttcactttcagggttcatcagtgtagcaggaaggttgagtaaatgcatacaaaccaaaagaagtataaggaaacaaaataacatgatctgatacaagtcaatggaatccaaattacgaacacttgggcctcaggaaaccaatatttaatggtatcacttcataatatttgggattgcataaaaaagtatgtagttaccttttaaaataataaaatgatttcaatattaatcagtatgtgttggctgtcattataaatgtgctttcctttatgctaggcactggaaatggaaattgttgtaatacacaaaccttgcctccaagagacttagtgcctatgaagtcggaaacttagaataatttttataggttgaaagataaatgaatgatacagataataattgccattaaagtttggaagacacttaaaatcaaagatgattttctggaggaattaggacttgatctagtacttgaaaatagaaacacttcttgggtaagtagaattgagaaaattaaatcaagactccagaaataacatagaaactccagaaaattaaatcaagactgcagaaataacatattgactactgggagatcagttatcacccttgtgagtgtgatgggtttgttactctgtatgtcaaaggttttaaacttggaataggattcaaatatttcataaactctgaaaacttgtttgtaaatatttgtgtttttgggcaacatacatatttataagatgcacttcagatctatatttttttttcagcttcccaaagaggtgtaacttctcccaaaggttaaaattctctgctctatattaagatttgtctccaatgtagttactttttccatgataattttcttaaaattgactgtccaagttgttgcatgttttatgctaaaatagaataattttagcaaagatagtcttcctagcctacaaaacagttaactgaatttttaaaagaaagaatcatatttgaatatcttctctatagcatgctactgtagtggtacaatatatgcattataagacttcatggctcttatttaaatgtcaggttgtgataaaactaataaatatttattatgttattaagaatgtaatggtaggggccaggcaccgtggctcatgcatgtaatcccagaactttgggagactgaagcgagcaagtcacttgagctcaggagttcaagaccagcctgagcaacatagcaaatctctgtctccacaaaaaatacaaacattagccaaacatggtggtgggcgcctgtaatcccagctactcaggaggatgaggcagaagaattgcttgaacccgggaggtggagattgcaatgagccaagattgtgtcactgcactccagcctggacaacagagctagactccgtctcaaaaaaaaaaaaaaaaaaaagaaaaagataaaaaaaaaagaaaaatctcatctctacaaaaaatacaaaaagttaggcaggtgtggtgatgcgtccctgttgtcccagctacttggggggctgagtcaggaggatgtcttgaacccgggaggttgaggctgcagtgacccaagatcatgccagtgctctgcagccttggtgacagagtgagtctctgtcaaaaaaaaaaaaagaaaagaatttaatagtaggacttaaatttcagtggacaaacataggtcacaattcaaaatattcattgaatttcttaattgtcttttacaagttgttttttattattattaaacaaatccaaaataaagccagagtttttgaacagacatacttctcttttagattgttctagataaaaagagtcttaaggaattttccaactattctaaatttcatagtaattgttttatggacatgccttttatttatgcagaagtaatttgactattacaaaacatagtaagtgtgcaatttaaagaatattttaagttttctttatccatctagtattttcttcgttctccactaagctgttaagctaattatgggatacaaaagtacagattaatatcttaagtaataaaaattatatcattaaatctaataattaagaaaaatatttcaccataagatgtctggcatttgaatatatatattaatcatatatacatatatactttatatttcaatgtatttaaaatatatagagattatatatgatattctatattttataaagatataaatgtacacacatatcgcaatatataaatgtatattcttgaaatatataaaactgaaatactttcagtcttcatttcagacaacagtattaatttcagcatgaagttttatttttcgattttagactctattctttctgtatccacagttgtatttattgttatgcagacatatgactttatattttcacagatagttctatagggaggtatttacttcaatgtcctttgttgaatgtttcttacattctcatggctattttctgctagaatatataatccacagaaaaaagggttcaagttaaagagggattaaattctggaaaggacatttatatataaaaatcacacctcttttaagtataccctctatattactgctaagctcttctataacacaaaccttatcctctcagttccttatttaaactgtgttcatgagttactatcttctgcgggatgcaatcatgacctattagcatcatacacaagacgcttcttgatctgacctcaatttatcctggcatcaatttttgctgacatctaatgccaaggtcttttatatcagcttcacacaattactcaacattcctcaaaagagccatgccatttcatcaggttggtcacacctcctgtgaaatttcactcatcccctcaggcagggttagttggttcttcctctttgcttctcctgcatgttataacactgtgataacttccttaaattttgtttacaagtctgtcttcacctttaaactgaaaaatcttggagggcaagggctgcctcatttacctgtgcatttcttggcgtgaatatatagtatggcacagagactccatcatggtttatataatacattcacaccagtcaaggtagaaatgatgttgtagctattatagttggattctttttaaggttttatggtcaaaattactatagaatctaatagagaatattaagatatgcccagagacttatacacattgttcaatttatcctactattgtgagacagcaaccatatcgacagtattttgagcattaatattccccataatccagcatgacaaagggaaaaaatgcaacagttggagagttgctgtttgtttttattgaaatattttattttacaacagagctgtaattgttaaattatctatcttattgttgatgggcatttatattaccccagattttgctgtcgttgttgtgcaaactttattttacatgtcttcttgtgtacatttctaagatttttctctagggagtatacctaagagtagaattgcaagttacaagatatgggcagtttcagctttacaaaatgatgccaaattgctttccaagaaatcgatacagtattctcccatcagcagaggagagagagttactgttgcctcatgtcctctcaaacacataatactgtcttcttttcatttttgccactctgacttgaaatagtatcaggttttggtttgaatttgcatttccctgattacaaagaaggtaaagcatgttttcaggttgtgagtcatttaaatttcttaaatgtcttttgccatttttttcttctactgattcataggagtcacttataagacacatttatacagtttggaaatatcttcaactagtttgcagcttgcatttgtacttttttctttgtacttatttaattttgtcttttgatatactgaagtttttaatttgatagtagtcagtttattaatattttccattattaatatgtgcttttaaaaatgtattttctaccctgaatcataaagattttgaagaatttttaatttaaaatatacctttcatgatgggttatgtcattttccatcaaaattgattttcatatactgtgtaaacatttcttaaatgcatatcttaattttatgactttatcttttcttccactgatctttgtaagtgtgctaacaccaaactaacttaattactgtagccttatattaagcatttaaagctaagaaggcaaattttcctgctcaattcctctcatttagaactatgttagctattttcatcaccatataaagaagtagttcttcatcagttcacacagacatcacacatacacacacacacacacacacacacacacacacacatacacccatcctacccatttggaactttgattaaaattgtaatgaatttattgatacattagggaaaaattgatgtctttacaatattgaattttcttagttatgaacatggtatgtgttctattgatttaggtattacttattatcatttttgaataaaattttacaattttctaaatacagtttgcacattttgttagatatattccaaaatatttaatactgaagttcttattttaaatagtatcttattttaactttcacttctaaatatttgttgcttgtatgtagaaatgcagttgatttttgttaattggttttaaatccagcaacattactaaattcccttattaattctaataatgtgtttttatattcttttgggctcccattatatataatcagatctgtggctaattagagttttgtttctttatgaccagtattattatttattttaatgtctgttgcacaggctaggatctcaggtataatgttgagtagagaaggtgacagcaggtattctttcttgtttctcattttaaagacaatgctttaaatattatcccatcaatattatccctgttgcttttgccaataatttttattaaaggcagtaagttgcatttccctgattctattcttagttttctaagagctttcaccatccatcagctgtttgtattgaataccctttctgtatttatcaagatgactctctctctctagatatatctagatatatctggatctatctatagatatatatatatatataatgatattgtgatctatttgtctatatcccaatatcatttagttttaatctaaaatgtcttaaactaattaaataaggaaatttctagtgttgagacaaacttgtattttacattcctggaataaatccaacttggtcttgatgtcttatgcttcttttattaaccattttggtgtgctattatttttagtatatttgcaaaaatttgagatttcttttatcaaaatgacctcttctggttttggaatcaagactataagaaccacataaaatagactacccttcttgttctattctcttaaaaaaggtatttttaaattaaatgcctttcttccttgataatgtcccatttttcatttgatatttttgaaaattttttaataattcagttttcaaattgttatttaaatcgtgttatttctactttagtcatgtttaatgatgtatattattttccaaaatatgtctttacctaagtttcaaatttgaaggcataacagtgttcatggcttatttcatatggtaattttaatacctactcctaatcatatttttttaactttctttgaacttactcttctgttccttttctaacatctcaaatcagatgcttagtttattaatttctcatattttttctaatgtgagccttaaagattgtctttctctacataccactttaatacattatagaagtttcatatatagcatttttatcattccttagttttaaatctattatctgaatatttagtttatcctccttaactttacatgcatatttagattcattcgtgatgactgttttgttatttctattatgagagctcttaaaacttattgtactttagtggggtttatttgtttgtttgtttatttattttcatttttttacctttcgggattgagtctttctttccaaagccaggcctagatagatggtgtgcttttgtgggatgggttttaatccggtttatgtgctggagttgtgacttttgtcctgtactttgagatattgagggttctttgatccaactttccacctgcttgaaagccctgtgcttcccccaactccagctttttcactaaggataaatactcctttcaaaaatattctaagcccctagagcttagcatatttcctcaggataaatgccagcccctaagtttaccattgtgaaatcatattctctttttttcctatttttaattattttttctttttttgttttacatcagcttagacatgatatacatatatatgcacccctaccccacacacaatctgttctgtaccaggtggagtttctgtatacactcactttgttatactgtctaaaacaaaaatcgtttgttctttttctatttttcactaggtttaatgcaaaggaaaatgttttaaggtataaaagtgagagaaattttctggcaatggttgcttaagtagtataagagtcatggtgttcttgatggtggaaccataaactgaaagagttggctgacttaacatttccaaccctgcctggggaatatttgacaaagtttgaggtgaaagtttgtgttaaaaaattaaaggatgtgaagctaatatttcccatcaagtatgcttacctttgaattttaattttgcttataagtttcattattcacacacaagtcagaaatgttaatttagctctttctttagatgtattaatttctctcacaaaatgtcttttcaaacttattttttaatcttcacaggtgagttaattttctttaatttgtaatcatttttaaacaatattaccagagtgatacatctactctttaaaattgtaaatataattatgctaagagaaaaatgaaagtcctcattcagatgaggactgactccaatagtttcattcaccagataacaactgttaattgatttatctacattcttccagtctctttggctatgtactcatgtacaatgtacaaaaactttataaaatctgcacaatttttttttaattttgataatgctgtccacattactctgacactagttttcttcagttaagaatatattatggacatcttaccattagtctgagaactaccttaatattttaagtaatggtgcagaaatttattgtgtttctacacaacataataaatgattatttaacttattggcatttagattgactctaattcattgctattagaaacaatgctacaaaattattctcctgcataactaattaattttacaattctttttggagaataagttctagaaaaacaattctagagttaaagacatgaatgtttttaattttgaagagatatgattaaaattacatattaagttgttagatagtaggttagattcacaaataaaggtacccatttaattttaagcatctacacacttcaaacactggtctcaaaaatatactagtaatcaaatatttggcttgcttttattgcctgtttgatttaggttatatgctcaaacaggaagactttatacttcattttcaatggcttttaataagccttcagtgtataaaatctgcaatgttaatagcaggtaatatacctgaaaatatagcaaagcaaaataaagatttgcatatttgctgagatgtgggtaactcctcttattactctgcctgctccccaccagcaaaatagtattatctgataaattttaactaaagtaaatcactgtttagatgcggtctttgggtaactttataactataaagccatattcctctttgcttacatttgtgaattaagtatgaaagtcattttgtacctattttatcatattttaaagttgtgtctttaattttgttgttactgctctttcaattatctgtacatgtcttatctgagaaagttgtctatttacattttgttgccagttcttacagctaaagcattcattagctcaagtgaatcatttttttaaaaaggttgatatatttagcttctgtgagcctatgacatgtaatttatctccctgtattattaatacattttgaataatcatttatcagcagaccacagaacagtagttcatagacgctttgtcacctgtatggctggctccctaatttctaacaataccattatttattagtaagacctttttagtgtgtcaaaagcacagactttctttcatgttcctaactggaaagttgaataatggcattacaagcagaatcattaagagtgtgtaagcgccacccagactgcagactgcttttgctgtaatcttggcactgccacttgctggcggtatcactttagacactggtaatttgcttatcttctctgggtagccacatctataaaacaaaaacaaaagtcttatctatctcacagagttgttgtaaagatcaaggaagtgtttggtctgaccacttagaaaattattggcagctgggttatttctacttgtcattctgtcaattctgtctggaaagtatatttcaaaaatcacttccacttgagttttgaattcatttgaataattttgtgaaacatcattttagggctcatttcttgtaaggtttgattggctaagtttttgtgttatattatctactcatgatctacttttctttgaatgtgaagaagctattcaaaagctatttttgaaaatggaaataaacctattcaataataaacaccgtattttgtcatactgatcaaaaggaaaaccaggagccattctgtttctctaagaatgcttaacattgtagcttcaaacagtaactaatatggaaattttatcatacaattagtcatattttaaaaatctatattggggcatgttttcaataactggcaaagtttcattttgtgttatgctattctgttgggcatgacactccacaattgattactgttttaatggtttttctggcagtaaagattttgtaggcaagaattgcagctatgaattggatacaggaagccttgtatctgattttccctataacaaattcaaccattcaatgctatgtttagagtccattttaaatattctgtagaaagagcataaaataaatattaaattaaaaaagctccctgcaagatatgccatcatccactttcatccaatattcatctgtaaaaattagatgccagattacataatcttttaacaaacactgcaggcaaattgtcttgcttctatttatcactagatagcagcattttatgactttttaatgtgatttattcagagaagtgatggaaacatactggcaattgttctagccattagaacatctacgatccatatatatcttaaagtatatacttgaagggatgtctgagaatggaagaaaattggttggaaaaggtatgcttggcaatactaaaacagcaaatggattcagactgcatcagatattataacagggtacacttgggttatcacctacaatattataggttgtgttttcctgccttcctaaactcctaaagggatgaaaagtagggaacaatatgccacttatatcgaactataagaaataattagttgaaagatattcaaccatgtttttaaaatttcatactttactgtataaccactgtaactgtttttccctgtggaattggacagatatttgattggattagtttacttttgttgatattatgtgggttcagattgcttctgatcactagaaataatgagcttaagcacacgtctactttcactgattattaagaatagaagtgaaatctgatcacaaaagaacctaaattttttgccactatatcaaaactgtgtacatgtgtattcgctggagttttaacaaacacttggagaaggtgcctctcaagcacttgaatctgaagagtggattgcaaagttataaataagtgttctatcttaatcacaggaaaaataaagacacattctgtcactttttcttggtcagcaatcatagaagtacccaataagaagcagcaatattctcaactattttagataaatggaagatgagaaaggcacatgtattagtttactaggctacaagaaaataccacagactgagtgtcttaaacgacaggaatttatattctcactgttttggaggctaaaagttcaagataaagatgtcggccagttttgtctcttttgaagcctcttcccttggcttatggaagccttctcgctgtgtcctcacatggtctttcctctgtgtgcacatccatgacgtctctttgtgtgtccaaatgacctcttcttataagtatactggtcatattggattagggcctatggtaacaatttcattttaatttagttacttcttcaaagaccttatctccacatacaggtacattctgatgtactggggaagcattagtccattctcatgccgctaggaagaaatacctgagactgggtaagttataaaggaaggtggtttaattgctcatagttttgcatggcttgggaggactcaggaaacttacaatcacggcagaaggcacctcttcacagggtggcaagagagagaatgaatgcccagtgaagcgggaagccccttataaaaccatcagatcttgtgagatctaacacactatcacaagaacaggcttgggggaaaccacccccatgattcaattatctccacctggtctctcccacaacactggggattatgggagctaaaattcaagatgagatttgggtggggatacagcccaaccatattaggagattaggacttcaacatatgaattttgggaggacacaatccagcccataagggcacactttccattctttctcacttaatatttggaaaatatagatgcattgtcagaacgtataaatgctttctttagcccttttaaacaaacaaaaatagtgcagtagttagaatgcctgaatacaactaatcatgaataactggagctcagacagcgtttctaaaggactctgggcagccaaaacaaatatcaaaaagtccgtgtacaaaagatcatgtgctttcctcacaggaacacatcttaggcccttactccaatctgatttatttaaagtttatacatgtttgtaacaaaaattatgatttgatttcctagattttagctgtcatctcctagcttctgattttacaggtgagaaacacaggccccaaaggtcaatggcagaatccacagtaaaactttccttcctagttgtataaccggagctttcacatgggctgcttgctgatgatttgggattgtcttctagcatctgagcctcagtagaatctattcattattggaaaaggatgttgaaattactgtgtgacaaaacacttcattagattttttttgttccaaaccataaaagaaacacctactcattaagacaagtcaaatgacatagacacacaacaaaatccagatgtgcccacctactctccaaggtggactacccaatttgagtcttcacctgtcctctaatttgcagaagcattttccattttcagctttttctgatagttggctagagactagaaaacataaataggaaaaaaaatatatattcttccaaacttttactcaatctcccatatcctttatatttcaatcctataggagagaagtaaagtgattgagcttcactttttggattcttcccacccaacttctgactgtttttcttcacagacaacagtttttgctatttaaagtttagcctttctgcaaaaccatgtttaaatactatttttgcaggaagtgcttcctaacttctctaacccatatagaagttaggagtccccaataacagtcactggctggaatacttatttgacattcatcttgtgtatgtatgcctttttcttaaattggtcacagacctcatgacagaaaggggtttgttcaacatctctatgaattggccatttctcagatcaggaattgccagtgaagtgcatttttgtctcctccaactgtttccagtgtgatagctttgaagtgagatgttgttaagatctctccttgcggatgagctggcctgagaatttttggagggatctactaatggctagtatactggtagtataattttacatgcaaaagaatattttcacaggttctgaagttcttacagcaactaaaaattttatcacatatgaaaattccaatgactctacaatgtttccattattaaatactgggaacatattaggattttaagagaatatgagtgattaacatattttgatccagggtatatatgatttctggtaaaaagagagaaagtaggaaaaatattttggggtcaattaatcaaatattttactcagaactcacctgtctctttctgccttgttgctgttttgatgaggttattgagagataaagtgcatgtgtgtgtgcgtgtgtgtgtgtaagagagagagagagagaatggaagcaagcctaaaattgggagattatgcctaaaactataattacttttatagagcaagtcaggaaaaaatgacaagaccacacatctaaacacattacagtgatttttccttgctagcttgatagtgcttttagtctttagcctgctgaaaccaataggtgctgagttatgaacaggcctaggcaaatggtaatgttttacttttccttctaagcttgttgtctctgtgtggtcttgatgagaaagaagaaacttccatgttaagaactgcagtgaattcagtttcacatttatttcagtgaaatagcataggataaaaaaagatggaaaaaaaaaacagaaaatgctactctagtgtgcaatgtgtggtcatcctgcagagacaacttaattgataacacagccacttatccatggcaaacatcacgagtctaaatatcacacaactttttttcacaacaatagtaaaaagcaactcgactattatttttctaactaagaagtatcagatactgacagaacttttaactgttttaaagcccaaacttacagtgattatcttttgtttttttaagtggtagcctcagcagtttttatctgaaagaggtgactttatctttttaaattatactttaagttctagggtacatgtgcacaatgtgcaggtttgttacatgggtttgctgcacccatcaactcgtcattttcattaggtatttctcctaatgctatccctcccccagcccccaccccctgacatgccttgctgtgtgatgttccccgccatgtgtccaagtgttcttattgttcaattcccacccatgagtgagaacatgtggtgtttggctttccatccttgtgatagtttgctgagaatgatggtttccagcttcatccatgtccctgcaaaggacatcaactcatccttttttatggctgcatagtattccatggtgtacacatgccacattttcttactccagtctagcattgatggctatttgtgttggttccaagtctttgctattgtgaatagtcccgcaataaacatacatgtgcatgtgtctttatagtgatttataatcctttgggtatgtacccaataaagggatcaccgggtcaaatggtatttctagttctagatccttgaggaaccgccacactgtgctccacaatggttgaactaatttatactcccaccaacagtgtaaaagcattcctatttctccacatcctctccagcatctgttgtttcctgactttttaatgatcgccattctaactagtgtgagatggtatctcattgtggttttgatttgcatttctctgatgaccagtgatgatgagcatttgttcaggtgtctgttggctacataaatgtcttcttttgagaagtgtctgttcatatcttttgcccactttttggtggggttggttttttcttgtaaatttgtttgagttctttgtagattctggatattagcactttgtcagacaggcagattgcaaaaattttcttccattctgtaggttgcctgttcactgtgatggtaatctcttttgccgtgcagaagctcttcagtttaattagatcccatttgtctattttggcttttgtcgccattgcttttggtgttttagtaatgaagtctttgcccatgcgtatgtcctgaatggtactacctaggttttctttaagggttttttatggttttaggtctaacatttaagtctttaatccatcttgaattaatttttatataaggtgtaaggaaggggtccagtttcagctttctacatatggctagccagttttcccagcaccatttattaaatagggaatcctttccccattgcttgtttttctcaggtttgttgaagatcagatgattgtagatgcgtggtcttatttctgaggcctctgttgtgttccattggtctatatatctattttggtaccagtaccatgttgttttggttgctgtagccttgtagtatagtttgaagtcgggtatcgtcatgcctccagctttgttcttttttcttaggattgtcttggcaatgcaggctcttttttggttccatatgagctttaaagtagtttttttccaattctgtgaacaaagtcattggtagcttgatggggatggcattgaatctagaaattatcttgggcagtatggccattttcacgatgttgattctgcctatccatgagcatggaatgttcttccatttgtttgtgtcctcttttattttgttgagcagtggtttgtagttctccttgaagaggtccttcacagcccttgtaagttagattcctaggtattttattctctttgtagcagttgtgaatgggtgttcactcatgatttggctgtctgtctgttattgctgtatagtaatgcttgtgtttttgcacactgattttgtgtcctgagacttcgctgaagttgcttatcagcctaaggaggttttgggctgagatgacggagttttctaaatatacggtcatgtcatctgcaaacagggacaatttgacttcctgttttcctaattgaatcccctttctttccttctcttgcctgattgccctggccagaacttccaacactgtgttgaacaggagtggtgagagagggcatccttgtcttgtgccagttttcaaagggaatgctttcagtttttgcccatttagtatgatattggctgtgggtttgtcataaatagctcttattaatttgagatatgttctatcaatacctagtttattgagagtttttagcatgaagggctgttgaattttgtcaaaggccttttctgcatctattgagataatcatgtgttttttgtctttggatctgtttacgtgatggattacgtttattgatttgcgtaagttgaaccagctttgcatcccagggatgaagttgacttgatcgtggtggataagctttttgatgtgctgcaggattctgtttgccagtattttattgaggatttttgcatcaatgttgatcagggatattggtctaaaaaattctctttttttgttgtgtctctgctaggctttggtatcaggatgatgctggcctcattaaatgagttagggagtattccctctttttctactgagtggaatagtttcagaaggaatggtagcagctcctctttgtaagaggtaacgttatcttttaaggtaaacaaataatgaagcagataaatgtactgtttattttgagggaaatattaaacacctattctttctctagttccttgccttttcacttaagatattcttctaattttattttggataatacaaaagttctagagctattctaatttagtttattcagtcagcaactgttcctttagtatgtaattctgatgtaaattatggactgtttgccatgacaaaatgtgcatagcttaacacagaactttgcacataatttcatgattcatggacaacttcaacctcacctagggatcctagtttaaaaactctaactaagtggcaatttgacagggagaaattatagcttcacctagacaatccatgttctaattccctgttccaatacaataacagctggagttttgctgcttgcccctgtgtgtttcatgcctttctccctgtgcatgattatgtacacaaactgttattcattgacattcctatttgatcagctgaatttctcttgaatgggaagtcagattaaataaattatagatttcagtctttgtgaaagtcattgtcactatgtgtatttactgtgatagagcaatttagaataactatttttttaattatctactatgtgcaagtccctgttcatgcactgccttttttaattgcctcaataatctcaatgaggcaaataccattacagaagcttctcaacttacagttaggttatgtcctgataaacctattgcaagtcaaaaatatcataagtccgggctgggcgtggtggctcatgcctgtaatcccagcactttgggaggccaaggcgggtggatcacaaggtcaggagatagagaccatcctagctaacatggtgaaaccctgtctctactaaaaatacaaaaaaaaattagccgggtgtggttgtggtcccctgtagtcccagctactcgggaggctgaggcgggggcgggagaatgtcgtgaacccaggaggaggagttttcagtgagcctagatcgtgccactgcactccagcctgggtgacagagcgagactccgtcaaataaaaaaaaaaatcataggtccaaagtacagttaacactctgataaactcgttataaagtaaaaaaaaaaagtcatatgttgaaccatcataattcagggaatagctatatcatccacaagatactgagacacagaatgacatttggttgtttggtttttttttaattgtttcatatagagtcaaataaaaattataaagtcatatagctccttaaggggaagagccagcatagtatgctggaccacaggatttcaaagtctctattcatttaactaaattataccttaaatatatctttagactatagaatgacttactgaaatttaaatatggaatcaccaagaaataaaacatattttagcaaaatgagacaaaacaattgaagctccacagcttcaatatagcctgatgtggtggcatgcacctgtaattccagctactcaggaggctgaggcaggagaattgcttgaacccaggaggtggaagttgcagtgagctgagattgtgccactacacttcagcctgggcaacagagcaaggctctgtctttaaataaataaacagggtgtttgagcatcaaattcttaatttgcatatattttgattgtcttcagagctaccaacttggccagaatccaagtgaggtaacccagctgggaaacacagccctgaggattgaatttcttcttgtgcatgactggtcttgacagcttagatgttagagggcttcaggcttttagcttttagaagtttatacactgtatatatctgcatttcaatttctattgttctctattacttggaaaaaaatatcctgcctttttgctatattacctgttttaccatttgtctttcttttcctggataaagtcattccacatccataactttccatgacagaggttcccacaagtatttcaccaccacatctgccctgagctccaatttcagattactcttagatgttttaactcaaacactccacaggccagaatttccaagtaactttccttgtcatgactaattaatttcattctttatacctacactgatagaacttctgtactgtcaccataatctaaataacagaaggtagtagggggaggttacttagggatgaagaaagtgatgaatttggttaatgtcagatgtgggttacttaaggagacatctccttatgcaattatggtaaaaatctggatattgtactagaattgtggttttgagaaatagaaaatctaagaatgaaaaatgtatctatttttaatgaatttttttatttgtgataatctggaagattccctttccctcgtgacattgctgactgtgatattcaataacctaaaaatcagggaatgctttggttagaattttccatagcagtcattcagttcaatgattttacttttcatttgagaaagctaggatccagaaaagtgtggtaacattttgaacattttgagcaaggactgcttttcagggctcttttcattcagtagagaggttgggaaagcctcagtgggtaatttcactagcatttctattatctgtgattgattcagcaagactattacctcttccttcatctcagagagaggatactagaggcactaatttatctgaaatgaaagtagaatcattacatcatgataccttgatgtaatattggcatctgaaaaagcaatggaaaataatggtactatcatcatcaaacagaaagaacacttttttccctctgagccctgagaggctgaggcacttggggagacatgaaactttcattccgctaagggaaaccatttagtaaattgccactgaaaggcttttaagggtcccttaagaggtctgcaagtcttaatgtagctctcaaagtgtctgacctaggcccagagaagaacagcagtactctaaatttaaaattcaggaatagactgggcatggtggctgatgcctgtaatcccagcactttgggaggctgaagcaggtggatcatttgaagtcaggagtttgggactagcctgaccaacatggtgaaactctatctctactaaaaatacaaaacaatagccagatgtggtggcatgcacctgtaattccagctactcaggagactgaggcaggagaattgcttgaaccggggaggtggaagttgcagtgagctgagattgtgccactgcactccagcctgggcaaaagagcaagactctgtctttaaataaataaataaataaaattcaataataataataataataataatgaaaatagctaccccgctgtagccatttaaaagtccagaacacattgtttttgcttctctgcttgttcatattggcagtaacaaggttaaatgaggttccttgtctgtctcttaaacatgtggatattcccattggaactctgcccaggtgttatagaaatttaccagcttcactgtcttgctaaatatggcctaccatcagggataagaggttacaatttgtagtttcctaatataaatgtagcacactgtgtcctgcatcttacatgtggggtgtgtgtgtgtgtgtgtgtgtgtgtgtgtgagagagagagagagagagggagagagagagagagagagagagagagagaatatacctctacctttgtctctggatttctctgctagtgtgcgtgtttgtgtgtgtctgtgtgtgtgtgtgtgtgtgtgcgcgtgcgtgcatgcgcgcgtgcaactgtaaggactaacaaagtcattattctgaaaataagaaaaggtatgtacagaatataggaaaaacatttttgtttggtgacccaaatgatttagagaggaagggatttgtaatttccaaattagttatccttttggaaaaataaacaagtagatattttattaaacaatattttaaaataaaaatatttgggcacattactggctattgtattttcataaaatttccaaaatgaaaacaacgtggttcatgttatttttaaaaatgaagtaaccagtattttctcacatttcctaagtgaagttatctaggcaaacaataagataacttttcattgcttctaaatcttcaatggtttggttcttgtacctatgttaaaaaagacattacctagggtggtttataaggccttattctgtgaatatgtttatgtaaatacatatccctctaaactattcaaataattgatggtttggattcgtacagtgatgttaaaactaacaacatttctttacataagttcataagtactgattgcagttcaaggagctcaaaaacagtccaagaaacaaattcattcaaggaaaagaaagattcttaagcaaacctaatatttttcatttagaacatatgatataatgaaataagattcagaaaaggcctagaaatgtataaatatgataatacatagattaattgaaaatcaatagctaattagtatcatctattatttgttttctttctctaatatagttcccatgaaaaataaaatattatgctaatatcaaaagccaatcaaataatgagctccctattagtgttccatggttagtctcattctccaaatatctttaatcatttacacatacacttaaagattcctttattcttggtttattttcattatgaactccgcatactttaagatttccaatacttaaaacaattgattagaggactaacactacctgacttcaaaacttactataaagctaaaataattaatatagtatggtagtggccaaagaagagagaaatagatcaatctggtagaatacagagcccagaaatagacctacatagagtcaagtaatttttgacaatggagtataggtaacacaatggagaaaaaaataatcttttcaacaaatggtgctggaacaaatggacatccatgtggcaaaaaaaaaaataatctatctagacacagattttacactcttcatgaaaattaactcaaagtggatcacggagctaaatgtaaaatacaaaactataaaactcctagaagaaaacataggagaaaacctagataatcttggattcagtgatactctttagatgccacaccaaaggcacagtctatgaaataaacaattgataacctgggcttcattaaaatttaaaacttctgctctgtgaaagacaatgtcaagagaataagagaatgagaagacaagccagagactgaaagaaatgcatcaaaagatacatctgatagaggcctgttatccaaaatatatcaagaataatgtacaaagtactcaacaataagaatgtctttgctttaatctgattttaaaaatgggccaaagaccttaacaaacacttcaccaaaaagatgtacagagagcaaataagcatatgaaaaagatgcttcatgtcataagtcctcagggaaatgcaaactaaaacagcagtgagataccactatacatctatgagaatgactaaaaatctagaacactgacaacatcagatactgaagaggatgcagagcaacaggaactctcattcattgctggtaggaatgcaaaatggcacagccactttggaagacaacaagtagttccttaaaaaactaaacattcttaccaaaggatccagcaatcctatcccttggtatttacccaaaagaattaaaaacttacattagtgcaaaaatctgcacacaaatgtttataacagctatattcataactgccaaaacttagaaggaaatagaatgtccttcagtaggtgaatggataaataaactgattgatccagacaatgaaatattattcagcactaaaaagaaactaggccaaacacagtgaatcatgcctgcaatctcagtgctttcagaggccaaggtgggaggattgcttgaagctagccccatctctactaattaaaaaaaaaaaaaattagccagtcatggtggcacatgcctgtagtcccagttgctcgagagactgaggtgggaggattgtttgagcccaggcgtttggggctgcagtgagctatgattgtgccactgcactccagcctgggtgacagagcaagaccttatctgtgaaaaacaaacaaaccaaccaatacaatgtaactagctatcgagccatgaatatgtatggaggaagagtaaatgcatattacttagtgaaagaagccaatctgaaaaggctacataccttgtgattccaactatatgacattctggaaaggtgaaactatggagacagtaaaaagatcagtggtttccacaggtttgtgggagggagggatgaataggcagagcctagatgattattagggcaggaaactactctgtataatactaaaggggtcattatacacttgtccaaacccatagaaggtacaagagtgacccctaatgtaaaccatggactttgggtaataacaaagtgtcaatgtagattcatcaactgtaactataccaaagccacaatctatgaaataaacaattgataacctcacaaacattccactgcagcataggatgttgatgttggaggaagctatgtgtgtgtgagggcagtgggtagatgggaaatctctgtattttctgctcaatattgctatgaacctaaattagtctttaaaaattctatgaaacatttttggactgttttcctgatgtattattctacctaatatgaaaggaaatttagctaatgtattttatggaatgaacttttaaccagagatgtgataaaagtggttggaaattaactagcattaaataaacaattcatttagaatataactgaaactacagacactaccctgagatttagaattgtagagtctgaaaaaatacaccagtacaataaatttttgcatctatacctgaaaattgaaaggaaaaatatgtataagtggagtaattatcatagtcatccaattgatatcttgccttgatgactgattgacattttctaaatagactaggtagtgtcaaggataaggaagctgcagtgtatcaaaagatgtgcccaatgttcccatgagcctgaaaatttatagatcagggagatgtcacctttagacaacttgtctaactgtcacattattaaaggaacttaattaactattaagcaatgttctcttctaattattgattcctgtgaccatcagataaataaaaattattaaatgaaatgctagcatctattgaaatattactattggccattaaaaacatgtattgccattcacatggaattatagaactctctagaaagcacatataggacaaggcaaactttactcttttggagtttaaaatttgtgttctgccatctcctattcattctatttatgatcattggtcataattttgttcataatcaaccaacatgcaaaagccctaatttcctgtacctctttcataacaaagaccttaacagagtcaattctccacacatgggctatgacctttacttgtcatcccaaaagctacacctgcactaatggcttcagccatctcatacaactctaaacttgactcactaaacctgatctttttctctatgtaagacttcaaacctggaatcctccttttacagccagttttctagcccctatatcacattatttcttccctactgctgcaaaccccacaactgattttttaatcatattctcttttactgacacccattgctccttctctttcaatcacacctactcacacagtgtattatgctgaaaacagcttctgaggctgattcttacagtctatctccaattgctgctgttacactagagagggaatcttcttttggtttaaggttaccctctctcttttatcttttctgggaatttattctcatttctgtaacataaagctctctctcagaaccactgttgtcttgtctttacatacacacaagcttgatttcctctaccttaaaataaaataaaacaaaacaaaatcataatctcttctttctgcacataaactgtctttcaagctactgccttgtctaactgttataaccaaactatttttatcaggcgtgagataaatgagataattcacaggagagctcagcatgcccagcaagtggtaaactttcagggtaatgttcatcattgcttatatgacattcttattcgttactgttagcagtaatagagaaaagcagaggtttctgggtgctgacaggtatgaaaggcctcatctagcctggtgagtagtcggtgaagtcctcctggagggggtgactcctaacttgaagaatgagttagtagtagttaaaagataaagagtttgtaaagggatttctgggtcttttaaaattatcataatgcctggtggggcaggaggtgagtagggtgtcggcatttagaggagggggtcaggaattctagctatcctgcaacttaggcagtgctgcacaagtaaagattacctaggatttggcatacacagcattttgaagtaaaggaattgctgcacaaatgatgagattctataacattttgtttggaatttaaacaagtgttgttcgaaattacacaatatccactccattctcagtattcgagtggccaatgcaacataactgtttcagtctgaagtactcactgtgattctacctatggggacaaacttattaattcattgtgtcttctagtgtagtcttgccggaatataaatgtacattattatattatcttgacttccctgctatttatcttatctataggggattatatattttttgaatttatgtgtataggtaggttttatattgtcttagttcaagatactgtaacaacttggtataaagaaaagtaatgctggtactttggtggcacataaacgacagaaatgtatctctcacaattctgaagatttgatgtctgagatcagggtgccctcatggtcaggttctgatgagggcccttttctgggttgtagactgccatcttttatctgcattctcatataaaagaaagagaaggagaaagagagctctctgtgacctcattaataagggcattaatcctacttgggaaagctcaaacctcatgaactaattacatcctaaaggtcccacctccaaattctgtttcactggggattaaatttcaatgtatgaaatttagtaggcacaagtattcagttaatgacatatgttctgggtctttaattttaattaataaacatggtgttaatatttctttctttttttattatactttaagttctagggtacatgtacacaacgtgcaggtttgttacatatgtatacatgtgccatgttggtgtgctgcacccattcactcgtcatttacattaggtatatctcctaatgctatccctcccccctccccctaccccacaagaggccccagtgtgtgatgttcctcttcctgtgtccaagtgatctcattgttcaattcccacctgtgagtgagaacatgcagtgtttggttttttgtccttgcgatagtttgctgagaatgatggtttccagcttcatccatgtccctacaaaggacaagaactcatccttttttgtggctgcatagtattccatggtgtatatgttccacattttcttaatccaatcaatcattgatgggcatttgggttggttccaagtctttgctgttgtgaacagtgccacaataaacatatgtgtgcatgtgtctttatggcagcatgatttataatcctttgggtatatacccagtaatgggatggctggatcaaatggtatttctagttctagatccttgaggaattgccacactgtcttccacagtggttgaactagtttacggtcccaccaacagtgtaaaagtgttccttgttctccacatcctctccagcacctgttgtttcctgacttttttagaagcattgatctgacaggtttgaaaataacttggttatgtagtcttaaagatataatggaatgattatagccaaccttggttagtgatggcccacagaattgaggtgcatattttttgactctggaattgatttttaaaacataggagtatttcaaaaggtttattaagatagtctattacatacagcaaaaccacataaacttggggaatcacgaatatttattaatttagtctctggtgctaagagactaaataatggctctaagagactaaatgatgattctaggcttgtatattcattttctattgctgctgcaacagattgccacaaatttggtggcttaaaacaacaataggagggaggagccaagatggccaaataggaacagctgcactctacagctcccagcctgagcgacacagaagatgagtgatttctgcatttccaactgaggtaccgggttcatcttactggggagtgtcagacagtgggtgcaggacagtgggtgcagtgcaccgagtgtgacctgaagtagggtgaggcatcgcctcacccgggaagcgcaaggggtcagggaattccctttcctagtcacagaaaggggtaacagatggcacctggaaaatcaggtcacttccaccctaatactgtgcttttccaatggtcttagcaaatggcacaccaggagattttatcccgtgcttggctcagagggtcctacaccacagagcctcactcactgttagcacagcagtctgagatcaaactgcaaggcggcagcgaggttgggggatgggtgcccgccattgccgaggcttgagtaggtaaacaaagtggccaggaagctcgaactgggtggagcccagctgcggctcaaggaagcctgcctgcctctgtagactccacctctgggggcagagcatagccaaaaaaaggcagcagaaacctctgcagacttaaatgtccctgtctgacagcttcgaagagagtagtggttctcccagcatgcagctgaagatctgagaacagacagcctgcctcctcaagtgggtccctgacccccgagtagcctaactgggaggcacccaccagtaggggcagactgacacctcacacggctgggtactcctctgagacaaaacttccagaggaacgatcaggcagcaacatttgctgttcaccaatatccgctgttctgcagcctccactgctgatacccaggcaaacagggtctggagtggacctccagcaaactccagcagacctgcagctgagggtcccgactgttagaaggaaaactaacaaatagaaaggacatccacaccaaaaccccatctgtacatcaccatcatgaaagaccacaggtagataaaaccatgaagatggggaaaaaacagagcagaaaagctagaaactctaaaaatcagagtgcctctcctcctccaaaggaacgcagctcctcaccagcaacagaacaaagctggacggagaatgactttgataagttgagagaaggcttcagacgatcaaactactctgagctaaaggaggaagttcgaacccttggcaaagaagttaaaaaccttgaaaaaaaattagacgaatggctaactagaataatcaatgcagagaagtccttaaaggacctgatggagctgaaaaccatggcacgagaactacatgaccaatgcacaagcctcagtagccgatttgatgaactggaagaaagagtatcagtgatggaagatcaaatgaatgaaatgaagtgagaagagaagtttagagaaaaaagaataaaaagaaatgaacaaagcctccaagaaatatgggactatgtgaaaaggccaaatctacatctgattggtgtacctgaaagtgacggggagaatgcaaccaagttggaaaacactctgcaggatattatcaggagaacttccgcaacatagcaaggcaggccaacattcaaattcaggaaacacagagaatgccccagtgatactgctcgagaagagcaactccaagacacataattgtcggattcaccaaagttgaaatgaaggaaaaatgttaagggcagccagagagaaatgtcgggttacccacaaagggaagcccatcagactaacagctgatctcttggcagaaactctataagccagaagagagtgggggccaatattcaaacttcttaaagaaaagaattttcaacccagaatttcatatccagccaaactaagcttcataagtgaaggagaaataaaatcctttacagacaagcaaatgctgagagattttgtcaccaccaggcctgccctaaaagagctccagaaggaagcactaaacatggaaaggaacaaccagtatcagccactgcaaaaacatgccaaattgtaaagaccatcgaggctaggaagaaactgcatcaactaaggagcaaaataaccagctaacattataatgacaggatcaaattcacacataacaatattaaccttaaatgtaaatgggctaaacgctccaattaaaagacacagactggcaaattggataaagagtcaagacccatcagtgtgctgtattcaggaaacccatctcacgtgcagagaaacttgtaggctcaaaataaaaggatggaggaagatctaccaagccaatggaaaacaaaaaaaggcaggggttgcaatcctagtctgtgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacccacaaagagacttagactcccacacaataataatgggagactttaacaccccactgtcaacattaaacagatcaacgagacagaaagttaacaaggatatccaggaattgaactcagctctgcagcaagcggacctaatagacatctacagaactctccaccccaaatcaacagaatatacattctttttagcaccacaccacacctattccaaaattgaccacatagttggaagtaaagcactcctcaacaaatgtaaaagaacagaaattataacaaactgtttctcagaccacagattttgcaatcaaactagaactcaggattaagaaactcactcaaaactgccaactacatggaaactgaacaacctgttcctgaatgactgctgggtacataatgaaatgaagtcagaaataaagatgttctttgaaaccaacgagaacaaagacacaacacaccagaatctctgggacacattcagagcagtgtgtagagggaaatttatagcactaaatgcccacaagagaaagcaggaaagatccaaaattgacaccctaacatcacaattaaaagaactagagaagcaagagcaagcacgttcaaaagctagtagaaggcaataaataactaagatcatagcagaactgaagaaaatagagacacaaaaaacccttcaaaaactcaatcaatccagaagctggttttttgaaaagatcaacaaaactgatggactgctagcaagactaataaagaagaaaagagagaagaatcaaatagatgcaataaaaaatgataaaggggatgtcaccgctgatcccacagaaatacaaactaccatcagagaatactataaacacctctatgcaaataaactagaaaatctagaagaaatggataaattcctcgacacgtacaccctcccaagactaaaccagtaagaagttgaatctctgaatagaccaaaaacaggctctgaaattcaggcaataattaatagcttaccaaccaaataaagtccaggaccagatggattcacagccaaattctaccagaggtacaaggaggagctggtaccattccttctgaaactattccaatcaatagacaaagagggaatcctccctaactcattttatgaggccaacatcatcctgataccaaaccctggcagagacacaacaaaaaaaaaaaagagaattttagaccaatatccttgatgaacatcgaagccaaaatcctcaataaaatactggcaaactgaatccaacagcacatcaaaaagcttatccaccataatcaagtgggcttcatccctgggatgcaaagctggttcaacatacacaaatcaataaatgtaatccagtatataaacagaaccaaagacaaaaaccacacgattatctcaatagatgcagaaaaggcctttgacaaattcaacaacccttcatgctaaaaactctcaataaattaggtattgatgggacgtatctcaaaataataagagctatctatgacaaacccacagccaatatcatactaaatgggcaaaaactggaagtattccctttgaaaactgccacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcatctcagcccaaaatctccttaaggtgataggcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttataagggagtgaaggacctcttcaaggagaactacaaaccactgctcaaggaaataaaagaggatacaaacaaatggaagaacattccatgctcatgggtaggaagaatcaataccgtgaaaatggccatactgcccaaggtaatttatagattcaatgccatccccagcaagctaccaatgactttcttcacagaattggaaaaacctactttaaagttcatatggaaccaaaaaagagcccgcattgccaagtcaatcctaagccaaatgaacaaagctggaggcatcacactacctgacttcaaactgtactacaaggctacagtaacgaaaacagcatggtgctggtaccaaagcagaaatatagaccaatggaacagaacagagccctcagaaataacactgcatatctacaactatctgatctttgacaaacttgacaaaaacaagcaatggggaaaggattccctatttaataaatggtgctgggaaaactggatagtcatatgcagaaagctgtaactggatcccttccttacaccttatacaaaaattaattcaagatggattaaagacttaaatgttagacctaataccataaaaaccctagaagaaaacctaggcaataccattcaggacataggcatgggcaaggacttcatgtttaaaacaccaaaagcaatagcaaccaaagccaaaattgacaaatgggatctaattaaactaaagagcttctgcacagcaaaagaaactgccatcagagtgaacaggcaacctacagaatgggagaaaaattttacaatctactcatctgacaaagggctaatatccagaatctacaaagaactcaaagaaatttacaagaaaaaaacaaacaaccccatcaaaaagtgggtgaaggatacaaacagacacttctcagccgaaagacacatgaacaaatgctcatcatcactggtcatcagagaaatgcaaatcaaaaccacaatgagataccatctcacaccagttagaatggcaatcattaaaaagtcaggaaacaacaggtgctggagatgatgtggagaaataggaacacttttacactgttggtgggactgtaaactagttcaaccattgtggaagtcagtgtggcgattgctcaaggatctagaactagaaataccatttgacccagccatcccattactgggtagatacccaaagggttataaaacatgctgctataaagacacatgcacacgtatgttcactgtggcactattcacaatagcaaagacttggaaccaactcaaatgtccaacaatgatagactggattaagaaaatgtggcacatacacaccatggaatactatgcagccataaaaaggatgagttcatgtcctttgtagggacatggatgaagctggaagccatcattctcagcaaactatcgcgaggacaaaaaaccaaacaccgcatgttctcactcataggtgggaattgaacaatgagaacacatggccacaggaagaggaacataacacaccagggcctgttgtggggtgggcggaggggagagaaatagcattatgagatatacctaatattaaatgacgagttaatgggtgcagcacacctacatggcacatgtatacacatgtaacaaacctgcaggttgtgcacatgtaccctaaaacttaaaagtataataaacaaaacaaaacaaaaaaacaacaaatcttatagctctgtagatcagaagtctgatatggttctcactgagttaaatcaagatgtaggtaggctgcatttttttctgtaatctgcagtgggggagttgtttcattgccttttccaggtactagaggccaccacattccttggcttgtgacccccaggagaaatttaaattctcctcactttgaatcactctgatttaattctagtcacagctcttctgattctcctcttctgccttccttgttcacatttaaggtcctttgtgactacaatgggcccttatggacaatccaaggtaatctccctattttaaggcctgttgattttcaaccgtaattacctccacaaccttaatttccttttgccatgtaatctaatattttcctaggtccagggagtaggacataggaacctttcagggcaatatattcagccttctgaataggctgaatccttgaaggtctcagcgggactgtggctttgaataggcgactccagtatatatctttcaattaatattccagaggaatgtggtggaaggatattgcatctaaatggcaggcatattttgacactttgaccatccgaaaggagttaacatgtcaacatttagaggtttatcatctcctataaatcagtcttttaccaggaagagaaattctcacataatctattccattgttgcactgcttaaaaaacagaaacaaaagacaaagaccatcatcttttctttttctctctttttatatagatgtgtatttcagagattacttattacttttaatttattattcagcttgatgtgctataccttcccttcctccaaactatgaaaatgtataaatatttctgtatctaatatctaaaccttagattgaaatgttaacaattaaaaacccaattataaatcagcacttattcacttttttgtttggctctttttaatttttgtaagctctcactactactatattctctccttgataatttcactctttgttttttaagtattaggatctttgcgagaccatggtagatacttgcaggagacgaaaatatgaccaaagggaaaaggagaagaggttcatttactgtgtgtctcaagagacaaggcatggagattggtcttgagctgtgttggtgaggttcaatttatgaggcagtttacaatctggaacttgatgatgactgtaggaaaaataagactttgtacctacagcttggtataaaggaaacaatactgatctgagtcagctattaagagtttatctgactaccaataagattacctttccgtttgtcatttgtaaactttgagaatttgactaaatttttaggatttaagtttaaaaatctgtagcttcgtgccttacatttgttctttattcaatagttctgtgtatatttaattattatacttgattttataaacagatacttatatgttaatacaaataataaagtttggtttaaaaacattacttttgatatgagaggttgttttaggaaatttgaaaatgtcatgagataacgatgacatttgcacaaaattaattgtagatactgattaatcccatccaggtgagtgaaagccagtatagtagacatataacaggtattgcttttaatttattatattatttttgcatatatttcctcaagtctgagaatactaaaaatatattacttccctttgctcttctttctagagcaaaagtgcctgatttgaattttagtcatattacattttaactgtgtaacttcggctgtttgttaattgctctatgccttcattttttttcatctgtaaaatgggaatattaatattatttattttataaagtgttatgagaactaagtgggttagtaaatgtaaagcacttagaatatagcactgacaaagtgaatgctccgtactgttgagctatgatgattcaggagtcatgcaatctctaaaattggcttaaagacagtgtgacactgtagatgtttgcctcaccacctcccactcttatctaatgcttcctggaaacactggcatatagttttgaacacactggagaggagttgactaggtgcattttttttttctccatagcaacagaaaataaacaatatgtgctgcatgttgagtcagaaggctccacatatttcactgtcaagcctgaatctaatgccagttcatattcacttccaagaagagaccgcctaatcactgcttggaatatgtttccagcctggtgttgacatccctaataccctcatttgagaccctttagatagacctttgtcttactaagttggccttccattagaccccaattatcccattttggcttctcaggacactgtggtgggtcatctaaaaagagaactagagtaaacattagcaatggcaacaactaaaccttttcttaccatccctgtgacaaaaatatccttcctctcagttgtttaattttgcttaactctgctgtcatcaatcatagtaagctaggtttgtaagtctcatcactactgtgagttctaagcatgtgttcaaaaaccatgaattacagatggcatacaaaagaatagtgacactacttccaaccaccctactctctggttaatgcgattttgaaaattactaatattaatatcaacttaggcaacaatatcattttcttaatttttttcttcaaattcagttcaaagaacagatgcattgcttcgtatttctaagtacatttaaggaaataaaacctcaagtataagaaaagctacttcatgtgataagttttataatgtcagaaaagttcttataaagctcattttataatttgcatatatttctttatatagttgttaaaataactagaactttatgctacctagattttttaatgatatatttatcctgcaatggattattatttaaggactggaggccaaatgttttgtaaaattgggaactatttaatacataaataatcacaaatttatgctaggcctataattttatatttcttacattcctatgaaaatatgttttaagttacaagatgcttttcaaattgaatacatgataatttgtgaaactagttttatgtacatttagacaaatacaatatgacatagcacagctaattccccattttgacatattaaaatcataccctaccaccaacacccagcactgatgtcagccctctattaagctttctggatcattctaatcagaagattttcgtcttgttctaatttctagcaattgatgcatatgtaattcatgatgctattaatattatttccatgtgttttttccacctattaaattgtaataaccttgaaaacaagaataattttattcagctccaacaatattctgattgtactagcaggttaataatatttattgattaaatgcctttgtagtgagagtaattgttagcaaatagctaactccaacccttccaaaataaagatatacattcaggtagagaatataaacttggtgaatgtaggtcattcatttggtacagagacatcaaaaacatttataaaaagaatgctttaagtttgcatagagggttaaaagccttagcatacctcctggggaaggggaaaataaaagattaggttcaggatgattcacaaatttgaaaggtgggctgatggagaaattgggatgaattggttcaaaaaggcctatctccaaaatactgctggtttggttccagaacaccagaataaagttaatatcaccataaagagagtcacgcaaatattttggtttatcagtgcatataaatgttatgtttacactatactgtagtctgttaagtgtgcaatagcagtatctctacaaaatatacatactttaattaaaaaatgctttattgctaaagtatgctaacaagatcatctgagccttcaactagtgatactttttgctggtgggaggtcttgctttgatgttgatgactgctgtctgaccagaagggtggttgctgtaagttggggtgactgtggcaatttgttagaataggacaacaaggaagttggccacatcaatttactcttccttcagaaaaatgtatctgtagcttatgatgctatttcatggcattttacacatggtagaacttctaaatgaagtcagtcttcttaaacactgcctctgcttctgcttcattaaataagtttatgtaatagtccaaatcttttgttgccagttcaacaatattcatagcatctttatcaggtgtagattccatctcaagaaaccacttcacttatctataagcaacttctcattcattcaacttttgtcatgagattgcagcaatgtagtcacttcttgaggcgccacttctaattctagttcttttattatttccaacacatctgcagttacttcttccattgaattcttgaatccggcaaggtcatccatggtggttagaatcaacttcttccaaatttcttttaatgtttatattttgacctcctcccatcaatcaacagtgttcttaatgacatctaggatggtgaatcctaggtttacaatttattttgcccagatttatcagaggaatcaccatctatggcagctatacttcataaatatataaaaatatatttcttaaatcataacacttgaaagttgaaaatactctttgaagcatgggctgcagaatggatgctgtgttagcagtcatgaaaacagcattaaattaatctccttgtacatcttcatcagagctcttatgtgagtgacttggtgcattgtcaatgagcagtgatattttgaaagaaatctttttttctgagcagtaggtctcaagagtgggcttaaagtatttggtaaactatgttgtaaacaaatgtgctgacatccaagctttgttattttatttatagagcacaggcagagtagattgagcttatttccttttttttattatactttaagttttagggtacatgtgcgcaacgtgcaggtttgttacatatgcatacatgtgccatgttggtgtgctgcacccattaactcgtcatttagcattaggtacatctcctaatgctatccctccccgcccccaccacaacagtccctggtgtgtgatgttccccttcctgtgtccatgtgtttcattgttcagttcccaattatgagtgagaacatgtggtgtttggttttttgtccttgcgatagtttgctgagaataaggaccttagaattttcaggatagtcaatgaacattggcttcaacttaaagtcaccagctacattagctcctaaaaagagagtcagactgttctttgaagatttaaacaggcattgatttttcatctttagctattaaattcctagatggcattttcctccaatagaaggatgtttggtctacattgaaaatatgttgtttagtgtagccaccttcgttcaccttcatgaattatcttagctatacctgaataacttgctgaagcttctaccttaccagttgctgcatcaccttgcacttttctgttctggacattacttctttccttagatcttaagaaccaaactctgctggctgcaaacttttcttctgtagcttcctcatttctctcagccttcactgaattgaacggagtaactgccttggtctggattaggacttggcttagggaatgctgtgggtgatttgatcttctatccagaccactcaaactttctccacatcaacagcaaggctgtttctctttcttatcactcctgtgttcactgaagtagcctttttaatttccttcaagaacttttcctttgcattcacaacttggctaactgtttggcataagaaacgtagattttggtctgttttggccttcaacatgcctttgtcactaagctcaatcatttctaacttttgatttaacgtgagagatgtgtgactctttcacttgaacacttagaggccattgtggagtcattaattggactaattacaatattgttgtgtctcagggaataaggagtccttaaggaagggagagagatggagaaacagctgagctgactgagggagcagtcagaacacacacttattgatgaagtttgtcatcttacatggcatggttcatggcaccccaaagcagttacattagaaacatcaaagatcactgatcacagatcaccataacagatataataataatgaaaaagtttgaaatattatgaatattaccaaaatgtgacacctgaaagtgtcatgtgagcacatactattgtaaaaatggcaccaatagacttggttgatgcagagttgcaaaaatcttaaatttgtaaaaattactttatctgagaagcacaatatcattaagcccaataaaccaagatattcctgaaaactgttccaaatttaatagctatatagcatcatggtattgtggataggataggaaaaataaaattttatgattcatatacttcccttttaccatattcaatgggcacattacattttatgatcagttgtaagcaagttttattttgtatatgctattgggaatctacttatcttacatttattaatttttacaaattataatttataagggcaaattcagtgtatttttctcataaaataaatatctttttttgttcagaaagcttatataatggtttttaagaaacaaattctaaaaatacatcttataatgtaaatactttttttcagaaacctctcttaatcattttaaaaatactactgcgaatgtaatttcccaaggccaaatgtcagcagtcagtaataataggtatcttaaatcaatcatctcaatattttcaaccctcatagattttttttaagtatatagtgaatgggatggcattaggggagcaattttcaagtctatttctggaagacattattcatggtaatagcacataagaccattttgtcctcttctgttggttttggttcactgaccaaaggacaacatttataaagtaaatgtacaaaaaagtaagaaaaggatagtgttacagtgtttttttaacaattttcggggtggggggaggttattggaaaaccctcctcaggaaaataaataaatgaagtgaattcacagctgtatttgcactagacactattagcaatgggattttggtagcagaaaatgcagtttccctaatgagacaataccttagtcagcctgggtattgaattagaagaggactttcataatgatgttcagatttttgaactgcagtggtgcctatgttcttactaagttgtttggggaagaagagcagaaaagagtaatagatttcgaagaaaatgatgagtttaattttaaatgtgtttaagctgaggtcctttgaagaaatttgaatagagacatttatatgcatagataatattctattatgtacatagaaatttcttaaaacaagtaagtttctatcatcaaccttccaagcatgaatttctgtatgccaaaaacattttgcgcagctaagcaaaacaaatgctaatgcaggtgtttgctcaaatgttatgtttcaatagatcctttcctgacgaccttaaaaaaaatgaaatgttcctccctacccacacacttcctattctacattttatgcatcttttctccatatcacaaatcacaatgacatttaatatattgaacttattttttatctctttttccctattcacaacactacaaagtccctccattaagggaagggcttgtgttcagtgctgtatcctcaatagctaaattggtgccagtacgtgctcacaattttgttaaacaaattaatgaatacagagtcaatcattagttcctgaaattctgtatcaccaatcttttatgtatggtaagaccattttaccattaaaagagaagaaacatatttccccaatttagaaaagtaatatgattatatcactctcaatcttggctatagaccaggctaaaatgcaacagttgtatgtccacatatacaaaaacacagccacacttctttttatctttttaaaaaatcatttatagatattttccaagtgtgtgaatccttaatattattagccctgagcagattgcactatatccaggttaattctctttaaagtactttgagcattcctgaaagaatgaagttttatggttaagtaatggactaagcataaagataccaaataaggagaacatgaaaggacaatgagaagtgcttctcatgagtctgatgcaatttctgtaatttactttattagatatttcattcctcagggttaaggtctgatttaaaatcctttagaatgaaaatgcttcttgaagggtatatattttttatttatcctttggcattaataagttatcaaagcaatttccacagtggaggctgaaaggaggataacaatagatataatgtgtacaaatgaatggagagaagagtggaagataaatcactgcttagaaaccatcaggctctctattatgattggatctaacaccacaatgtctaaagagaaaggacatgggatgctttcaaatgcatttataaacaaaatatcaatggtcataactcatagtgacttttaaaatattttttattattatttttgagatggaatttcactcgtgttgcccaggctggagtgcaatggcatgatctcagctcactgcaacctctgcctcccaggttcaggcaattctcctgcctcagcctcccaaataggtgggattacaggcatgtgccaccatgcctggctaattttttgtatttagtagagacggggtttcaccatgttagtcaggctcgtctcaaactactgacttcaggtgatccatctgccctggcctcccaaagtgctgggattacaggcatgagacaccgcgtctgtcctcatattggctttaaaataaagacatttgtaaaaatctgtagtaaatatcctgagtagaacaggcatggagctaattaatatcataactcaaaattcccatgaagcatccaggttctttgatgacatctttcatccccaccattcttagcttgtctattttggcgtttcatctatcttgccccaagtcacaatatggtatagcaactccagtttgcgtgtccagataataaaatatccaaaagaaaagagaaaaacagcgtgttctctgattctctttttaagagtcagaaaacatctccaagaaaaaaccatgaaacttaaccctacatacccaattttacaccaataattgtcagggggaatgggattactgggtttgtttactaatctggatttacgtgaatcacatgggtactagtggacacaccaatgaagtcatcatctgtatgtcattaggaaggaaagaggaagggaccataatgggacaatctattatgcctgctagaggaaccaaaaagagttttagaaactaagcatatttaattaaaccaatgtagacatggaagaagtcaaaaatgggaaacagcatgaattgtcccttgtacaattttttcaacagtacaatcatatcaggtattaaattatcaagtgagcaatattgtccataatcctcataagtatttattttaatagtatgaaatatgagcatgatagaatagaaaaatatacttgtcacaggagcaaattgtcacaaaagaattttaaattccgcagcaggtttttacatgtgaaatttctttgtatatttgtgtcagaaacatctaattctagaatgagggtaataataaggaattagtactctatttatctacttatccatattactgaaagttttaatctttttaaaagtaaggcactaacaatgttaggtgtgttttgtttacttttttagattttgtttttagactagatcaactatccagtttaaaaattaggttggatacaatgtaggtataaaagtcaaatgatctgagtaatgttttagatattgagtattaaagatatttagctcccgattctgcgtcctctgtgtaaaccaggaaagcaacaaaatagcttgtcttatcagtgtcttaattattgctttgctgaagtttctctcccagctggtaaggtagtatggtggtgaaaagattattgccaaaagactgttaataatcaattggcctgcctaataaacatggagatgataaggtgaaaaaagaaatgtgtcagtagattccatgttccagatgatatctactctagaaaaatgtgtaataaaagaaacataagcagagtcatcagaagaatctacatgagaatttaaagatgcaataaaaataccttagaagtaggggaaatagaaaaagaaagcgagagaggaacaaaggaagagaagaaggaagaaagagaatatcagattaaattaaatatcgataaaagatgttcacggtgacataattaaaaagaaaatatagctttggtaattaaaaatagcaataggaattcttcagtgtacactaacatttcatgacattaattttagataatctggcaaatacctacaaattttttacttcagtcatttggtagcttttagtcaaatctgtctggaagatttgtgcttaagctaggttatcccatcaagttaaatatctaagtcatttcctgtatgttaaaatatactagcatgagaagttatgttatattcttggcaccaaatcataggatgatgatgatgaggataaggatgatgatgatgatgatgataataatgatgcccacataatctacttgtaaaaatatagattaattaaaattgtacttactaattttaaactttaaactatattaagactttagatataaagttatatcctgaatgttaaaaaaatggatgtttgaattttgtaaaaacagataaagactgggaatattaaataaatcttgtattagttgagaactatatagtgagcagtttttatttcttttgtaatattaataaccaaaacagtaattgagattaaattaaattaattaattaaatagaactctaaacatggtgaaatgttacaccctaaagttccaaagagtaaactcacagaagtcttgaggtttcaaatatcaaacaaactttcagccatatgtaactgtcttatttctgaatttctcaaaagaatttttaaaatataaatctttctacatgggtaaaacctttaatattacatttagaggaggaaaagtaataatttttccttatctacaacaaggttcatggacaattcctttatcacaagaaaagattaataagagaaaaacaaagcatataaagtttcatatgacattgaaacctacagaaatgaagaaccagagacccagggaaaatagtatattttaatggacaatcatgtagaagtatgattggaggacaaaaggatatgatctaaaggtcattagctggaggtaacttagcaaggtctgtctgttcagattatttcctgtgtctgtatgtgacatttcttccctctgggtgtagggcaggacaccagtcataaaaggatctccaggggagtgggaaggagactgtcagagagtaacctgtctaggctttatgacctgcttcagagagaaaggggtaaggggaatttcggtttctgagccttagttcaggagagaaagggtggaaaaagatcagagacctttcaacttctgtgattttatcagtttccttcagtttaaaatacttagtttgccaagataccatattttgatgtattgttttccgagcccttacgtacataattttaaaataaagctacttaaaaaaagaacctagtggtttgaataagtaaacaattcttccattgtcatgacacttctaagattttaaagcacactttaaaatataacgagtgttaatttttttttgcttaccaatttaatggataacagaataaaaaatgattgatttttaaaactaataataataacagtcattaacatttaatgaaattctactctgtgctgggaaatcttctactttacacatattaaataatttaattttcacaataactgagttaaacactgttagtatgcccattaaatgatgaagaaactaaggcacagagcgttattctgggaccagttctatttcattccaatttattatgctttttttttcaaattttgcactttacattcctaaaaattgatgtgatcagaaaatttaaccaaggtcttgtagcttttctgaatcatctaaagaagattaattgtattaatgagacagtcttccttattaaggtagagagtctacaaattattaaatatttttaaggataaaactttgagctaagggtaatttgtggattttttaatctgatgatcgtaacatttgctcaagaaagagaaaatactcttaatattattttttaaatatatgattacaaatgttactgatgactaaaatagtgaaaatagccaatacaaaaacaaaacaaaaatcctggctgcacgtgagtagagtggaaagacctgttatatgtgaagctaatacctgttttatgtctttactaacactataattttgagcaagttcttagtgaaaactttaattaccatagatagcagtgtgtgtatatgtgtgtgtgtgtgtgtgtgtgtgtgtgtgtgtgtacttcacatatgaaagtaagatagaggtgttatgcattttacaagcaaaaggcacatcctttaagaatcatgttaaggaggctgaatccaaaatccaggtgtgttttaaaaactttccagggacagttaaaatggccattcaagtgaagggtcagagttagaacttaattttaccctcatttagttggcaagcactgtgttagatgaggactatttttggtcaatattttccaaagggcactttttgaaattcaatctaaaagctatgtttttcatgccaccatgtttttgaactgtatataactctgtgtgtgtgtgtgtgtgtgtgtgtgtgtgtgtgtgtgtgtgtgtgtagcctaaaatgccctctccttttcaccatctgggtttagttaacctgtgttaatctttaagatttagttctgcatgtcaacatttagctctgtaagcagctcagtgctattcactttcagctctgtactcctgcagctccttccttttttatggatattcctcactgcattttcaccctgtaagaaagttgcttgtttcctaccagtcaccccattcctttacatggaaaagggacattctttgtttattgttgtgttagcagagccaagaacaatttctggcacacggtaggtgtcaaataatttttgaagaagaaaaggaggtagaaagacaaaaaaaaaaatgaaagaaaaatctgtgatgctggcagatgaataaatttccattcaattgatatatcttaattccattcttagttcatcttaattgtcttacttcttttgtatattatccataattttaaaaccaattaagtgaaattcccctatgtattgacaacaatattaagttataaaacatttcatgaacttgaagtggacaaacttgcagcaactcaattcctctggaaggaatgcctgtgtattttcttaacctataacctgtatcagagagaaagtaatagtgaggggaacagactgacacttttacttcatgtgtatggctcacctaatactgacttgtccttgttcaaagttttctgcttttataaagctcctattcgttgcacaagaaaccatatgagagttcttgcttgggcattttcctcatagggaggaacccgtcccagagtgcagaagggctaatcttccagaaaaccattgtgcaggatcatttcacttacgtatgaggacctgtagtcaagggagtcttttatttagtctgtctccattttcctctcattttattgttatttttctttcctcttttattttctctttgaaaaaaattactatcaatttccatttgtgatcattgctttgtgtgtttcccagcatataaactctcttgataatctggattttgatgtataaagctgcagctgccctttgatatgaggcattaaatgatgcaaaatttaatattctaacttaaaatttatggaaatataattgtgacctaaatgaaaaatactataatctcaaatactgaaatagtaaactatctagtaataaaaatattgtgtaatgaaaaatgagtatttgatacttttagattacaaatgtgggagagtaatgacaagaaagtgatattattttaaataaaatacctttcctaaattaagttaattagacctacctcaacctaaaaaagagacaaccagttatagagtttaaaaatggaaatcaaatatgcatataattaaggtggtattatactgggcagtgctaatagaatctcagattaggagagatgagaaaaattcagtaattacattgttagaatgataaaataaattctgtcatctgttggagagagaatgatattgacctgtgatagaactactcaatttaagagaaccatgactaattagcagtattcagattttgttgtttatacacaaatcattataccaccatctcaagttactctgagaacacatttcaattttattttgttgccaaaatgaggatactcttcaaagtaattttctctcaaaactgtgtcatattcaattaagttaatctctaaaccatgagaatgatattaacaaatagaatacttaattattattattattgttgttgttgttgttttgagacagggtctcattctgttgcccttgctgggtgcagtggtgtgatcatgggtcactgcagcttcaacctccagggaacaaaccatcctcccacctcagcctcccgtgtgacaccacacccagctatttttttgatttttttgtagaggtgaggtctctctatgttgcccaggctggtctcaaactcctgggcttaagcaattgtccttcctcagcctcccaaaatgctgggattacaggtgcaagccaccgtgccaggcatgactgcttaattatttttaccactcttttataatatcacaataaagttgactcctgtgcttacaagttataactacccaagggcacagccttttccattaaaatattgtttaatggtggaacaggcatgattatacatgcaaatatattctatagggaaaactattagtgtgtgttggaggattttaaggccacacaaggctacagggtgagttgagcctgctatgcactaggaataatggcagcttaatgatgacacttcctccattcattgctcccactggtttctgcagatagaaaaatctatagttaatttaatatcattcccttaaaagaacatttgggaatagggtgtagatttagtgagatcaaaggaaaaatatctaccctgtttatcattactcatgagtttattggtcatttccattggaccagcccttaaatctgacagttcaattttaatttaccttttcattgctttttctctgatatcttcttcccatgatgaatttcagtttaatttaatttgacaaaaacacaaagattcttctgacaagataattattttgggctattttataaaggtattttgagtttacagggcagaggaaaaaaggaagttgttaacaaacacaaatgtgtagctccagtgtgcccaacgaatccctttatgctttttttctgctgtcatttcttttcttcccttctgagacagattaataacagacgtaattcaggctgccagctactccttctttatttgcgattattcctttttatcatctcatgttccttactactgacaattatggaaagcttatgttaatatcagattgtctgtaaaatataattctttatagaaatgaagataataggagtatttgctcttataaaatgagactggcataaaggattacatagttagagcaaaattgttgctttaatagtctacccttaaaacagccatggaaacatacattgacttttctgtgtgggcatgacacttttaggaggataggagttgtaggtaaaagcttcctactttgggaggccgaggcgggcagatcacgaggtcaggagatcgagaccatcctggttaacacagtgaaaccccgtttctactaaattagtcaggcgtggtagtcccagctactcgggaggctgaggcaggagaatggcgtgaacacaggaggtggagcttgcagtgagccgagatggcgccactgcactccaacctgggtgacagagcaagactccgtctcaaaaaaaaaaaaaagcttcctaaaggttcacccacatttaatttccttgttcacattatttttacttagtgggagacaaagtttttgaggtatcaggatgggattaatcatttaaatttcctttgtggagcagaatgaagtgagattaactcagtgttttaagttttcattacttaacaaattacattttgtcaagaagaattttacgacatttatgattgggtctgaggatgtagatggtaataattaggctactagttttgctcaggtgtcatatgtcacctcagttgtaagttcacagctacaatgttgctctaacctatgggcatagttggaagaactagtatcaaatcaaaatgaaactgacatagatagaaattggagaagaaagctcttcaaaaataggaagtggacttatatatttttgggactcagatttttcagctgtaaatgatcaaaatgcagggttattgggtgaattagacaaaatgtttgtaaggcaccttataaaaagtgttgtatatgatgactattcattaaataattgctgtaaattcactaaaaagaggttgaataaatttaacattttcaacattttatcaatgatgtgaagtgttgttagaattgtttcagaaataatttatattatcttaatttcctgatatgagaatacttaacactgtttcctctcagtgtaggaattctattgtaagtcttatacttgtaaatcttatatcactttcaacatattgttcaattcataaatgaaatgttatagggattccactatatatattttttattttattttatttatttatttttttgagatggagtctcacttttgtcctccaggctggagtgcagtggcatgatcttggctcactgcaacccccgcttccaagttcaagtgattctcctgcctcaccctcccgagtagctgggattacaggcacccgccaccacacctggctgatttttttgtaattttagtggagacgggttttcaccatgttggccaggctggtcttgaactcctgacctcaggtgatccacccacctcggcctcccaaagtgctgggattacaggcgtgagccaccgcacccggccttcactatatattttaaattcactacatatattcactataaaaaagaaagataaatccaggtatgataaatgttaaatttaccttaggtttattaagggactgtttcagaaaaaaacttcaaaatgtttacaatttgtttatatgaatttgtttctacaaacaaaactatgtttcagtacagaattctccaattcaggtttatgctaaatatgtcctttcttcaagttctagttttaaatggtccatcacatatcctatgtattttgcttaattcaaattaatgttgccttttattattcgtccattctgagaacaaagtgtcagtcttggtgttaggaaaccattcaatttacatgaagtatcatctattcaagagggttttgcgtacatttgttaagcaattttttttctgagtgacgtgtagaaagaaaaagtggcaattctggttttagtctttttatcacttccactttgacaattctcacattcttaatattctaaatcacaggattcatctcaaggaattacctttgtgcctgttatttttacccagatattcattaatagcttcatattggtgtttgtatatgtgtctttctgtgtgtgcctatttgtgtataaaatttacctaagggttttttgtttgtttgtttgttttgtagacatggggtctcactgtgttggccaagctggtctcaaattgctgggctcaagtgatcctcctgtttcagctttccaaagtgttaggattacaggaatgagccactgcacccagctagaatttacctaaattttaaatcaagagatttttctagggttttttctctgatatcattctgctgttggatatcaagagaaagatgttaggaaaacacactttggtaaattgggaaggtatgacaggtatacacataaagcattatgaaaccacaaaatgtgtagacagacataccattctgttgttaaccttccagagttagtgtcaaactccacaggtttaaggacagggccaccaagaaaactgttatcacttcaaatgccagccacaaatttgggagtcaccaggccacctgtacttctgttcaactgactaaaaatgtggtagtttcccatgaccgccctccagttggatacttcactgaatgattcacagagctgaagagagcactatacttatgattacagttttattataaagaataaaaaccaggaccagccaaatgcaaagtcttaaacacaaagcttccaagccctcccctcatggaattagagtgcatcaccctcacagcacattgatgtgttcaccatccagggaagtttccatgtccagagttaggattttgttaagtaagtatgattaatcaccggacatgtgattgaactcaatctgtaaccctgtcctatccctggaagtcaggctaactcaaagccccaattttctaatcacattattgatcatttcagtgaccagcccccatcctgagatatctccttagcataaactcaagcgtaattcaaggggctcataaataacaaagagactcgtcttacctgggttttttttttttcttttttctcaggagccagggacaaaggccagtcaaattcttttctatgcaatgttaaatataaaattaggtattttatcttagtaatacacattttctctttttgctacccactaaaagtctgatttacaaaatattttagcctttgaagaatgactttagaagtcaacttaagtgtgccataatggtattgaacttttttggtattagaagtactctaaattgattgcatttgtttaagatgaattggaaattttaatcaaattattcaataaataatatgccaaaaaattacactcaggaggattcaatgaatagaaattattttttaaaaaagtgtgcaaagaggaaaacataaagatttcctataaaattaagtatcaactaaacatattaaattaccatagcttaaaagctttggactatcttgatttgaatgaataactttcctatatttaagtaaagttttttaaaaatataaatctgattgggatgaaattaagaaggcatgacatttcagcatgttttctctttaaaaaaaatttgttaaagaaaggcactctaagtagaaacaaagacagaatctgcaaaaatgtttgaattgcacatcctgaatatgaaaagtttagaatttgatattagtttagcagataccttagcatttgtaaagaggttttatttcctcagttaaaaaacttccacgctatagagaaaagccaatggaaggtttaagcagtgtcgtatttacgaaccagaaaatgaatctttaaagaaaatatgaaaaatactaaaagcaatatgactgtgttaagtcttcagattattactagataaacagcattagactcatagagcagttgatttaagtgtgtgaatatatacaaataatttttgttatacttagttttttatgaatataaacacattgtttttatttgttaaatataattgtgtttttgaaaataatgtggacaggataatttttaattttgttaatacaatgaaaccaactttttggtcaatgtatcactatttcaaaaattatatatttttaaaatatttagggtctcctttaaattttcaaaattgtcccatttttaacaaagatttaatggttaatctacttatgaaatgcctatttataattatctacataatgatgagctatgaaatatgaccgtttagaaattgtaggcttgtggtaatttttataaatgatgttaaaatggaagttatctttttgcttaatcactttcctctggttctatatagatataaatttttaaaaatacataaaatttcagtatatgactaaggaattaacatattatcaaataacaagaatgcatacaaacattatatacgtataccctggagatattgcaggtttggttccagaccactgcaataaagcaaatatagcaataaagcaagtgacccaatagttttggttttctataaaaccaatttgtatcagtttggtatataaaaaagttacgtgtacactatactataaactatgtgctaatattgtctaaaaacaatgtaattaccctaattaaaaaattctttattggtaaaagtgctaagcatcatttaaacttttagcaagtcctgatctttttgctggtctaagttccgcctcaatattgatggcaactggcttatcagggcagtgtttaccgaaggttggaatggctgtggcaatttcttaaaataagacaacaatgaggtttcccacattgattgactttttttcataaaatatttctctgaagcacataatgttatttgatacattttacccacactggaatttctctcaaaattgaagtcagtattctcaaacactgccagtgctgctgcttttgcaactaagtttatgaaatattcaaaatcttcatgttctcatttcaacaatgttcacagcatcttcactatgagtagattccatcttaagaaatgactctctgctctcaagttgcatcatgatattgcagcaattcagttacatcttcaggctccatttctaattctagttctcttgctatttctaccacatgtgtagttacttcctccactaaagtcttgaacccctcacagtcatccatgaaagttggaatacttcttccagacttgtgtaatgttgatattttgacatcccatgaatcacagatgttcttaatgacatcttggatggtgaattctttccagaaggtttaaaatttattttgcccagatccagcagaggaatcactatctatggcagctatagacttaggaaatatatttcttaaataatgagacttgaaagttgaaaatactctttgaagcatgggctgcagaatggatgccttgatatcagtcatgaaaacagcattaatttccttgtacatatccatcagagctcttgggcgactagatgtattgtcagtgagcagtgagccgtgttagggaatcttttttttctgaacagtcggtctcaacggtgggcttaaaatatgcagcaaaccataggcttgctgtaggctgggtgtaggctgggtgtggtggctcatacctgtaatcccaggagttttggagaccaaggtgggaggaccatttgaggccaggagtttgagaccagcctgagcaatctagcaagatcccatccctaaaaaaaaaaaaaaaaaaaaaaaaatagctggatgtggtggtatgtacctataatcctaactacttgggaggccaagatgggatgactgcagtgatcttataagctatgataatgccaccacactctagcctgggtgacagagcaagatcctgtatctaaataaataaataaatactatagacacagatgtgctgtcatccaggcctatttttaaattccacttgtagagcacaggcagagtagattgagcataatttttaagggccctttgattttaggaatgagcaatgagcatttgcttaaatttaggttcaccagttgcataagctcctaaaaagagagtaagcctgtcctttgaagatttaaagccagacattgatttctctctacctatcaaagttcaaaatggcatatttttccaatatttcaatttaagcctctttcatttacattgaaaatctattttttagtgtagccaccttcatcaattatcttagctagatcttttggataacttgctgcagtttctacatcaacatctgctgctttatcttacacttttatgttatggaaacagcctctttccttaaacctcacaaaccaacctctgctaacgtcagacttttcttctgcagcatcctcacctctgtcaggcttcacagaattaaagagagttagcacctcactctgggttaggatttggctcagggaacatcatggttagtttgattctatccagaacactcaaactttctccatatcagaaatatgactgtttctctctctctctctctcttttttttttttaaattaattctgtgttcactggaatagagtttttgatatccttcaaggatttttcctttgcattcacaacttggctcagtgtttggcataagaggcccagcttttggtctgtttttgctttcaatatgccttcctcactaagctcaatcatttctagcttttgattcacatgagagatatgtgactctgcctttcacttggacacctagagtccattgtggagtaattaattgacctaatttcaatattgttgtgtctcagggaacggggaggtccaatcagagggagagaaatgaaacaatggccagttggtgcagcagtcagagcacacacaacatttaactattaagtttgctgtcttatatgagtgcagttcatggcacctcaaagaaattacattagtaacatcaaagatcactgatcacagatcactataacagatatagtaacaaagaaaaagtttgaaatattgcaagaattaccaaaaagtgacacaaagccatgaaggagcacatgctgttttaaaagtgggaccagtagacttggttgatgcagggttgcaaaagcctcaatttatttaaaaacaaaaacagtatctgccaagtgcaataaagccatgcaccataaaatgagggtatttctgtattctttacttaggagcaatgataaagcatttcaagcaatttggaagaaatatgtgatgaaataaaactttttattctgaattgtctgcccagtaatgtagaacaagaagtcagcagcactacaaaagcagttgacaactgaaaatgtaaaagctgcagttgtttcccactaaaaatgtacatggctcagtgacgagaaccgttgagaattttaggtttccagatcaatgtgtattgcattgaagaaaacagaataagaaagaaaaagcaaaataagaacaaagacaattaaaaaaaaagttttcaaattccaaatgtgaacagcagagagctttgggaggaattgggaagatttgatatttctgcattaattgtggttgaaacaaaaatgacactgaattttcctgtgatatttgaaggttgtaagtctttcaaaagagaagtgagacagattattatcaggggatattgaagtgacaagagaacggaaatcgaaattttatgaaagtccaaagtcatgtgtaggtagaaggaaagcttgagagattagtcaagctttaaacgtgtgatatttcaggtgtcaataggatctccaaaagatgaactccatctttctgttggcaattcagggagggaactgcactaggagaatagtgttcgctattcacacagaattatatgagaaacaataagaataagaattgatgggagaagaaacatagaggggaaagaatataagggaaagaatcagtttgggggaacagtgcattagagagtttgagaatgaacctttgaaagcagtaagaggcaattaaggcaaatgtgcttcttggggtgaggagactaaaacattcatctttgcatcttctgagcttgaaacattattaaataggaatggagaaaatggaagaaggaatctaggaatgtaaggatgaatgttatagtagtacaatgtcattcaagagattttgggctataaagagaagctcaagggtataaaggagtttatgtatagtcatggtgaaatatgactaataacatgaaggaattagaaaaggacttcaagttataggcagagaacaatggccttatcaaggtaattttagtaggagaaaagatgggatgttatcataggttctcactttttatgccgacatctagagttccttggtaatgtattaataaacaggtgaaggatagattctcccattttgcgggttgtcttttttactttgttgattgtttcctttgctgttcaaaagctgtttaacttgatgtgatctcatttgtccatttatgctctggttgcttgtgcttatggggtattactcaaaaaatcttttcccagtccaatgtcctggggagtttccttaatgttttcttttagtggttttatagtttgaggtcttagatttaagggtttaatccattttgatttgacttttgtatatggtgagaaatagggatctagtttcattctttggcatatggatatccaattttcccagcaccatttattgaagagactgtcttttccttagtgtatcgtcttggcacttttgttgaaaatgagttcactgtaggcatgtggatttattttggggttctttattctgttgtatttttctatgtctctgcttttatgctagtaccatgctttttttgcttaccatagctttgtagtataatttgaagtcaggtaatatgactcctccagttttgttctttttgctcaggatggttttggctagtgtctctgtgtgtatgtttattctgttgtatttttctatgtctctgcttttatgctagtaccatgctgtttttgcttaccatagctttgtagtataatttgaagtcaggtaatatgactcctccagttttgttctttttgctcaggatagttttggctagtgtctctgtgtatgtgtgtgccttcatataaattttagaatttttttctagctctttgaagaatgtcattggtattttggtaaagattgcattgattctgtagattgctttgggtagtgtggacattttaataatattgatgctttcaatccatgaccatagaatatatttttattttttggtgtcctcttcaatttctttcattagtgttttatagtttatattatagagattttttcacttctttggttaaatttgttcctaagtattgtattttatttgtagcaagtgtaaatgggattactttttttatttctttttcatattgttcactgttggcatatagaaatgctactgatttttgtatgttgattttgtattctgcatctatactgaaattatcagttctgctagttttttggtggagtctttaggtttctccaaatataaaatcatataatctacaaataagaataatttgacttcttcctttccaatctggatgccccttatttatttcttgtctgattgctctagcaataatttcctagaatattttgctttgggtgtgttgccctagggggattttggagcagccatatcaaaacagcagtaaaatgtgtttcattaaaaggaaatctcttatttacattttatgcctgagctccatagtttctgagcctccatgaatctcagagaaagcttaattgtcaaagaaggggtgagatgctcctgtatgtatttcaccccttcttctttaatacagaagaaagttagaaagtttttcagatcagataaccacattttaaggtcaaattgcccttagcaaaatttcacatacactgattattcatgggcaattaaataactccttgcccgatatgactggttttgttgattttctcctgcttgccttaagtattatcctgaatccccacaggttggattaggctgtagggggcctagctaagtaatgtggaatagcttttgttagttgtttcaaccaggttttcagatctatcagacattgtttctgtagtgaagagagcaattataataaccctaggttgaggccttttctctcagatcaagcctgaacctaaatggatttaggttccatttaggagggattacatttattttttcattaagtgtaaatactgtgggcaagatggtaatacatttatttaataatagcttgatagattacattttatcagggtcatgaaaaacagaatatttggattataagggaacttagtagccttctaattcaaccttcctcctaacctgagaatgtctgtgacttctaattacccattatgagtacttaatgcatgggtagtcacaattttatgaagatacctaatcattatttcaatgggcctatctgtcagtgataataaacaataactgcttattgactcattcaaaatttagaacttcattttggcctatctggactctgcaatgaactatcagtgaaggagaaaaggttaaaatctgaaatgagccagtgctgtagtgaggaaaggccaggaattccatagctaacttggatgttgggatttagtaataatttaatgtgtaagaaacacagatctgtaacagatggtgggagaatatgactaatagaatctttcacttttgccatacttagagtaaggggcatatgtgacttccaggtacagttggccctcccattcatgggtcctgtatttctggatttcaacaactgagaatgaaaaatatttgaaaaaatcaataaaaaacagcatgaaaggattaaaaaacaagtaaaaatgtagtataacaactctttacatagcatttaggtggtattaggtattataagtcacctggagatgatttaaggtatatgggcagatgcacataggttatatgcaaatactatgtcatattttatgaggaactgtgcataggttatatgcaaatactatgccattttatgtcagtgatgagcatctgtggattttggtgtctatgggagatgttggaaccaataccctatgggtgggggatggataccaagggacaactttatattattttgtaagggaaggaagactttatcatctgagtgataaatttgagtctataaggtaaactgacagcaggcagagtaacaagaaaaacagtatacgcatttatagtgtgtccaggggcatcatatgaccaaaaaatgattactcacagcctcagtgagatctagaagcttacatatacccttttcttaggggaaaagcaagagaggatgtagccaatctaggggacggtaaatgatttttgagaaagatgaatggggcctcagaagaatatgtgacagcctgtgacaacatctgtctggatggacgtccaccccagtcaccgttcctgtgataggagttaatctttcctgattgatgagatttctgggcaggtgatttaggacaattacatttctttccttcagaggaggcagaggatgtgacttctttaggtaaataagcagagttcagggaaagccccttcatgcttgtgcttttcccaggtgctctgagtttgaagtaatcagcatatcaaaatggcatattttgaggtgcaattttctgaacttcactttgattgtgattaatgttattcttattttatctgatctcctatttgtgtctccatctactgttaaaagatttcgtattcccagtgtcttccttttatcatatacattatgccatgtagagtccatttatccttatattgaaccaaaatttgcttgtcttcaacacaactcttagttacgaattttaatgataagcttacaaaaatttgtaatgaccctcctgagatttcacttctgtaagctaaatgctatttttgagtggatgagtaaaatatataccatgtttctagacttttccaattatgcttactgaagctgttaactctttaaaagcaaaaagctctttcagatgttacatttccagtccaaaatcaaatgcaatgatgatagctttaccatagaagtctgtcctgtttaatgaaggagcagacttcaggactttctcttgatgatacttatagatggaaatactaaataaataatactaaaataatatgtggacatgataagttttttgttccacagttgcattatattgctgcactgcaaaggaaaactttaaagtctacttgaaataaaatactgttaaatttgttgactaccatattatgcgagttcatggctgcctgttttttaaggtatactatgtaaacaatcatttcattataaattcacagtttgagaaatgggaagtacattaaagagggaatgtactgctgctgaagttaatggagaagtcagatttaatgaagcctttgcagtttctggagatatgtgacagatttcgccaaagatgttatttatagaccagcttttcccttagctcaagctcagatgcaaaatttgaggatgaatctgcttgtgttaaccactatctccttcatgaatttctctcaaagaatataagataatcctgaggtgtaattaaaattgtggcaaaaatttctaagagtggacaattaatggtcactgtgtatatattttcaatttatcctgtggcttggatatattcttttataaaaccaatggcattgtgcatcttaatctattaccattttggctaattacaaataataggttaaattagttttaaaaatagccagacagtttttataccttatacgtaattgaacagtagttaattgatggaaaattttcttcattatattcaagattgtttttgttataaatcctttatagagttgttcggagtaatcctccacaatcacaaaattgtacagataaaacaccagaaagataattgttggaaacaggtattactgctaagtagaatataatatgaaagtttcctttagcaatgaaatttcgtattatgatattgattataatctgaataaacaatgccctttgtgaggcagtattttaccttcttttttgaaaataaagaaaacttttatccatctttaatcttctatcattttctaattctccatgattgctcaaatatatcatgtccttgttgacattgagagttttattagtatcttgggatatcattcatttttgtctagaaacttaaactcttggatatatttctacatgtaactaaaaaaaaaaaggttgggagattttattgaagtctgcttttgttttcatttgttcatgtgcttgatatgacattagatgtgcaatagataagagcataatatatttttcacttttttcgtcattagtttgctgtctattagtgcttactgaccaattcttcattgtaatacctagccaggaaattgggcagaaaattctcacaatcagacatgcgtatcactgaatatgaagtgacttcccaaaatttaggccagcgaagtagatagatataatggattattataaaatgctaatatgcatcagagttttccttaagaatagggataatgagttgtcattttgtgaattattaagatctgtatgcttaagattatgtaatttggctttctgtgcatggctttcaaaaatagtatgatcggttttctctatttctaacaaatgcaaaatccatagaaatggaaattagctgcagctgtgattttatgaatggtttcctagaaactacattaaagaaaactttaatatacaaatgagttttatacttctcttctaagcaagtgcagatgggagatttgtgaatttttattgttgctaccacaatggattaaatatgctttttgaagatgatggtcacattttcaagtttaagctaacatttaggtaagtccaaatatatgtgtttcacaatgaaaactttagaaatcatctattaaaatgaaaaactcatccattacctttttttaaaaattatactttaagttttagggtacatgtgcactgtgtgcaggtttgttacatatgtatacatgtgccatgttggtatgctgcacccattaactcgtcatttacattaggtatatctcctaatgctatccctcccccgtgccccaaccccacaataggcaccggtgtgtgatgttccccttcctgtgtccacgtgttctcattgttcaattcccacctatgaatgagaacatgtggtgtttggtttcttgtccttgcgatagtttgctgagaatgatggtttccaggtcatccatgtccctacaaaggacatgaactcatcattttttatggctgcatagtattccatggtgtatatgtgccacattttcttaatccagtctatcattgttggacatttgggttagttccaagtctttgctattgtgaatagtgccgcaataaacatacgtgtgcatgtgtctttatagtagcatgatttataatcctttgggtatataccagtaatgggatggctgggtcaaatggtatttctagttctagatccctgaggaatcgccacactgacttccacaatggttgaactagtttacagtcccaccaacagtgtaaaagtgttcctatttctccacatactctccagcacctgttgtttcctgactttttaatgatcgccattctaactggtgtgagatggtatctcactgtggtttcgatttgcatttctctgatggccagtgatgatgagcattttttcatgtgtctgttggctgcataaatgtcttcttttgagaagtgtctgttcgtatccttcgcccactttttgatggggttgtttgcttttttcttgtaaatttgtttgagttctttgtagattctggatattagccctttgtcagatgagtagattgcaaaaattttctcccattctgtaggttgcctgttcactctgatggtagtttcttttgctgtgcagaagctcttgagtttaattagatcccatttgtcaattttggcttttgttgccattacttttggtgttttagacatgaagtacttgcccatgcctatgtcctgaatggtattgcacaggttttcttctagggtttttatggttttaggtctaacatttgagtctttaatccatcttggattaatttttgtataaggtgtatggaagggatccagtttcagctttctacatatggctagccagttttcccagcaccatttattaaatagggaatcttttccccatttcttgtttttgtcaggtttgtcaaagatcagatgtttgtagatgtgtggcattatttctgagggctctgttatgttccattggtctatatctctgttttggtaccagtaccatgctgttttggttactgtagccttgtagtatagtttgaagtcaggtagcgtgatgcctccagctttgttcttttggcttaggattgacatggcaatgcagactcttttttggttccatatgaactttaaagtagatttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttacctatcagcttaaggagattttgagctgagacaatggggttttctatgtacacaatcatggcatctgcaaacagggacaatttgacttcctcttttcctagttgaataccctttatttccttctcttgcctgatagccctggccagaacttccaacactatgttgaataggagtggtgagagagggcatccctgtcttgtgccagttttcaaagggaatgcttccagttttttgcccgttcagtatgatattggctgtgggtttgtcatagatagctcttattatttcgagatatgtcccgtgagtacctaatttattgagagtttttagcatgaagggctgttgataaataagaggttcattgacttttctctttattcacacaaagttgaaactcttatatcatctcttaatccagatgatcatcatttatttcttgtgttaaatctaggcttagaaaactcatttacataaagtatattcattgaattcttactctatatttagggcattgattgtagtcttggtgaaaaaaaagtaaagtaatacagaaagtatgtgttttttttaagtttataagttaattggcaggataagaaatgtgtatcagtagattgttaataaaacctaggcaattctagagttaattattaaaacacaattattaaatatctgaataaaggaaattagtagaggcttatgatattttactacttgagcatgtaatattaaaataatcctgttatatctctgataatgttttattctggtcaaccaaaggaaaagatatgatgtattatatctagaacacaaatagtgatttgaaaaatcatcttgtggcaagacagatacgaataggtgattaatagtgtatttactagtaaatattggattaacatatcaatataatctctgcgtaaaaggattaatatcagtctgaaaggcaatttctagtggaatgtctcttttctctgacctatccattatagcattttatatgtttattacatgaagacattgaatatttgcttatcaaattcacagatgacacatatctctgatgtattaaaaaaatggcttgacacacagtatcagaacctaaaaaattgcagtacaaaataatgacttgttaaatcaaatgagatacattttaatatacattgatatttgttctgcacttgggctcagaacgtaaactgttaaatatagataaggaataactcatatgaagaggataggtgagcagcaaattctacattaaagctcagcctgaaatgagtagggtgactgctaatttgatcttgcagactctctccgctagtattaaacgcatactccgctagtagtaaatggatactctctccgctagtattttctgtcaatacttactttactactttaatataaattgctaagtcatattgaatagagcaaaaatcagaaattcaccttcacaaattatcccttccaatgtgttttattattctagtagctccttgtctttcattgctcaatccagaaatgtatgagttagcctccttttctttacttctttcatatagtcaatgtgtcgtgtatattctgtcaatatagttggagacatatcatgaaggatctattaaaagattaacaatttagattttactcagttggcaataaagaacctattaaagattttgtcataagaatattttagtaaaatcatttgcatgattaatgtgcattcttaaaattgtactaatgtagagaatcatagagaccggttaaaaggttaatgaaatagttcaagtcagaaatgaagactgagagacatagaagagagggaaactaagacgatgcggactgaaaacatacatttgaaaatctgtagaggattttggttcaatataagtaatacttttctaataagtaaagtattctactcgtgaaaacaacttgtttctgaagaattgaactgccatgttacaagatcattttaaatagcatagtatagttggaataacgatatttaaggtgtcttctggtctgagagattatgattctattataaacaacattgaagccatataggataggtgcgttataaattaataaagcaaaatcccccaagaatacaggaaaggagagagagacagagatgtaaaatattatggaggaaattttatttgaattaataaaagtgaaattataaagaaacgaagtaatagaactaagatgggaaatgaaaaatcacttagggaatcatcagtcttaatttctttgaagcaaagaaagacagataagttttaggagctgtgtccggaaagtcactttaggtgtcattgtagaatttctaaatggtccagaatttggatattacactgtggtaagtgtaaatatagaagctgattataaagcatttgcaacatttaaacatcaaggcaaatttttaaaacttgctgatttgaagtagaaatgaaaaaaaagtgatatataaaataaattgcaaagaaagtattgaggaaaattccttttattatgtatcagtaggccaattggagtctaaatttaatgtgggaaacattaagaaaacagaagaaaagaagaggaataggtttggacatgaagaattgttatgcatttatttgtagacttgttgagctttaagaagatactggaaatcttgaggagaaaatgtctatcaaataattataatgtaacattgtaggctacaggtgaagttacaaatgtagatacagatttacaaatcatttacattgtaatgagttaaattgggtaaataaaccatcattgaagcagagagtatgtatgtaatgcttaaatgaagattacacggagcattaaagtatatacatatttattctgaatgaagctaaaacacatctgaggtgtcagagaaaatggggtctatattacagtaggaagtccaatgatattttactagcagagtgaaaggggaagagtgtctcaagaaggaggtgatagtcaacagtgtcccacatattgtgaagagttaaaaattcagaaggtacctctgatctttgacaaacctgacaaaaacaagaaatggggaaaagattccctatttaataaatggtgctgggaaaactggctagccatatgtagaaagctgaaactggatcccttccttacaccttacacaaaaattaattcaagatggattaaagatttacatgttagacctaaaaccataaaaaccctagaagaaaacctaggcaataccattcaggacataggcatgggcaaggacttcatgactaaaaccccaaaagcaatggcaacaaaagccaaaattgacaaatgggatctaattaaactaaagagcttctgcacagcaaaagaaactaacatcagaatgaacaggcaacctgcctaatgggagaaaatttttacaatctacccatctgacaaagagctaatatccagaatctacaaagaacttaaacaaatttataagaaaaaaatcaaacaaccccatcaaaaagtgggcaaaggatatgaacagacacttctcaaaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagagtatgtggagaaataggaacacttttacactgttggtgggactgtaaactagttcaaccattgtggaagtcagtgtggcgattcctcagggatctagaactagaaataccatttgacccagccatcccattactggtatatacccaaaggattataaatcatgctactataaagacacatgcacacatatgtttattgcggcactattcacaatagcaaagacttggaaccagtccaaatgtccatcagtgatagactggattaagaaaatgtgacacatacataccatggaatactatgcagtcatgaaaaaggatgagttcatgtcctttgtagggacatggatgagctggaaaccatcattctgagcaaactatcgcaaggacagaaaaccaaacaccacatgttctcactcataggtgggaattgaacagtgagaacacttggacactaggtggggaatatcacacactggggcctgttgtgggatggggggaggggggagggacagcattaggaggtatacctaatgtaaatgtaaatgacaatttaacgggtgcagcacaccaacatggcacatgtatacatatgtgacaaacctgcacattgtgcacatgtaccctagaacttaaagtataattaaaaaaaaattcagaagatgccatttgctttgtcaaataggaggtaactggtgattttctaaatacgaacaagtagaaaacctaaaattctagaaactcatctttacatagaaaactaacctattgatttaacaagattctagaaatttctctgtgatttactaggtttttatttcttaaggataatgaaaactaattcattctgaactttgtactactttatatttaataatctgtacatacattattttttatttagcaaaataagtatattctaaaaaggcattctttctatggtacatggatagtaccaatacattttattcctcagaatgctaaggtactccagactcttggaagcagataagtatttgatgccctttgttttaaacaatttcaaaatcatggaataatggaagttgaaattataagtcagaaaatgtagccatacatatttaatctgcccctttttttgtacccatcttctcttaatctctttacaactcaccttcccaccatgactcttctctatctgctttatatattgatcatattcgtgaaataaaaataatatctaagaattatttaggcaagagtatttgcataatatgcagtatctctaactatgtcacagaaaataacttaagccctggctggaaaggaaataagcagtatgagcatagaaggacttttacatgttcctgtgtttagatttttacataggcttttaaaaatggtgccagcatttctattacctcagtgatttaatacacattgtatggaagctgtacttccttgatattcagcttaccaggattaggaaattttaattgattgccatacatctggaggattatttagagctggattggaagtaagcaaaaacagcaaatttattcatttatttgtttactcattaatttctttatatagttatttttaaatgtttatgggtttcaaggtataagattatattttcaatggtgtatatcctagcaagaagataaaatcttgtaacagaattggaatgacagatgagatgtcatttctaaagcaagtcatagtatatcatagtttggaagaaaacaaaattccaatggctttttcccaatattttctggggaggttttatttttttattttttttatctccttctatgttatagatagatcgtaattaattttcctaattctgaaagtaaatctttggttcttggtacatattagttttgattgtcattttcattttgaaatgctttcttgttaatttaccaaattcattgaagcaacaatcattatgaatacacatataaacttaaaatgtttgtccatgccttatgggtataaaaagaacataaaattaaatgcatattacttctcagagagggagagtaagatgtcagttggcaactttggggaccatcttctattcaaaatgtaatcatagctggctttggttaaaaatgttgtcatactttagaattataacacaaaggcataaggttgcatacctctgtatctttctattgtgtgtttatattcaatgaaacatattctaaaaacagcttcaatctgtcccatatggaacaagtctccaattgcttgaacatacactgactatagcattttcttttaagtgatgttaaatatttcagtgtaatagcttctcccaattttatcaaaatctgtgatttcagctaagctctgttggaaacacaaacctaacctaaacagtagaaatcctgtcactggaaagtacacaggacaagtcagtcctcgtgggtgaatttcacgcctgttgtgtgtagtagttcttagctatgtttattagagggcatttgtccttcagcaacacttttgctggtctgctcgctgtcaccactgtagtattcatcaaagtaacaccttagaaagcacagcaatgttcccagagaactgctaatctgaaaatctttttttttttaacttttcttttccttggctaaaaatagtgctaaaactatgttaacagatatgtaagaagaaaaaatatgcaccagaaaaaaaattctgacatacagcagagtcaaataccaggatgtgatcagaaatatttacccttgtccaaaatacaaagaaaaagcattaatcaacttattgggaaattgcaaaaatgagtttggagcattatgaatactatagaataaaactatattttattgcacagtaattggttattttgacattgcttgtgtgtagtttcagcctttatatgactggttaggaaggaaaaatgtgtgaaagaatttgactgaatttaacctgaatttaatgacatgttattttttcaacattatttgactaaacatttaattcgtattttaattccagttatctggctctttcacttgagtggaattatagaaaaatatattaattaattaattaatctatgttatggttaatgtaggtttaaacatatattgctcagtgttttatatttttctgtccacaaatatgtttacgttataatgtggcaactcagtagcttatttcttgtttcaaagtcacagctgatcaagggaaagatttaaagttattcattatgtttaagctaattaacttgtggttatttgtttttattctgtatttgaatttgcatttcatgaattctctatactttttcttttacccattatctttaggatttaattactatttatccccttcccaaagaagaagaaaagatacatcagtaagccacagtgttctgttttttaagttttgtaaaagaaaatatttgaagatctcaaagttaaatgcacattatgtgttacagattttgtaattctgttcagtattttacatgttttaaaccattgcttaattctcttcctactgggaatgacagacaaaaaataaatgataaagtgtgataagtgcaatggttacaagttcaagattcaatgaaagaacacagcaatttaacttaaccaagtacaaaaggatcatagaaggcatctttaaggaagggataattaaacagatttgaggccaggtaggtttaaacagggacggggctaggtgttctaggagtgtacaagaaggcagggtaacactatgcagcgcatggcaagtcatgttcaggataactagagaacagagctctggagatctggtgataatgtacaacttgatcatcaataatttgctgcattttttttcagaattaggaaagcacttaagggaaaattataaatacaacgtgacactgccatcattagtttctatacattaatttctataaacattttgtaccattgtacgtggagtacagcccacaaattctttttcagtttgtaatagggcaatagtttaggtcttctcctcttagattaatattttttttcttttttctgcatggctaaaataagtttgtggtgagcactaaataagttttgtgtgtttcatcaggataagtcggtccctttggatttcagttgtattccattatatagaagaaagacaaatagaatacatactctcacctcatgttatagacatactttttttctttgtaaattttaagaacatgcgattgaaaatgcctactagaatttaaaggtaaatacacagtgacttattttcatcaaggagaacacattggctattattatcagattgttaaaattatgatatgtagagtttgaacagctcaattagaaaaaagtaaataaaatgccattagaaaaatgcaaacaataaaggaaatgtgctatttacatattatgaaatacatggaaataacaaacacagggtaaattatagaaattcaattgtaaaaaatctgctaggcatggtggctcctgcctataatgccagcaccttaggtggccaaggcaggtagatcccttgagtacagaagttcaagaccagcctgggcaacacggcaaaaccctgtctctacagaaaaatgtaaaaattagccaggcatggtgttgtgtgcctgtggtcccaactacttgggaggctgagctgggagaatcacctgagcctggggaggttgaggctgcaatgaaccatgatcatgccactgcactccagtctggatgacagagtgagactctctctctctcaaaaaaaaaaaaaaatcagtaaaatagtaagacagtatttttttattcatttttgcagaagattatgagataagagctgtcaaagctggagtacttacatggaaaaaatcactcatacattttttgtagttatatttgttggcataagtctctgaaaaagtcagtaagcagttgaaactcgagcattaaaatttgtatactgctttaattcaatatttaaattctatctgaatgaacaacaaaagagataaatagcactatttgcaaagatgttttttacagcatttattatcattatgtaaaattgaaaataacaaaaataccctaaaattggagattgattaagtaaactaaggcctatcctgacaatgataaacattttatatatatatatatatatatatatatatatatatatatatctcacaatttaaaacaatgggatttccttatgctgtttatgcaagtaaaaaaattatacatttagtttgcctagaattatgcaaaaatatgtatgtatgtatatgtgtgcatatgtgtgtatgaaaatgattatattcaactcaaatagtggaattgtacatttatttttatatatttaaaataataatattaaatattttattaaaatatttaaaataatattttttaaaatattgttttctttcttttcttttgagacagagtctcgctctgtcacccaggctggagtgcagtggcacgatctcagctcactgcaagctccgtctcccgggttcacgccattctcctacctcagcctcccgagtggctgggattacaggtgcccgccaccacgccaggctaattttttgtgttttttgtagtagagacggggtttcaccgtgttagccaagatggtctcaatctcctgacctcgtgatccgcccacctcggcctcccaaagtgctgggattacaggcgtgagccaccacacccggccttatttaaaatatttaataatattttatttctactttaataatattttctattatatataatctcattttaaagttttaaaataaaaagttttgtaaataacaatagaccatatggaaataaggaaggagaaaagaaagcaactaagctttatgaaaatatactgtgtggcagaagctgtatgatttaatacataaaataagtctaagaagtagatattatcatccgcatttgacagatgcagatattcatgcttagaatcaatttagtagaatttgagatttgtgtgactgctgctaagttacaaatagaaagtattgaacctacgctttaaatcttaagcagttgatttttctttccaaatctggttctttaggaagacaaggatggggaaaaatatcgattgtttcattgagaaaggaaagagagcccactggtacaaaattaacatgtgacttaggaatcttatttcacagtacctgaaacctggaaactagcaattggagcaaatcactccaggaccagggaatactttaaaattgtttttgagtgcaatttaataaacatgatttttctttggctcttcacttgctacaagaaatcttttttttaaatttgtgtgtgtgtgttttctattggtatgtcaattcgataatgtacattgattttataatttggatgtatcatctgacctctttatacaatttgggtatttttaatcttacagctcttttaaaaacattcattgactattgcaaatgaagtaaataaactcagaccaagcctttttatcaggcatttagaaagagcatgggatatatagttatatcatatcctagttccatcacttacttactatgtaaccttgggcaaatgatttagattcacgaaattgcatttcctaataagcaaaattatgacaagtatttacctcaaggaattgtagaataaatagtaatgtacgtagagaccatcttagatattactttctatttagctgttatacaatacatgcttcttattattatgatgattggatagagaggatattttaattttattttaaatgtaatacttaaaagttgagatctttgcatcacagcaattagaggatctctatttccaaccttaaacccattgcttaatttactactaaaagtatgaatttaatatttctaaattgtatatgataggaattggaattagaagatcacttcttagtttcatttggattttgaaagctcacctagaattaggaatactttagaaatcagttagtggcattaataatgattttgcacccctttcttaacacagattaactatgcagatttgtttttttttttttaactgttattgcacagaaggagagtataatctctactaggactgttaaatcaataatactaattctcctttcatatcacagccaaaggacggtactttctgtcaaagatccattgaccttggagtctactacaaagtcagtactatcttttaaaattgacattctcagtttcctaggtgattctctgtaggttctttacatagttgtagtcaaatggctaacagcacaaagagtgattgggaaaaagggaaggaccagatcaaatactcaagtaagaagagaagaagataggaaggtaacagagtgaataaaagacctagatacaaaaattagccaggcatggtggcgggtgcctgtaactccagctactcgggaggttgaggcagaagaattgcttgaacccgggggcagagtttgcagtgagctgagatctcgccacttcactccagcctgggcaaaagagcgaaactctgtctcaaaaaaaaaaaaaaaaaaaaaaaaaaaaaaaaagacttagagttgctttaaattagtgaaacaaacaacagtaaaacaccaacctttttgcaggagaatcaatatctaacatgtttggcaaatgttttcaaacagaggtattgttaaaaaaaaacaaaaaaaaatgcataatcagctgtgtaccaggattttccagaaaatagcttaaatagcaatgtaaaatatttaataatgaagattttacttggtaaaactttagcagataactatcatataaactgaaagaaatattttttttaaaaattgagggcagttgaggttagtcagagataagatttactggaaaagacagaaactgcaccttgtgatgttgttttttatgcctaaggcagtaccctattacagtcttgagaacagaaagctgcagcattaccagcctgggctgtcagagggcataccttagaactggaaaaagagccacaaatttaaaggcaaatcctttgagaaggagggatcctcagaagggatggaacacccaaattttagtacaaaatctccctaaaacttcatctgacctagaaattatgcatgctggttgagaaattgtgcatgcaattgcagggaaacaggggaaagcagctgttagcaactgtaataactgattggcgactttacctgctgccaaccttatgggatgctgagcttggagttctagtttagcgaaattgaccacctcttgaaataaaatgtattttcagagaattataacaaaatccagattttctttcaatttattattactatttattattcaattaaaaattagtagctacatgaagaaacaggaaaattaacctatactcaagaaaacaagcagttggatagaatgtgacaatgacataattaaaatgtttctattagcacacaagaatgttagagaagtgacattttcaaggacttaatgggaaaaaggaatataatgaatacacacagaatttaatctcaacaaagaaatataagccatgaaaagaatgaaatgaaaattctaatgctgaaaaatgcagtaactgaaatgaaaaaaggaaaacactgtgtgggtttaaaagaagattggcggtgacaggaaataaagtcagttgagttgaagatggaacttttctcatgtgaaagagaagaaaaaaatggaagaataatgagcatggactcacaaacaatgcaagtggtctaacataatgtaattggaattctagaataagatgagagaggaattggggcagaaaaaatgttttaaaggaaaattagatgaaaacttcccagaagacatcaatttacagatccaaaaatacagtaaacaccaaaaataataaatgcaaaggaagaaaaccaaaccatatatagacacatcatagtcaaactgctgaaatctaaaatgaaggagaaaatgatgaaattacatagagtgagaggagaatacaaatgaaagtggagttttcacaagaaacaatataataatatctttaaagttaaagggatggggagcaaaactaaaaaacaacaaccaaaacactgtcaaccagaattctgtatccatagaaattatccttaactggtaaaagtgaataagaaatttttagttagacaaaaactgagagattttttcattaagagacccttgttacaagacattgaagacttaagagtctgaaggaatcggattaccagaaaggattaaaaataatcagtgtatataatgcatataatctgtatgtatattttcatattgcagactatattgtttaactttatcactgaaaagatgatggaaaattccttggtattaaaaatatttatttgatgcagaacaatgaacactgagacttattgagttatatttgcttctctattatatttattatattcctgtcttcttttttgttcctttcattctgtgttttttttgaaatggtgtctggctctgttccctaggctggagggcagtggcacaatctcaactcactgcaacctccacctcccaggttcaagcgattctcctgcctcagccacccaagtagctgggattacaggtacccaccaccacacccagctaatttttgtattttttgtaaagacggggtttcaccatgttggctatgctggtctcgaactcctgacttcaagtgatccgcccaccttggcctcccaaagtgctgggattacaggtgtgagccaccatgcccagcctgcttctctattatatttctcatttgagaagatatcatcaaataatatattaagacgttctcttccattatataaattagggccaaacatatttcttatgtttgtgttataagatagtccctagttttatatttcaatgtaagagggtctaaatagcactgatttatttttttactttatttaaagatcctatgatttgcattttttaaaataaaggcatattgctattgtttttggttttatagtgcgtgatttaatttcacagcatataaattgtaactctgagaagaatgctgatgttttattttgggtggatagaattgccaagtcttactgtttcaatagctttcaagtcgggcatgtgattaatgtatgtgcctgttaaagtatgttgttattcttaaattggtttttcacatttttaattttataggttggaagaaatgttccatttggattaataccttttttctccctctgctctgaaaagaaactatatgcttgtaattaattcaccttggctatttagcaaatgaattcaaaatataaggttagcaggttagctcttctattatcaaaatcacttatgccaaccagtttcgcttaacaaattgatacaagatgagcctaatgtttattttttttttggcttagaatctcgtataggctgttaagctacattcataagtctgtctccgttatcttcctccataaacttttatcaggccattgcttaacaattggtctttgacatattgtacatattattaatagttatgacattatacacttcaggagccctttaggattgctctaaattttcaggcagaaatggtctcacagcaaacctctgtcaaacccctgtattaatttttttttttttttttttttttttttttttttttttttttgagatgcagtctcactctgttgcccaggctggaatgcatggaatgcaatggcgggatcttggctcattgcaacctctgcctccgtgattcaagtgattctcgtgcctcagcctccgagtagctgggactataggcgcctgccaccatgcccggctactttttgtattttttgtagagacgggtgtttcactgtgttggctaggctggtctcaaactcctgacctcaggtgatccacccaccttgacctcccaaagttctgggattacaggcatgagccaccatacccggctcaacatcttgcagtgcacaatatggatattaggtagtaatcaataggtggctgaaatgagaaatctatgctcagtagaacaggattttcttataaatctcaaaaacttttagataatacatcttaaagctgggtgccaacattatgccaatccttgttctctcttctcccctccactgcccacttagcagatggcttcgagcccacagaactgtgccctgctgcactccactaatgaccctattgtcaggtctctttgtcttcttgggacaatgtcaccactaggaattgtgtagtttacaaaacacataaaaagccctttcctgagaggtgagaaaaaactgaactccagctcagcctctgctctttatgggaacactttttttcctatattttttagcctgaagggagagcctttctccaattcttgctgtgccctccatatggtatagctatgggccattcagtgggcacataggattttggcataataaaaacactttctatttcttacagaatgttggagtaaattaatgcatatattaactaaaggggtatcacctaccttggaaaggctagtcagtacatatgagacagtcatcagaatccttgacaaaggaagagctgggcatcatcatatcactatagttacagaaactggaaatgacatttattcaaagtggcggtgacacaaagcaggtgccatgaaccggccttattaggcagctccctggaataagcctaaactcagaggagagagaaaggaactgacttggagtctaagattttagttagatgattttgcttttatgagtttttttttgtggattgattatatttttgagttatagtgaacaagtaagaatttttacttttctaattggtcctcattttacaaatgtgcaatgttttctacaaaagtaaaaagcttttcagaaaaacaaacacaccatacacatcaattgtgctgatttctgcaaagcttactctgaacctggcatgattcagaattgtgtcctccatgcagtagttctttcctcagagctcgaaatcttagctgtcagaattcccctgaactcattaagactcatttgtctctgtcagtgacatgttctctagagccagttcatgccacctcctttgtctcacagccactttgaataagggcagtttacaagagaaaagagaacctattccttggaatgttttgtatctcaatgaattacacaaatttttcttcacaaagttccatttgcaaggaaaagtgcgggttaagcactgcctaaataaattaaatggtgcataataaaaatatcctttctataaaaaactcagaatactgtacactggttcaaatgaaaataatacagagattctgaccactgtctttggctcaaggacaacaagtactgtaggataatctcttaatactcagtttagaagtgccttagtaccatatgttgtgatataaataaacatatataaaactctgattatttgttttaatttaagggtagattttgcctcattccaagaagagatgatagatagaatgaacacacttaattaaagccatgctccataattataatttctctcaatttagttaaaaaattgactgtaaatgattcttatgttataattggctatattttacaataacaaatttttaatagcttaaaggttggaaatcacattcttttctaaagttatagtaaactaacaaaaatgcccacatagaaggctgctagaatgatcaatattatcttgaaacatttttgtctgctcaaacataaaagcaataaagtattgtagcttcacatttctatgctatagagcatgaccacaattgttttagcctctgttttgttaagaataataagatttgtggtcctcgcctttgaagagcctacagtctagtcaagtaaattgtatttaacaaatcattaatatgaggcaagtgctaaaaatcatatgaacaaagtgttatggaaacataggggagagaaagattaattatgatgaggaaaagcatctcagaaatgtcttttgtttggttggtttatttttattttgagacggagtcttgctctgtcgcccaggctggagtgcagtggtgcgatctcggctctctgcaacctctgcctcccgggttcaagcaattctcctgcctcagcctcctgcgtagctgggaccacaagtgcacactgcctcgcctggctgttcttttgcattttagtagagacagggtttcactgtgttgctcaggctagcctcgagttcctgtgctcaggcaatccgcccaccttggcctcccaaagtgcttggattacaggtgtgagccaccgtgccaagcctcagagatgtcatgttggaacatatttgaaaaaaaaagtgtcagagcctacaaagtaaactacaagacaaaaattattctagcaggcaaaaaaatcagaatgacagagaattgtatgcttgaggtactggcaagtgtggctgacagagggtccatatgatgaagaaagggcaagataaattaaaggggaagggaagtaggggatacttacacaacacaatggctactgaattgtattctgaggacaacagagggtgttctttaaaaacacgggactagtagagtaccaggatcagatttatggacaaagataaccttgaaggcattacaaagactcaataatggcaatagcaacagaggagtctgaagtgagcagagtcccctatttcagtgggaaggctatttcaaggccccaaacaaaagcaattaattaagcaattaaggaatggtagaaggagatatgagaaaagaacagaacaaattagagaaacatttaagaagtagcaataacagtgccagttcaaagggaagagtcaataagaagaaaaatttatcagggattattcagtttcactgttgccatagattattcatgtgaaacaactgaatttggagtagaagtaatgatacaattgtaagcatgaccattattgctgtttttttcatgtgatgattgtgtgtgtgtgtgtgtgtgtgtgtgtatgtgtgttagcatttctttaattttacatccagaaactacaccccatatttcttggcatttatatccaaaattccatttttagaaaaacctgtctaccaccaccaccattagtctttttgtctatccttgcttcttttcccagctatatccaggatgtctgggtaactcctgttgttgacttgttattagctgtgtgaccttgggaaagatatggaaatttgtccattctatcatttatgttacctgtcaaatggttatgttaataatagaacctaccacacagagtcagtgcaaaatttaaatttgttagcacacaggaagtgcttagtttattcactttttggaaaatggaaattaattaaagttaaactttgttattttgaaaggtccttagtatgagcatgaagagtattctttagatcataattatcttggaagccaagaacctaagaggttcattggctaaaattttaccccaaaatatttgttcttagaattcatattaggattctgtaactatgaaacatcataaagtgcctaatgtatagtccttactaattgtgtaatagccaatagttttgccactcaaaaaagcaccctttattttaaaaaaaaaaactatatatgtatatatatatatataaaaacacaatcatttccccaagccacaaagtgacatattaaaaaatttaaatttgctcaggtttactgaaagctaatgttgtgttgctgttgtacaatgtcacttaaggcaggcttctgtttatttttgttttagtgtgttcagtgctgtatgatttataaagtgttttcaaacatgagttaagcccatgatttaggagtggcacctgatttgcctcactgctctgaaaaaaagagctgagaagcaaaagccttacctggttacagattccgtaatcactggagtcaaaactcaacccaaatactctgacttctaggtcagtcttgctttgtttgcagaattttgtcttaattcgtctctattatgtttaacagattagacatagaaatacagataagaagaaattaaatatgtgaaaaacaggaaaatccagaagcatgttacatatctttattatgaggaatctaaaataaccacacaatactgtaaaactgtcacatctataatttatcacctttggtttgggataatttggcaaatttgtagaaaatattaaagataaacccagttttgaaaacaaagagatttataattgattatttgcaattgatggtgctgtaaaattgcaaaaagtaaatcttcataatgaaacatcaaaagtgattgacagctgtggggaatactagatttccttaagaccttaacttttgagaaaatatttatgttcatctgtttttaaattcaagtgggtacttttcattttgtctattttaatttggtattccgccaaagacaccatttggatttgatcaaaatgacttggtttctacacactcctgatttctagatttttccagagtcatcattaatttctaacgccttccctgcagattacacaatatttccttattactttgacatattttaggtgagcaggagcctgcttttcagataaaatacatcagacagaatcactattagaataaacctccaccaagaactcatgctagtttctacttcttaattgtttaatgaaatcatgaaaattgggctttacctgggctctgatttgccgtcattatttattatttacctaattagggactaattagctcataaatattgaaagaataaagtggtggcatgagggagggagacagtgtattctgctttatttttagttagtgtgtagtaaaacaaagacatgtttaggaaaggtgttcttggatgcattgaaccagataaaaacaatatgttaatagataacagtgaacttctttttcttctttatgctgaatgaaaaaggatcttgagaactttaaaaagcattaatgccactggaatgaaggaggaaaatacctgctttttattttaaagctcaaaagtagatgccagtctttactgtgttttaattcatcataagagtaggatatttcttgccacatttgtctctattaaacttttgaattccataaagctaagggcaacttcactaaattctacttgtctttactttcctaatcatgcctgtgatctttaattattttgccaattagatttgcctttagaacatatactttcaattttaatgacatggtctatatttttcttatgattgagactcaaaatcacaagcaaagacattttggaagaattatcttgtcagagttcatagattttgaagatagtgtgggggttaaggcaaaatttggaaagggacaatttttggggatatctttctgttttctctttttggagatttttgcttatatatttttaagatttattaagcagcatagttaatatgctgctttggaaggttacttcatctccttgagatctgaattccatattgataaaactggtataatgaggtctgcttttccctcctcttaagctttttcaaataaccaaaaatcaaaatgaaaaattctttgtcagaagcgatattaatcaaaatatgttatcaaccagtaaaactcaacaatgaaaactatttggtctatagtaatggtgcatacaggctactagtcagccctagggtgaaatacttgctatataactctaaaacactaaatatatgaaatataagctattagtgatattattcacaagaatattaatagatgaatctcagaacagagaaccttaatttataagtacacatcagtaatagtaggatttagggaagttaggtcagacagatatttgaaggaaaagtattcttccagaatatattattatatcagattgcttaaaaagttcatcttttagtctaataagtttgagaatactctgagaataaagattttcattgcttaccctaaatttacttacaagattaagacaccagagtaaccctccttctattggtaaataaataaatggaactaaagcaaacttattgattttatttttaatttaatatttatttttcccctaggactatagagtatttttgggtttaaaaaaaaaaaaaaccctaaatttagaatcagacacagtttggtttagatcccatctccatcattactgaccatgtcaccttcagaaatttaaaccactaaacatttattgactctgtactatatgccatgcaaatgaaaatataaaaaaattaatacaacatgttctgtctgccttcagtcccctcgcattctattcagagggatagatgagaaaagagacgtttaaaatgtgaaggaagtttctgggctcaaaagaagagtatctatctcagtctgtgtaggaaaggatgtgaatgtcagtgtgtgagagagagacagagagagagagaaagagagagaaaagagagagagaatgagaatgatgggagagagacagagagagagagagaaagagagagaaaagagagagagaatgagaatgatgggcagagaaggaaggaaaggaaagatttctgatagacaactgaaacccaagttagttcatagactttttaattggcttccctttccttctttgcaaattggaggaaataagatggagcatacctctgtgtggcaggggtgattaagctgatgataacatggtataagcttctgtttagatcctatctccaccattactggccatgtcaccttcagaaatttaaaccactaaacatttattgactctgtactatacgccatgcaaatgaagatataaaaaaattaatataacatgttctttctgccttcagtcccctcgcattctattcagagagatagatgagaagagacatttaaaatgtgaaggaagtttctgggctcaaaagaatagtatctatctcagtctgtgtaggaaaggatgtgaatgtcagtgtgtgtgagagagacagagagagagagagagagaaagagggagaaaagagagagagaatgagaatgatgggcagagaaggaaggaaaggaaagatttctgatagacgactgaaacccaagttagttcatagacattttaattggcttccctttccttctttgcaaattggaggaaataagatggagcatacctctgtgtggcaggggtaattaagctgataacatgctatcagcttctgtggctgagcatggtagcttggctcagaacagaccagaacctaaagcaaggattacaatatgaggataagtatctgagaaagagagctcaagtggattggcagtacaggagaggttgacatgaaatccccagctctaggccccaggagaaggaaatctagcttagtagttgcactgtgtatctgcaagataggagcaatggaaaaaccaaaataagtgatatctctagaaaaaaggatttctccaaacccaaggttcagaacaagtagttatcctcagaacactctttggctgggtcagtaggcacagaagggacaggaaactagttttgaatagaggaagtagtgggattgggacagataagagaaaggtagagagtgcaggtcctaagaggcactagacaggttatcaggatgaaaagtgcatgaaggccgaaggccagtggctgaaactggaaccagtgtgaagtaaacagtggccactcactgttgtctcccagggagtttagtttaggaaggataaaggagtctcccttatccttcctatgtaaggtaagcactagtatagaaactcaaaggagaaactcaaatgacctcaacagtgggaaacatggttgacaaaaactgggaattagaatctgctattttatagtaaattttttgattcactgagttagccgacatgtcttagtcaatctgggccgctctaacaaattaccacacagtgggtggcttataaataacacacatttattttttgcagttgtggagggtggaagtctaagatcagggtaccaacatggtgaggttctggtgaggggcctcttttggtttgccgactgccaacttctcactgtattctcacctggtggaaagagaaggggctagaaagggttagctctccttcttttcttataaggacactaatcccattatgagggctctatcaccttgacctaattacttctcaaggcactcaccacctaatgctattgtattgggtgttagggccccaacacatgaatttcaggcacataaacatgcagtccctaagaagacctaaactaaatattatagtgagcactgaggcagagcagtgtagcagtggacttaaattctactgtatgtaggtgactaattctgtagactggggcaaatcaattactttctctctcatcctcctatttctcatttgcagaatggagcaataatgtttacttgaacttagtttggggtaatcataattttaaacatttaatttgctttttatttatttattactccctattttgttcttatttaaaatagaatttaaagaagcaattggatttgtacagacggaatatattaattagtatataaaataattatatttatattcattttatcatacttatttgatgtcgatattaaaccatgtctaaattaaaggcaaaataaaatgttacccagtttttctttgtatattcattgcagacaaagataattttcttttacaagtctaatatcttacaaagaaactataatactttgtatgtttgctttttaagttaggaaaaatcttacctttattaaaattaggatactaagtgttcattgtcttaaataatttttttctcaatttgctaatgaaaagatgatcaactgggcttcatccctgggatgtaaggctggttcaatgtacgcaaatcaataaatgtaatccagcatataaacagaaccaaagacaaaaaccacgattatctcaatagaggcagaaaaggcctttgacaaaattcaacagcccttcatgctaaaaactctcaataaattaggtattgatgggacgtatctcaaaataataagagctatttatgacaaacccacagccaatatcatactgaatgggcaaaaactggaagcattccctttgaaaactaccacaagacagagatgccctctctcaccactcctattcaacatagtgttggaagttctggccagggcaattggacaggagaaggaaataaagggtattcaattaggaaaagaggaagtcaaattgtccctgtttgcagatgacatgactgtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaacgcccattcacaattgcttcaaagagaataaaatacctaggaatccaacttacaagggacatgaaggacctcttcaaggagaactacaaaccactgctcaatgaaataaaagaggatacaaatggaagaacatttcatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagccctcatcgccaagtcaatcctaagccaaaagaacaaagcgggaggcatcacgctacctgacttcaaactatactacaaggctacagtaaccaaaacagcatagtactggtagcaaaacagagatatagatcaatggaacagaacagagccctcagaaataacgccacgtatctacaactatctgatctttgacaaacctgagaaaaacaagaaatggcgaaaggattccctatttaataaatggtgctgggaaaactggctagccatgtatagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtccaaaaccccaaaagcaatggcaacaaaagccaaaattgacaaatgggatctaattaaactaaagagcttctgcacagcaaaagaaactactatcagagtgaacaggcaacctacaaaatgggagaaaattttcgcaacctattcatctgacaaagggctaatatccaggatctacaatgaactcaaagaaatttacaagaaaaaagcaaacaaacccatcaaaaagtgggcgaaggacatgaacagacacctctcaaaagaagacatttatgcagccaaaaaacacatgaaaaaatgctcaccatcactggccatcagagaaatgcaaatcaaaaccacaatgagataccatctcacaccagttagaatggcaatcatttaaaaagtcaggaaacaacaggtgctggagagtatgtggagaaataggaacacttttacactgttggtgggactgtaaactagttcaaccattgtggaagtcagtgtggcgattcctcagggatctagaactagaaataccatttgacccagccatcccattactgagtatatacccaaaggactataaatcatgctgctataaagacacatgcacacgtatgtttattgtggcactattcacaatagcaaagactgggaaccaacccaaatgtccaacaatgatatactggattaagaaaatgtggcacatatacactatggaatactacgcagccataagaaatgatgagttcatgtcctttgtaggaacatggatgaaattggaaatcatcattctcagtaaactatcacaaggacaaaaaaccaaacaccacatgttctcactcataggtgggaattgaacaatgagaacacatggacacaggaaggggaacatcacactctggggactgttgtggggtggggggagtggggagggatggccttaggagatatacctaatgctaaatgacgagttgatgggtgcagcacactagcatggcacatgtatacatatgtaactaacctgcacattgtgcacatgtaccctaaaacttaaagtatagtaataataaaatttaaaaaaggaaaaaaaaagatgtgaaagcagacttggacaatatgtaaataaatgacatgagcgtgtttcaactatttaggaaaacaagcagcaggatggatgtgatagagaagctgtggttgaccagcccctggtctatgttgtcaattcaaagcagagttgtcgtttccaaaagatattttttgatggttttattagtgcaaaataaaagctatttttcagattgcaaaacaaaacaaaacaaaaaaaaaaaaagaaaagagacttacattttaaggatttctactaagtcagagtatcttttgggtaaaactgcaggcaatttaagtaagattaatttttgcttcaaattacatttccttctaagtaattgtaggggtatagtactgatgaatgtttgtgtgttgagattgatgctgagggccatactgtgctttcattttgcacaggtttgaaactcaatgcataatttaattcaaatcagtaaatctgacactagtttttcacatggtgattttgaacaaaggttttaatgatcatttctataacctatgaaaatgaccacatacatttaattatttacacagtaagtttaagtgtatagcttaaaatgaagctgacggtaataacagcaaaagtaattctggatacatgactttttttaacaacttaggggaataaaattagaaatactgttaagaaagtaaatttctatattttaaagaagtggaataaaatcaaggtttctaactataggttattaggtaagatacatgactattaggtaagaaacagaaacatacagttgaataaaattgcaaagtcatttagtttatagtgttttaaaatttaagaacgatttaaactgactaaatcaatctcatctataacaagtaagactctagaatattcttaaaaccttctgagttttagttaaattggaagtctttaccctaatgttctgtaaaattattctaccaaacataataattcccttatttaataacatagctgattaatgattagtgaaaactgtggagctgtatctttgctgataataagttatattataacgttatttaatatttagaccacattactggaactccttgctgttatgggttaattttatcccctccctgcaaaagatatggtgaagtactcaatcctagtacttcagcatgcgaccctatttggaaatagggtcataacagaggtaatcaggttaaaatgaggtcattggcatgggttctaatccagcatgactggtatcctaataaaagcatttgatttggacacaaagacacagatgaaagaagggaagatgatatgaaaagacataatgccatctacaagccaagcaatttctgaggctaccagaatgtaggagaaaggcatggaacagatttttcctcacaaacctcacaagaaaccaaccttgctgataccttgatttcagactactagcctccagaactgtgatacaataaatttctgttgttcaaatctatctagtctgtggtaccatagcccttggaaactaatacactttctctgtggcttcatgttaagtttggccaatgggaggcgccagaagctagaagaagagaaggttgcaagggagttcagagcctttgttttcttggctccctctttgcaaagagggttggtttcactctcctttagggtgctctctctatatatttatcttctttggattcctgaacctctcttttcgtctcttcaggtccaagtgttcaagggctcccagatggtacaagcctcaaggatctatgtcatctcttactaaatctttcccaggccctttaaaataattttttaaaaagccaaaaaaacaaaaaaaaaaacctcttaggaaagtagctggtttgcatatgacgtgcttttcttggcagggccatgactgatacagcatctgtcttctaaaagagacttgtttatcctttatgctactactggacattgtacatgtgataacacttatattatattataatgacttgcctgagtagtatgtcttttcatctctaaaagaagttccttgaagctgcttattctccattgtaaaaccagcactttatacaggctctgccataatgtaagtcctcaatatatacttaccaaatgaatgcatagatgaatgtttatttttaagatgctgctatatactgccttgtttacaaaagagaaactttggatagttaataaaataagcatcatagaataatattaaaattaatatgtaaagaaattcaaaagataatagggtcagggaaagtgaacatgaaaataagattaatacatgaaatattataatttgcaatgtactggcactaggtggataacaaatacagttctgtgctatgtaacagacaatgggaaggctaaataagacaagttgcataaatcagtgtccataagttaaatacaaaccaattactaggtgatatacacatattccaaagactgagactggagcagatgcaaatattaatttccaattaatccctatgaagagataagcatgtcatgcaatgaacaatgctttcaatatgctcctaaagataattaaaaatgagtttcctaagactttttgtgccacattctcatatgaccaatgcagtaatgcccaaataatgttcaataaagattactccaatgggagcaggctaagcaaaacaatatagatgaggtactgtgacagaatggaccaacctaagcacacatatgtgaactgcttatacttttgataatatagtgattaatgcccatatctttattcataaatgttatacataaatattatttttatccactaagattttgatcagtattttgtggcaatgaattcaagtcttacaggtactaagaatgcagataactgttgtcaactcttatgggtaaacacatgtttttatagaaagccaacctaattattaggtaaaaatcacctataaatatttttaactacctggttaagtttattttatgtttaacaaataagagctaaaatggtaaaaaaaaaaatacattttaaaatgaatgaatacagcaagtttgtaaaagacagaaaataaaattttccttttggtccctcttagattttccaagacaggtttcaatgaataatgagattctatgaataatgagactcaaaatctcatgctatttggaatgaaagacattattgaataaatagtttttaaaaattgatgtgataaaatctcacaccctacatatatttctttttgttgactgagggggaaaacatgttagtgggaagtaaacacaatactcactgcttgtcattttgagaaaactgcacattgtttttttctcaaaatattacaaattcaatatcacagatcccagcatgtaaaaagtagaactactatggcctacttttcggacttatctactaaaaaattagcaggcctctagaaaggacagtgtgtgtatgtttgtgtgtttgatttagagtatatcctatacttatcaatgtaaacaataaacacagttttcaggatccacaagcttctctcagtgttacctgatcatcttcttgaacttctcattgtagtggtctgtgatcttctcattatcttgattacttaggaggagaaaactcagattctcatttcccagtagccagactttttgttgttgttgttgttcaaatgtaagcattaaattccttctaataaaattggttgtgattcctataattaatatatatggccataatttatgctagcataacttgattttgatggccctctttttgttctggcaatcagctaccaaaatggtcttagggccctctgtgaaaattatatatatttgttttaaattttatatatttatgtatatatatgcacattttatatgtatataaataccttttacatcagtacctttgggctgctgagatcttatatgaaggcatttttaaagtttttcttagcttaggaaactcagttgttttctggatagtaatacagagttttctaatttcttcaggtttactttttggtccccatatgctaagattcccttccctcttttcaacaaattactggctgaaagaacttcattatctaactgtattctttctgttgttttctgatgaaaaatgacccccaggatgaatttttcatttgttttaatctttcttcacattccattttgattctcttcagcccctgaagggattgtccatcaaatggtctcttctatcagggtcacagtatttacgtcgttgggcctcctcctcaggctgtgcatatcttaggtttcctgcactctcaatataacctgcttatcttattccaatttctgcttatcttactcagacccccagtcatccctgtgccatcaggagattcttcctagtagccagcatgatcctgccagtcctgtgatcaggctgccacaccaccatgcttctgcccaggagctgacatcttgaacaatgtggggagactgatggagacatgagtttaaagagaggcctctcatactgcttggtagatatggaaccatggaatgcccaaaaacaaagtcaagattttgcccacaacaatttagagtctactctgatgcaaataaatgattgatgtgccaaatgttgtacatcatagactatggtttcagtaatctgaagtgatgtaacctcccggtaaatcctctaagataaagttgtttcagtctatcactctgggcaaatcaataaattaacttacactttgcaccttttagctgtgagccagttaaatgtgaaatgtcatcaaccacaattgattgcttcaattttagcattcatttatctgaaattcttatttctgacaaaatttaggaggtgtattagtaggaattgcagtggactacatatagcaagtaacttatattacagtggctaaaaattgatttttgatttgcttttttccaaataaagagaagcccaaagataggccataagaagctggtatggggacaacatcatttcattggggatattatcatgtccttttagctttctttgccacaattttcaggttgtggttcttgttcttatttttacaagatctttgctgtaattcaggtagttttttcttcaaaaagaagaaaagatgaagaaccaatggtaatagggtatagactatttgagtcaacctccttggaagctcaaagccgatattttgactgacatcacacggacatttctatttataaggatgggtgggaaatacagcttttttatcttggcaatgttctgaccccagtgaaatcatgttttttttttttttttttttttttaaggggaaattgggaatacaatctctgccacagaagatcagatttgaggctatgtgataatgtatacgtaggaaaatatctttttgttttctacaatatgaatgtatgcatgaatatttatacatgcatatgtgtgtgtatgatggggatagcgtggggatcaaaggaagccatgaaacaaactcatccaaaaagtagaatcaatttattaataaagaagtaaaaataagggagtagtatgaatgtattcccatttttaccccactagaaattgtgtctgattagagattattcctgtctgttctgactatcgtggtttaattatggtgcaggttcttaataactatcaatatccaggagtctgtattaaagtcacacaacttatacttatggcttgttagcatttatgaaatcaaagccttcagaatatgtcaataaaggctcaaagcagtcttacaatttttttcctaacacagttttccacaaagtcctatgattctctttatgcataaatcaataaagaaggaactgtgtctagagtctgcagacttctgctcctgaatattatcctgagaaacttagcagaagaattttttttacttcaatgagataactaataagttaacatctataatatatgggacatgatatgaagaacatcataattttaaatgcatagtggactctggctgtaataagacagtatgaactaataatatttaataagataccaagtctgatcaaatacaaagtataagagagacttcagtaatcctcaagacaataaaaaatattcagagacacaattagctttggcttattaatcaaatttttctatggtggactattctaaggatcaatatgcagttaatcctggagttgacaaagttgagagcagtttataaaaccaggaaaataatttccaatagagttacaaaaatatatctaataccacaaactaatttgccaaattcaaattatggcatattttaattggaggaagttttatttatgaatattgtctatcttatccttgcattccaaagaactactgaaaggactagaagaaaaagagaaacaaaagaagaaaatatcacttcttatttctttctttaaaaagttagctttttaaaatatacatcactttatataaactgttcttctggggatatggatggtacactgtatttaatcaaatttcaaaagttttactccagaatacaagtactctagtagtttaaggagaaaaaagtgttcaatgtttaaacagggaggtaagggctagaaggagagaagatgtgaactgggcctaaaagaatgggtcaaatttggaggataagtcaactccattgaggaaaccccttccaaaagagcaaacatggaaatgatctatgtatttgtgtaatgatacaataaacaataacactggttgagatatatgatggatataaatgcaaaataagaatagggctgggatattaaaaatagctgtttgaggtttctcaatttagaatcatgaattaaaagttgacatgcatgtatacatatcagaaagggtcattctctgtggatcacagttttgtattttttcctgaaaagaaagaggcatttttggtggtagatttaatacagcattttgatgggtttatattttattttatcctgtgggataattttgacatttttttaagttgcaattcaaagtttatatgtttgtcatgaaaccagtagcaggcattcttagaatctgaaaagatatgatgtttcataatgtggttataggttgggtataaagtagctggatggacaggtgaactgtgtctatattctctctatgtgggacgttagtagaattgtagcctcattttcttatggtatcattgcaggaatactctatttatttgtacatgagccaacctgttataacttatatacttggcattcctggtatgtgataacaactatgaagataaatttggtatctctttagttaagacagtggtttgcatagaataaaagtgtaatacattttgaattgaattgaatggtacttattgctacatgattttgttcatgtttctctaagacatcaacaaatattcagtaagcaattgttgaatgaataaatgagagttcagcaatttcaacagtgactttattgatgcttttgggtaaaaacgctaagttttttaggtttcctagtttgatactatgtagttaagtattatagtataccttctgataatgagagcttctttgggcaagtaatttggttatctataagaaaaaaagaaaacctattacagcttgatggacttctcagaatctgatgtagaagtgtagcagcagttatcacatattttaacatcagctgtgatttttcttctgtcctcgatatgttaaaatgaaaactgtgcacatagggtctatatatcatgaaaaagttttgtaggcatacatctagttgtatagttcttatctctaaattatcataataattaagaaataaataagaaagcatattaccaataaaaattaataaaaacatctaaaaacactcaaattaaagcaggatttttaggatagaaggattgaaatttccagaagacaaatttcaattcaacagaaagaaaaaaatatttgcaatgaatgcctcatgaagtagtaaattagttcagaaatattcaagtaaagtctggatgttttttgtcatgagtttcgtagactaaataccctaaacaggtttcaaattaatcccatgaacatttgccaaatgtgtattctgttcatggctttattgaaaaggtttcctctgtaggtgtattctgagagatgagtagaaattccaagctgaggcaggatgaggccaagatcacttcagtgtggtcagatcaacaagcaggaacaaattttgggaaggttggttttcggataaagaacgcttaaacattgaggtagaaataaatgtaaaattattgaaaaatagaattggaactatttgtaccaggttttgaactcggcaagaaatttggtcttaatttttatttgaagagtagtccttaaaggttttgaattacatgatccagtcagtattttaataagattgtctggctacagccagattgtgggattagagcagagaaatattggaagagacggctttggaggttattttcatgattcacataagggatgattgtggcaataatgaaatattaggaaagacagcgcaatgtgtttgaggtagacttttaaaaataaggatattatttcctaataatgttaaataatagcattaggttttcaatcagaattcataggatatatggatatataaattgttatggcttttttaaactcagaaaataaggagaagaaattttgagaaatttcattcaatgtattctaagactgcccattggtcttaggatgttcccactgttaacctttctttgacgtatagtttctatcctataactttcagggaaaaattagcaggtgaaaacttatcagcaaagaaaataacaagaggttgatcagtgcttgatgttttcttcttgtcccttggtatccccttacatttggacagtttatgtccttttaaaaatgtttatcattatggaaattcttgcaaatttctaaatttcatgtatctaccttaatgtgggtctgaaatctatgaggctttatagataatggggctatagccacagtccccaacctttttgtcaccagggactggtctcatggaaaacaatttttccacagtcaggggtggggcaatggtttcaggatgaaactgttccaccttagataatcaagcattagattctcataagggtaacgtgcaacctagattccttgcaagtgcagttcacaataggtttaacgctcctgtgagaatcacatgccactgctgttctaacaggaggcagagctcaggtggtgcttgctcacctgccacttaccacaggccatgcaacccagttcctaacagtccagggaccaatgccagtccaggcctggtctatataactactttgtctggctttgatggtttatacctttgaatggagtttccttaatgtaggtaggaattatcttgattctataatttatcatgaggaaaatgtgttttttacatatttctttcataccttcctgcacccctccttcttctttaacatcatgtaactttcctatgagctctcattctaggcttcttcagagttatatgtattatgattttaccttttgttttatcataaataattcccttttctaaaacagacgtaggtaatatatttgattcactattcttttgcaaaatttaaatttcagttactttctcgatgtatttatgtttactggtaatgccaaaatctaggggttttgccatatgtgtattgtgcatatgtgtccttaacgccctatgggtgtcttcgaaatataatcaactttatgttataatgttgtgtttttatgtctccatatttcaccagaactgtacattattaaaatatggagatgtactttattaatttttaaagtcgggctctggcgtgagttggaacttagtaaatgggcgttgataaataaagatttttttctattaaatattacttcactctatctaaaaacctcatatttgcctttcatttccatcaggtttacttgtttatattttggtaaatcaagcttgctttactttaagttggtacaactgggtagtatttctaatcacattttgtattttatcttatcttctgaattcctctgtatgattcagagtgtgctcatgtagaatcttttcaacaatgtaaccgtggctactgtggaattcagtgccacaccatgacctgggcattgtcctctagagtaatatttttttaaagaatgccaattcaacaaataaataaataaaaatattcatggggcaggattttttaaaaattattttcttagaaaaaagtagattatgtaatctatatttaaattattgactagatgattaccaataaaatattttttatacatactaatctgttaataactagttaggtctggaaagtagccctatggggccagctttctaatatttgagcctgaaattagttaattcctcaactagaaaaaaagtaaaaagatgagttacatctgacataagtgctgttcaacttattttttagcactttagacttcattaaccataccatattccagaagacaagatcactaagttttcagaagacattacagtgttcctagcaaatagcattttggaaaaaattattttgactagtggaatatgtaaaatgaattaaatgtgattgaaatacttttattctcaaatttatgagagttaaaatagggttttgtaaatagaaagtgacgatagaaggaatccagctagaaaagctggctagttgctcacacagagccttacaggatggtagtaagttatataaagatgaataatcttatccttaactttaagggccatgaactaaatactacttccttttgtagaacttattacattgagcattataacttttcaagtaaacttttaatttgtaatagttttatatttgccaaaaatgtgtaaatatagttttcatatactgtgcatagtttcttctatttattaacatcttactctgatacatctgacgaactaacgaaccaatactgatagattatttttaactgaagctcatacttttattcatattgcttagttttttagtctaacgtcctctttctcttctgggatcccaaccaaaaaccacattacattaagtcctcatgtctccttaggctccttttaactaacattttctctgactttccttaatttttatgaccttgacagtttgaagaagctgttatataaaatgtcattaaattaggtttgtctgatttttgtattgttacaaaggggttgtaagtctttgggagaaaagccacagaagtaatataccattctctaattaaacattcatatcaagggtacattctctgaatattacatatcattgaagttaaccttcatcatctggctgagggtgtgtttctcagatttatctaccataatgtttatctttttctccacttaccatattgtatcttggaaggaagtcactacatgcagcgtacacttaatgggttggaagtttactccatcttccttaggggagtgtacctacgtaacttatttggaattcttctgcacaggatatttttattccatttatctcttgattcaatcatttatttatattataatggactcatggaaatttattttatactttggcttatattctaataatacattatttattttgtttcttaacttgtttcatttttggccatggagagctcatggagaatggcattagaaaccatcatctaggtactgggtatactcattgctactggaggtgttattaacttttataaagttaaaaatttatcattaacctaagtaactgcttacatcatattacctacatgatgaaattcaaaatccattaaaatgggagaaagagattgctaatttcccccagtgtttattttgtattttgttccctttaatagggccactaaatattaactggatatggacaccaacaataaactcaacatttctaaggtccctagagtcagatgtgacagctattgaggatgggatataacagatatcattaagtaactttttttgttcttaaatggaggagacatacccttcttctactcctttcttcttttgcccacctggaatgtggacatgatggcagaacacagagcagtttgacaacatggtagaatcaggtcctcattcttcagttagtcatcaaaacagggctgggatgccaaaacttaaacgagagaggagtaaaattttctcttctaatcatttttcatttaatatttcctgtcaaattacactccagcctaattctcactatatttggtatacccacttcagatgattatgtgttccagacacttacctctaatcaaataaagattgattaagcattctgtgtgagccggactctatagtaggagctaggagggaatttgaaaatgaacaagttaacaagccccagccctattgagtcgatactctagtcatataatagaatgttcctgaacactcaattcaattcttgtgtcatacgcacattcatgtttctgaaaaaaatgttcttcacttcttattatctgcatggaaatctcataattgtttaggaagactcatctgaacacttaccttttgggggaaattttctcttatgtatgtatatggtgttagtcactccttcatatatgcttctggagaacctcctacaaactttccatctgatatcaagtcataccattttttggatagaccataagctcttgaagacaggttgtcttttcattcaagtgttattattatttgccaaaatgatgtcggatgtgaagtgtttggtataattcaattttgttaatttacatggatgatagtccatttgagagaggataattttagtgtctaatatctggggaattccttctacttattcaggtagcaggggatctagattaatgatcagaagtttccatgatgatttttggaatcaaaaacacagctttgctgtatggcctggatggtatttgaacgaggccatgtgaggcctgaagaataattacttgttccacaacaaaatgtatttcaatgatattctttagattctaaattgcatcttgttatagtgaaaaaaaattccttgaaaatattcataacagccacatactggctatatctgtcaatagctccaacgtagcccgtctctcctctcaaattagaatatatcagtctctcctagttgaaaatgagttgacataattggattgaattttgggagcattttaaatgaagtcctatctttaaacactggaatcacacatggcccactgagatgctcctactgttggaggaacacagaaactgagaagaatctgaactttcatgagtgcagttcatgctcaacctgcagcatgcaggcttagaatgtggtggtgactgaagtcttctgcactattcaaatgcttttttttccctttatttttctctcctcctcagcctgtgagcatatatagttaaatgtgtaagtttataaagacatatcatctactttatcatacagctctacataacccaaagagcataaatgtgtctaactccctggcacaacaaaatctcttgaattattttcgcctctgagatattatgtggcaatctctccgctctgctatgaggtgcactcctagttacaaatgaacaagatcgatttagcagaaaatgatacaatgctgacatgttaaacaccaaccttaccagtaatcatttgtaatgctcaaagaaggaagcatgttgtgtatcagtcatgtttaaaggacttgaaagtaaggaaaatcattattttactcatgtgctttgggcagggtaagaacttagtaaatatttgcagacttgactataatagtggtattttttacaagcaggctgaatagtaggataaattgaattatggcgaataaaaatgatgatgaaaaccatttgttcaccaggcttagcttgtttggctttcacaaggtttcaacctggaagccaaacccttgggcacaactttgtggttttatctattagtttatcaaactaaataatacaatatagcctacttgcatcatctgtttcaaatgtatctatcataaatttaaaacaatcttttttattaggaagctttatattattggttgatattacatcacagacattctatatagaaaagtctgacttgaaatgagatgcttgaaaatgtcagtttttttcattgagagtgccctgagttttgaagcttttcagtggcatgattataagtaggacataccctttgtcttttctttccctatttttttcccagaaaagacagtgcctaatgtttgagtatagaagcagagataatactaaatatttgaggaaatgttggtgagctgaagctcaccatgagctttaattataaacaggtgaaaattgtgaacattgagcctagcatggattgtaaaacaggtggtgtaatctaactccttttggttttcagttacaaacaggtgaaaattgtgaacattgaggatagcctggattgtaaaacaggtggtgtaatctaactccttatggtttcaaaagtaagatacagtggcctttgggaattttctgtaatcgtacttggagaatggagaaaaatatgatgaacttttcacatacatttccaattcaatattcatcacatgaaccttaagagttagtaatatttctatttgccaaaagctttcacagtaggcttttaagcttaagattagaattcattgatttttattgtcctttaattttcagtgcttttgtttatggtaagttgcctttttgtagacaatatttgtgtatatatatgataatcttcagaatttatagaattaaaataagtttttggtgaaattcagataagatgtattttcctgcacacatataatgttatatgtctctttaagtcagaaacataggtaatgatttttatcatggaattataataaactacctagaaaatgcttacctttatatttattcaaatattgatgtagctatttaaggaattactgcagatttttcattaataagaatttccaaacactgatctaacatgtttgtttatagcttgtctttctaatctttcattaacaaagacctaaaaattatcctttattattttcataatttgatattcgtgtaatccgtgggtcaccttctgaccatgtgtgtgtgctcctttattctcaatttgcaggcttcaatgtttctcatttatatactgttatttctctttgaaaaggatgtttattgtatctttggtgaagctgtttttattttttccatcatagttttagtgggaccttggaaccattacaaaatctcaacaagaagcatgaaaatggagtgtgctttattcttttcccatcctgtcatagtcctcttagctgctgctatggcaacagactggcaacagttgtagaggaaaccatgctcagactaaggccagatggagggagttggtgccagtggcagcattgcatggaaactgtgtatagcagtgatgaattggaacttggctgtgttcctctccaatagataggcaagatggaaagggaaggaaaagggcagagactatggagtaccacataagctgagcagtcgttcacaggattgttgtccatgttaatgggaaatctaaatttcctacctagtttaaaaaacatatgtaaaacatgctaatatctatatgctattaaaaaacaagctttgtgacataatttctgttctaattgacttgctgtgaaacattccttctacaaattgatattgtattctatccctctagtctttcaactaatggccctgtgaattcttattattaacagtatacaatatatctctttactgttgctggtgacagtggaatttttctttccattaagaaatgtcacttttagtatgcaggtttgaggccactaaatgcataacatttttgttataaatatattaatgatgtttctttagaattaacatgaatttcctattctcagtgagcttttatgatacaataatcaagattaatatcaaatgaataaaaagaataacaaatgatttagtaataaaattcagatctccatacagagctgtacttttaggcaaacaatttttcctgaaggagaggctttaaagcctttcctagtcatgaataaaaatagcaatacaaagcaaaataaaaaattaagaaatacatccgagtggtaatttcctctcttattgatgaacccagtttgcatttgtgtttttcattttttatttttattttgtaacccagtttgcatttgtgttttgcatttttaaattttttattaaattaaaaaatcctagaaaacagaggtacagacatggaataatgtggtcagttgttatttaatattttgatgaggtaacattacactttcaagaaattttaaattgaagaccaaatttgaggtggattttattttctaaattgctggtatgagtcatctggtagatggtgtctctgatttagctgacagataagaaaatgtggttgttcatagactcccagggtaaagcatgtaagttgtcttaagaacatatgcacttgaagcatgacaataccataattaatttctgaaatgtttcttgggtcttaaacaagaaaaatgatcattttacaatctaagtttgagatatattttagcagataaatgtaatctgtaactaaagttcttttaatttttattgtgaattacagttatcatttatctaatataaagaagaaatgccgattttatttcattctagtgaacataactatactatccttgttacatcagcaaggagaaggcaagcaagattgcactttgaattatttacatttgaacttaccaagatataatgatacctttattatgtcaggataataacatattgaggcaagcttgattagctaatgttccttatttctgataggtgtccagagtcatattagactgatgaaaaataataccagtatttgaatatgataaaaatattatgaatagcctccaacatggatgtgtgtgtatttatatatttacatatacctatatgcatgtatatttatatatgaaaaatattaataaactaagcttccatatgtgtgcttttctagttggcattttcattttttaactaaatatatatgcatccagattttaatgaaaaccttaaaatgtcttcaaaaatagaatgttataatttacccttctccagcttcaataattttcaattcctttgccaagtcaatcctaagccaaaagaacaaagcgggaggcatcacgctacctgacttcaaactatactacaaggctacagcaaccaaaacggcatgttactggtaccaaaacagagatatagaccaatggaaaggagcagagccctcagaaataataccacacatctacaaccatctgatctttgacaaacctgagaaaaacaagcaatggggaaaggattccctatttaataaatggtgctgggaaaactggctagccatatgtagaaagctgaaactggatccctttcttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaacggaatctaattaaaactaaagagcttctacacagcaaaagaaactaccatcagagtgaacaggcaacctacagaatgggagaaaatttttgcaatctactcatctgtcaaagggctaatatccagaatctacaatgaactcaaacaaatttacaagaaaaaaacaaacaaccccatcaaaaagtgggcgaaggatatgaacagacacttctcaaaagaagacatttatgcagccaacagacacatgaaaaaatgcttatcatcactggccatcagagaaatgcaaatcaaaaccacaatgagataccatctcacaccaattggaatgacaatcattaaaaagtcaggaaacaacaggtgctggagaggatgtggagaaataggaacacttttacactgttggtgggactgtaaactagttcaaccattgtggaagacagtgtggtgattcctcaaggatctagaactagaaataccatttgacccagccatcccattactgggtatatacccaaaggattataaatcatgctgctataaagacacatgcacacgtatgtttattgcggcactattcacagtagcaaagacttggcaccaacccaaatgtccatcaacaatagactggattaagaaaatgtggcacatatacaccatggaatactatgcagccaaaaaaaaggatgagttcatgtcctttgtagggacatggatgagctggaaaccatcattctcagcaaactatcgcaagaacaaaaaaccaaacaccgaatgttctcactcataggtgggaattgaacaatgagaacacttggacacaggaaggggaacatcacacaccggggcctgttgtggggtgaggggagaggggagggaaagcattaggagatatacctaatgtaaatgacgagttaatggatgcagcacaccaacatggcacatgtatacatatgtaacaaacctgcacattgtgcacatgtaccctagaacttaatgtataataataagaagaagaataataataaaatgtggtcctggcatggtggctcatgcctgcaatcctagcacttttggaggctgggtgggtggatcacatgaggtcaggagttcaagaccagtctgaccaacatggtgaaaccctgtctctactaaaaatacaaaaattagctgggtgtggtggtgcacacatgtaattgcagctacttgggaggctaatgcaggagaatcgcctgaacctgggaggtggaggttgcagtgagccgagatggcaccatagtattccagcctgggcaacaagcatgaaactccgcctggggcagggttaagggggtggagggaatttgtgttggcgtggggggaggggggaataataattttcaatgcttaagtattcttgtttcatccatataaaaactcaccgccccatatggttataaagataatcacaaatagaatataatttaattatgaaatgtttgaatatataactgtaaaaataataggatttaaaacatataaaaatattattgttcacaaaataattaagaatatttatttattttcatcaaatactcaatgttaaaaatttttggattgtctttcttcaaaaaatttaaagcttttttctaattagaattaaagatacattttaaatacattttaagctaaatctagaactaaaagcaatctctgtctctctgtgtctctgtttctttctttttctcttcttccctagctatttattcgttagagatacctactcatttgcctttagagtttctcgagatctggagtttgctaacttcaaaatgttcctttttcccctttatttcctataaactagtagtgaaattcagggttgttttttggcaagactatatcataggtggtgttgtgtacttacatcagaatgttgccctatctgtgatgtttgcagccacgaccaacatttattattttattaaaggttgcaaaacagtgatattctgattcacgtgctccttcctacctaacattttataaaatactttgttatcctacaataagtttcatataagaaaggagagataaatgcatgagtcttcccattaatttatttgtttattcactttaactattgtgttgtattttataacatgtatataccaacatagtgttgtttctaatttttaatagatataaacaatactgtaatataaatgcttatacatattttgacaatttctactttaaaaatgcgaagttttcctcaatgcaggacgttaaaattcctcttcagtcaacattcttttgtgtttgctttactttttaaactattattattattgttaatctcatagccgtggaatgatttatcattattaatagctaacatttgttgagtgattagtacataccaggccttcatttagacaatttagaagcacaattttattttatttacaaatatttttattaggtagctgctattattactctgagtaactaaagttctttccatttttattgtgaattatagttatcatttatctaatataaagaagaaaaaaaggaaaaatgaaggccagaaatattaaataacttgtacatggctagtgagtggcagagtcaatattttagccaagatagtttaatcatgaaataatagtggatcccaatagttggaattcgtatttcttgatttttaggtatattgaacctctttacatttatttatgaccattctcctgcctcagcctcccgagtagctgggattacaggtgtgcaccaccacggctggctatttttttgttgttttgttttttttttttagtagagatggggtttcaccatgttgatcaggctggtctggaactcctgacctcagatgatccgcccgcctcggcctcccaaagtgctgggattatagatgtgagccacgacacccggcttcattttgtcattgttaaggataaagtatagatgtcataaaattcttttctatgcatttggattttaatttgtgaggctatatccttctgaaccttgaagaagttatccaaataatactctgactgtgactagtaaacactaaaggatatggtatcttttgtacagttgtcctgagattgacattattattaaaataatacaaacaatatattgctattttaagttcctaatgtatctaaactaaattacatgcaccccacctggccaaacaacatggagaagaagagtctaataaaacgctgtatctactctgaaatttaaaatctggttgaggggacaattccaataatgaaatcgttaggaaatggggtaaaggagcacataatcaaaggctaggcatatggggcatatcataactctatgctttaaaaaatgtgaaatttgtggctgggcacagtggctcgtgcctgtaatcctagcactttgggaggccgaggcgtgcggatctcccgggtcaggagtttgagattagcctggccaacatggtcaaacgctgtctctactaaaagtacaaaaattaaccgggcgtggtggcgggtgcctgtagtcccagctactcagactcagggggctgaggtaggagaatagcttgaacatgggaggcagaggttgcagtgagccgaggtcacgccactacactccagcctgggcgacaagagcaagactccgtctcaaaaaacaaaacaaacaaaaaaaaagtgaaatttgtttcagaagaaacaaaaatttgaattttcaggtactttaatgtcttattcttaggaaaataaatgtaacattaagatagcattaaattagctattagcttttcaaaataaagctttttaaaattattttttgaacattgcctctgtcctaagccctggagatataatgataaataaaatattattttctctcaagtataatatggtagaatcaggattgtttagcacattttctccctgaaagtagatattgccctttggaagactgtaatcattttgtttctgctgcccagtcagttattatttgagctgccacctcttcaagtttgagtcggcttatcaaaccttgtataatgttactagtcattcatccctgatattttacttgctctgttagcattttattttatgtcacagtaactcctaggataaagaatgagataaataggataaaagtttgtcaaaagaagtgacacatttgttgatgtgaattttgttaaactctagaaaaaatgtcactagaaattttagtaaattggggagaaacttccttgctgagaattaacatgcaaaaatgtgagttagcctccagaaaattatcaacagacattatttttttctcaaataaaatgatttacatcccctaacagaatgaattaaggatagtatgccagagttattaattttaaaactttttgtgtgattttgcaaaccttgtgacctatatcaccatgctgacggataagggttaggttgtatgttaagatgagataaattattgcagaaatatactccaattttaaacagatattatgggttatttaaactatattgtaaaataacaagttgataatttaccaattagttctaccagatctaacatttattcctctaatccaaaagtcctttacccatatgtttgcatgccacatattatccactaattttaggcctcataagtatcacttgtttctatgaccaggacataagaattcttcataaacattttattttaaaaaccatattttgtaatttcaacttagtttgaaaaatcttggaaaattattccaaatgaattcatcaaaaattttccacctaagctattgatattttgtactgtcaaaatccaccagataatggcataaccttctgtttatcctgaactccagagttttgccagggctggacataggctacctgtcttagctagaatattaattttaaaataagaaaaattattttttttaaattacccaaattctttaaatgtcaccagtcatggcatctatattgttgtccctggaaacatccatggtataattttcccaataagcataacattgtttcaagagaagatgtttgtcaatatcatattctatataacatgtatattataaaattataattacttctagaatctttaatttatttcaaaattataaatgacaatgcagactgtgtttgtgtgttttatgtgtatgtgcatatgctagcatttttatgtgtataggtctgagtaaaaattatcaacagagtaggctgggaagagatagatgctaaaagtaaacaaaatttggaattaaaatacctgggtttttcaagcctttcatttctactatgaatagaatgtggaaatactgttatatttctgtctcctgacatagagatatacatagacatatgtcagtgtcatgtatagtgtgacagtgaagctattttatccaatcattaattttacttaaatcaatatatattgagtgctttctctgctctgtgctagtaatatattgaatcaaaacacagggggaggagccaagatggccaaaaaggaacagctccagtctacagctcccagcgtaagcgacgcagaagacgggtgatttctgcatttccatctgaggtaccgggttcatctcactagggagtgccagacagtgggcgcaggtcagtgggtccacgcaccgtgcacgagccgaagcagggcgaggcattgcctcacttgggaagtgcaaggggtcagggagttccctttcctagtcaaagaaaggggtgacagagggcacctggaaaatcgggtcactcccacccgaatactacgcttttccaaccgtcttaaaaaacggcgcaccaggagattatatcctgcacgtggcttggaggggcctacgtgcatgcgcatggagtcctgctgattactagcacagcaatatgagatcaaactgcaaggcggcagcaaagctcggggaggggtgcccaccattgcccaggcttgcttaggtaaacaaagcagccaggaaacctgaactgggtggagcccaccacagctcaaggagacctgcctgcctctgtaggctccacctctgggggcagggcacagacaaaaaaagacagcagtaacctctgcagccttaaatgtccctgtctgacaactttgaagaagagtagtggttctcccagcacgcagctggagatctgagaatgggcagactgcctcctaaagtgggtccctgacccctgacccccaagcagcctaactgggaggcaccacacggcaggggcagactgacacctcacacggccgggtactccaacagacctgcagctgagggtcctgtctgttagaaggaaaactaacaaacacaaaggacatccacaccaaaaacccatctgtacatcaccatcatcaaagaccaaaagtagataaaaccacaaagatggggaaaaaacagcagaaaaactggaaactctaaaaagcagagcacctctcctcctccaaaggaacgcagctcctcaccagcaacggaaggaagctggacggaaaatgactttgacgagctgagagaagaaggcttcagacgatcaaattactccgagcaatgggaggagattcaaaccaaaggcaaagaagttgaaaactttgaaaaaagttagaagaatgtataactagaataaccaatacagagaagtgcttaaaggagctgatggagctgaaaaccaaggctcgagaactacatgaagaatgcagaagcctcaggagccaatgcgatgaactggaagaagcagtatcagcgatggaacatgaaatgaatgaaatgaagcgagaagtgaagtttagagaaaaaagaataaaaagaaacgagcaaagcctccaagaaatatgggactatgtgaaaagaccaaatctacatctgattggtgtacctgaaagtgatggggagaatggaaccaagttggaaaacactctgcaggacattatccaggagaacttccccagtctagcaaggcaggccaacattcagattcaggaactaaagagaacgccacaaagatactcctcgagaagagcaactccaagacacataattgtcagattcaccaaagttgaaatgaaggaaaaaatgttaagggcagccagagagaaaggtccggttaccctcaaagggaagcccatcagactaacagcggatctctcggcagaaactctacaagccagaagagagtgggggccaatattcaacattcttaaagaaaagaattttcaacccagaatttcatatccagccacactaagcttcataagtgaaggagaaataaaatcctttacagacaagcaaatgctgagagattttgtcaccaccaggcctgccctaaaagagctcctgaaggaagtgctaaacatggaaaggaacaaccagtaccagctgctgcaaattcatgtaaatgtactaaatgctccaattaaaagacacagactggcgaattggataaagagtcaagacccatcagtgtgctgtattcaggaaacccatctcacgtgcagagacacacataggctcaaaataaaaggatggaggaaggtctaccaagccaatggaaaacaaaaaaaggcaggggttgcaatcctagtctgtgataaaacagactttaaaccaacaaagatcaaaagagacaaagaaggccattacataatggtaaagggatcaattcaacaagaagagctaactatgctaaatatatatgcgcccaatacaggagcacccagattcataaagcaagtcctgagtgacctgcaaagaatcttagactcccacacattaataatgggagactttaacaccccactgtcaacattagacagatcaacgagacagaaagtcaacaaggatacccaggaattgaactcagctctgcaccaagtggacctaatagacatctacagaattctccatcccaaatcaacagaatatacatttttttcagcaccacaccacacttattccaaaattgaccacatacttggaagtaaagatctcctcagcaaatttaaagaacagaaattataacaaactatctctcagaccacagtgcaatcaaactagaactcaggattaagaatctcactcaaagccgctcaactacatggaaactgaacaacctgctcctgaatgactactgggtacataaagaaatgaaggcagaaataaagatgttctttgaaaccaatgagaacaaagacagagtataccagaatctctgggacacattcaaagcagtgtgtagagggaaatttatgcactaaatgcccacaagagaaagcaggaaagatccaaaatttacaccctaacatcacgattagaagaactagaaaagcaagagcaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagtatcaaatagacgcaataaaaaatggtaaaggggatatcaccaccgatcccacagaaatacaatagcttaccaaccaaaaagagtccaggaccagatggattcacagccaacttctaccagtggtacaaggaggaactgctaccattccttctgaaactatttcaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccaaattctaccacaggtacaaggaggaactggtaccattccttctgaaactattccaatcaatagaaaaagagggaatcctccctaactcattttatgaggccagcatcattctgataccaaagccgtgcagagacacaaccaaaaaagagaattttagaccaatatccttgatgaacattgatgcaaaaatcctcagtaaaatactagcaaaccgaatccagcagcacatcaaaaagcttatccaccatgatcaagtgggcttcatccctgggatgcaaggctggttcaatatacgcaaatcaataaatgtaatccagcatataaacagaaccaaagaccaaaaccacatgattatctcaatagatgcagaaaatgcctttgacaaaattcaacaacccttcatgctaaaaactctcaataaattaggtattcatgggacgtatttcaaaataataagagctatctatgacaaacccacagccaatatcatagtgaatgggcaaaaactggaagcattccctttgaaaactggcacaagacagggatgacctctctcaccactcctattcaacatagtgttggaagttctggccagggcaatcagttaggagaaggaaataaagtgtattcaattaggaaaagaggaagtcaaattgtccctctttgcagacgacgtgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagccctcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaagaattccctatttaataaatggtgctgagaaaactggctagccatatgtagaaagctgaaactggatcccttccttacaccttagacaaaaattaattcaagatggagtaaagacttaaacgttagacctaaaaccataaaaaccctagaagaaaacctaggcattaccattcaggacataggcatgggcaaggacttcatgtctaaaacaccaaaagcaatggcaacaaaaccaaaattgacaaatgggatctaattaaactcaagagcttctgcacagcaaaagaaactaccatcagagtgaacaggcaacccacaaaatgggagaaaattttcgcaacctactcatctgtcaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaatgctcaccatcactggccatcagagaaatgcaaatcaaaaccacagtgagataccatctcataccagttagaatggcaatcattcaaaagtcaggaaacaacaggtgctggagaggatgtggagaaataggaacacttttacattgttggtgggactgtaaactagttcaaccattgtggaagtcagtgtggcgattcctcagggatctagaactggaaataccatttaacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtgaaacatatacaccatggaatactacgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaactcatggacacaggaaggggaacatcacactctggggactgttgtggggtggggggaggtgggagggatagcattgggggatatacctaatgctagatgacgagttagtgggtgcagcgcaccagcatggcacatgtatacatatgtaactaacctgcacattgtgcacatgtaccctaaaacttaaagtataataataataaataaaaaaaaataaaagctaaaaaaaaagaaacacaattgaaatacattggtaaatatattctaataaaagtagaaacatagacacaaaaaggaacttaaaattgcaattccttataaattttcacaaaacatagatattttagtgtaaaaacattcatttatgtaaaaggaatatataaaactattacattaatgaggaaaaatcatggacttggagacattagaaaattatatttaactcgatttattttttgttagagtataagataagttttcagatgatcgtgacgcctcattatttctttattcttggtgactgaaatttatatatatgtttgtgttttgtgaatatatatatctatatatacatatgtcattgcagatttgtcattcaattatgcaaaataaataaatagttaaaaatccagaatcagttgagctgcaaaaactcagtagtttttgagactaaactcatatttagtctcagtatatttataaggtgtgcctagtaaaatattttacaagaatttgtatgagaaatagtctacaattaatatatactgcattataagaaagaatgattctctctatattttacagttcacttccaggacattttatgagttatcctggactaaaagttatattaaattgtatgaaggtcccagcttgaccaatccacagacttttctaagctttccatactctagtttcttctcatgcctcaaagagtttttctaagaacaaaaaacaaaataaaggtatgataacaagtacttacatcttaaaaagaaatgtgttaaaatgtaatgtaacactcacacctgtgatcccagcactttgggaggctgaggctggtggatcacctgaggccgggagttcaagaccagcctgggcaacatggtgaaaccttgtctgtactaaaaatacaaaatattagccaggcttgatggggcgagcctgtagccccagttacttggaggctgagacaggagaatcacttgaaccggggaggtggaggttgcagtgagtgccagcctgggcgacagagcaaggctcttgtctcaaaaaaaaaaaaaaaaaacaaaaaaactgttgctggtaacgccactgtctcacacagttttagcaaagaactttgacgagcatggataagaaaagaagattttacttcaaattttatatatatatatatatatatatatatatattcatttaaagaagtctaagatcctctcaaagcttgatttagcttatttgtcacacctatcctctctctctcacacacacacacacacacacacacatacacagagttttggtgagagagagagtgggttttgggagggtaaaaatggctccctgcctctagtgcatctctagtgcttattctgcctgtactgaagggtttcttctaagaaatgatttgtagtaaaatgctggatatgatagctagacatgatgtaggagtagctggtgtaacactcatgacatatgatgtgtgttagcttaatctgctgcttgtgaagcatgataaaggtgcctagaaattcagtgattatctaaaatttttagatgaggttggacaaatgaagtgtttgtcttggtttgttatacttggttatgtatttccatgttctgataaaatttcataagtgttaacatgacatttatatataggtagtacttattaatcatttaggaatacaccatgtcagatcttgaattcatgaaaaatagagaaccccagcctagctttcaccacttccttaccttcttatagaggccctgcataatttcctcaagacctggaattttattctgtaacttgcttgcacatattatttttctcattcactcttcacaataatccattaatttttccagctaaaataaaggacacgaagtgttggaattacgttattcaactgaaaatgtcctatagcatagcacatgtctaaatacaaagcacacccataaactactggcagaataagtaagtaaacaaatgaatgaggcatacaggaaatcaaaaaagttcaaagaggttgagcaatttatgaagtctcttaataagtaactagcaagtctatgaaaaagtggcaaaggtttggacagtgtgaatacttgagcgcacaaggtaagttaaaggcccctacctgctcaaatttcaaatttgttttttttaatgtttcaactgatatcataattatgatatactcacagagtgttatgtgtttgttggagtatggacaccaattgtagaaacattgtgagactttaaagggaaaatttgatgctgattttggataaagcttgacgtaagacttaccaagtatgagttagcttgtatatgttgctgggaataacagaatataaaatttatttccaaaatatgtatatcctaatattgtagagttctagggcaatacatgttaatatttaattttcatatacagattccgagtgtgattcgcttattactttgctgcaagatggtttagataaatggaggaggcagaagccaagccttagtgacttaaggagagaaagtgtttatatagcaagggtagattcataaagataggaaaactgatgtatggttaaggtgggcaatttgagggaaagtttttggtttaagatggaagagccttgaacatgctcctgcctggaatatagggccagttgagaggaagaagtggataaaatgagctaggcaaaggatgattggtatagaaaggtcaagggtacttaggaaaggatggtttctattctggagcaaaaattgaggaattatacatgtatgaaagttggaagaaaggggagactcatctttatttaagttttttatttaaaaaaattgtgagtacatggtaggtatgtatatttatgtggcacatgagatgttttgatacaggcatgcaatgtgaaataagaccaagaaaagagtaagaatcataagaaaagttggtcaaacactttaatatttatgattacgtcagcagcagaagtggtaggtgtgaactggaggagagttaatgggtaagggttgactgggaattgtggcatcacattttatctatttctgggaagaaagaagcagtttggtaagaatgctcagaaagaggaagggacaaggaggctggaagataacacaaatgtttgaaataactggagaaaataaataataccattacatttatgtaaagaaagcaaaacccataaatttgtcaggcatcaatgaaggaccaacagttttggaaaaacacaaatttatagcgaatctatcagcaagacctttggtatctgtttctttcaggaaaacaatccaatctcatcatgatctgactcctgactaacctgcaaatgtatctgtattgcactgttggcattctatgacctagttatagtgaatttccttgcagttttccaaatgagctattttctcccctgcttcatattttgcacatgttgttccctgtgtttgaaattttctttttaacatgtttcacctggttaatttctatacgtaaagatgctgctccagcaatgtcttatccaaaaagtattgtcagtaggtttgccaagtaaaatacagaatgcccagtaaaatttgagtatttggggcatactcatactaaaaaattattcactgtttatctgaaacgctaattgaatgaactatatttgtatttgctaaacctgacatccctaattgtcagccccagatggactaggttagttgtttgtcatgttttgtcatagcacccactatggtagcctatatcacattgcctactacttcgtaccttcactggctgtctctaaagttagaatgtgaagcttctatagaccaggaaccacatcttggagaacacttcacctagacaatgcctggctcatcatagattgactcgttataagctgaccatgctaaatactttggtgcctttactggagaaactgaagctggttgcctaaggatctggctaacgagaagctaaggttcagtttgaccacagctttaatcatggtggaaacagagagcactttattgtcatgaattagagtgtgggagatgcatggaatttctgaagaatcaccaatccactccagccatggttcttgtgtacttttcaagcttcttattaacagaaaaacacttttattctggaattgatttaaatacatttttattttattgttaaattgcttcagggattccccactattggtcccagaataaaagttaaatgctagccatgagtttcaaggctcttaaccccaagttatcttttcaggcacaatgtttatagttgtcctacatgccctagcttcccaacacagaaaactattaattctccccaaaatgcaacaaaactttgcatttctgcaatttcttgctatacctctggcatcttcgcttagaaatcctactccaaatgtaactcagattaaatattttgccttctctgaagcctgtgtccaacacccaactcttctgaactccaagttaacgattccctgctcaggaatttcttgaggccttacctgtctgagagtcaggtacattgagtacatgccagactttcatatttcgggacaagatttgtggcaggcattcagcaactgttttattcagtgaattgtaaaatcaaggctttaaggcaaaagcctttcataacacaaactgcagtgcccttcaggtgagctttgaagatgtgtgtttcctcagtttcttgacacaattgtggtcaaaacacctagtataaaatataaactaaatataaataccaaaacatgaagaataggaatggctggaggaacagcagtggctgtgaaattatttatcatatagttaaatagttatctatgctttctccaatattctctaacttactacatctttctcagtaggactgcaacctttgaagtttctgaattgcttccacttttccaagtactatagccagtttgcaagattgttttttatgaactctggcagctctttagagcatttcaatatattttatgaaaatacgaaaatgccgtatatcttttaaagcaatattatatggaattcaatgaaagcacaactgactggtgttatttttatataacaacagaatataaacagtccctgctgtttgatataaattattgagatatggagaaattaagtattttcatcagtttttcctcaatgccaatattattagtcttttaacaagtacttattgagctactaaatgcctttcagtgtctaagttccccattcttctgaagtttatattttagcagaggcacacagaaataagcataatcaaaagtaaattacataatttcatgaaatcaatttttaattttatgtaaaaaattaaaagaagcataagagaattataagtgtagggacaggtcgttggggtagtgttgggagaaggtagtttgcaataataaaccaggtggtcaaggaagacctcaatgagaatgtaaaatttgagccaagacttgaacaaggaataagggcagatgttagtattaggttgcatatgtattcatccaaatttaaatgattcacatttaatacacgttgtatactctctagtcaagattactatattcacagtgtagttcaacttctcataagtatgaaaatccattgtgttttatcatttaaaaagaggagatatcaaatcaatatttttagatcgaaacccttctgtttcttctctgtcgctcagcaaatgagatctggctacacatttacttaattcagactttcaagatttttgaaagaagtaacttgactaagttttactaaattttcttcaaaccttgttgtgtgtaacatactacttcataatactgttcttgcattattttgaaaatgcaaaatattaaagccatagacattggaacatgaacttacattattttgtataatttctcaattggaaaaaaatcagaaaatgccctcatatgtgcacatatgtctttgaaaagtcaccctatgacagtggattttcatgtttgtgaagtgcacacaggggcaaaactctgacagtatatgccttttaattttgaaatggcctagatatattaaaaatagtgattgggccaccatgcattgctctaaccaacagaatacatagagctgactgcacaatttccatcatcctactaaccttttaaatgtacaatgccgctctcaaaaatatactttatattgaacaagaaatatttttaggaaaacttttattcttcctatatagttaccaaatgaagagtacagcaaaatttatgtgctcatcattttcaaattcttaaatatctgtctgatattatgaacaagattttcagtttaagtatattaatcaaaaacatttttcagcaatgaaaattactattgaatagactgtgattaatgacctaaagttgttaaaatactgacatttctgtttcagattgttttggcattaggtacagaggactgttcaaagttttgctgtatcctttacaattatactgcttaaggaagtaagaaacaattactgctaaagaggatgtaaaacatctgacgacttacaggaaacaccaatggaaacatagaagagacacttgtgaaaattaggcagtagagactgtatttaggacaactgtgataattgtgaacatctaatttaccacctaacatagatggtttggtttggtcagttactattattgacttcatatttgaagatttatatgaattatcttctgattataaaagttcatgaatatttaattgcatacatagacttaggtgtattcccttacaatatcttttcttgtgatattatacttgtacaatattcctaaaatatttaacaaattatactttaaagattttgatgagctatgaagatagtttttcatcatttgtttgttagtacattgttatattttaaagtagctttgctattaattctattgcatgactttaaaatttattttgaaacttctttaaaaatcatcattaatagaacgtgatggccacatgaaggatgaagatgtagccagtgcaacaaaaattgatgatgtatgtttctgaatacaccccatgagagtatatttaatatcatgtgcaatagttactctttatatgtttagtaggagaatagtagttctttatccatgtcatgttgggtaaaaaacaaggtttttgtaatagaatgaatttaaaatctagctctatttcttccagtatggtacaatttgacaagttacctaatttccacaacctttgaggctttgacagtggatataaatataagcacttaccaattaatcaatagctatgattcctcctatcgcaaaatcttgtatgggagactagtcagacattctggatgacataaacacctttctcccagtcttgatatggctttcaacaagaagaatgtcttacatgccaaatagagaaaatattttgtgaagcctagaacatgatctccaaagtcagactgcatggatgtgaaccttacatgcatcacttagtatgtgaggtcctgagcaatttactcaaattctgtaagcctcattttctaacttgtgaattaatatactgatagtgcataactcaaatacaatggtaaacactcatatggtagctacttgtattattgtcacttagcttggcctaactatggggcctaactaatctccatgtaggaggataatttcctgaacctacttctgaaaacatgtagttatcattgctgataccatctgttgatgcttctttagtgaccttcaccccctgcacaccacatgagaatataacatcatgccttaacaatacttggttttgaacccttggatcttttctactatgcaaggctaagaacgatcgtactatcttttgacaactttcctcttttctaatcctgagttgtattttttttacaagtagtgaatatattaactctttgattctttggaaaaaaagaaacatatcacttttatgaaagtataaattataagccatgagtatttcccttctgcgtaagtgttgggaattcataaaatagaaattatgtgtaattatgcagatgagatgaaaaaactgttttgttttattgtttagtcataatttttaataagaggaaaatttaagtttgcttccattttttgtactttcacattttgggggtaatttctaaaaaatttttatgtacctgaaagagtggagacattcagaagaatgaggagatggagaggaaaggaacatggtttacatgcaaagtttaacagtgttgatagtcatatgccttagtaggaagaactaaaatgaggcatgtgtggaagatatttacaaggcatcaagtcgtcacttatttgaaataaactaattcttttagcgcctacattataatacaaaccaatcaattgcttttggatattctcctagaacagtttttccgcccccattagcaaatgtaataagtgataacataaggaagctgagcagaaaattaccacatctgactgaaatctatcaggaaattagggcatatgtatggataatgagtttatccaaatttagttttggccacagctcaaaaggccaggcttacagttgccaaattaccacctgtgccctatatatcacaggtgttccggccttcagagctgcttttctttctaaagatttctgtgccaagcatgcttccacccaccccatgaatgtgagctcatgcacaaaatcagtactcagttctggaccaaacactgacattcacattgactttgaacactttctgatgtcttttttaaaattaataacttaataaaagtataagcactgtgtcaattaggattaggtttagctactgttgttagagacctaagataacatctagagtccaggggttatgtggaatgtccgaggtcatcaggagcagaataaacttacttattctcagctccactagtcttagactgtggaggcatcaagtttattatactcacaagataactgccgatgacctcactgtcacattctcattttaaaaggaagagagggggagggcaaggggaccccctctttgagtcatgtctgcaccaaagggcttccctggaagtccaatgaagtaattctgtttatatttagacggatttttttttttaagatggcgtcttgctctgttgcccaggctggagtgcagtggcacaatcttggcttactgcaagctccacctcccgggttcacaccattctgctgccccagcctccaagtagctgggactacaggcacctatcaccacgcctggctaatttttttgtattttttttagtagaagcaggtttcaccgtgttagccaggatggtctcaatctcctgaccttgtgatctgcccgcctcagcctcccaaagtgatgggattacaggcatgagccactgagcctggccaagtttttagagtctttattttgcagaaaaatgtaatggggatttgtttaaaatacagctttcactaccctaagcagaaagaacaaagccagaggcatcacactacccaatttcaaactatattttaaagccacaataaccaaatgagtttgatattggtacaaaaacaggcacatagaccaacagaacagaatcgaaaacttggaaataaagttgcacacctacaaacgtctgattttcaacaaggccaacaaaaataagcaatgagaaaagactccccattcagtatatagtgctaggataactggctagccatatgcagaaaattgaagctggactcctacctttcatcatatacagaaattaactcaaaatggattaaagatttaaatataagacttcacactacaaaaatcatggcagaaaacctaggaagtactcttctcaacatcagcttggcaaataatctttggctaagcccccaaaacaactgcagcaaaagcaaaaataaacaagtgggacctaattaaactaaagagcttctgaacaacaaaagaagccgtcaacaaagtaaacagacaaccttcagaatgggagaacatattcgaaactatgcatccgacaaagccttaatatccagaatctacagggaacttaaacaaatcaacaagcaaaaatcaaataaccccattttaaaaatgggcaaactacatgaacttctcaaaagaagatgtacaagtcgccaacacacatgaaaaaaaattcaacatcactaatcatgagagaaatgcaagtcaagaccacaatgaataccactcagaatactgtgtgagatatcacaccagtcagaatggctattattagaaagtcagaaaacaaaagatgctggcaaagctatggaaaaagggtagcgcttatacattattggtgggaatgtaaattagtccagccactgtggaaagcaatctgcagattcctcaaagaccttaaaacagagctaccattcaactcagctatcccaccgctgggtatataccccaaagaaaataaattattgtaccaaaaagacagatgcactcgtatgttcattgctgtgctatttacaatagcaaagacatggaatcaacccttatgcacatcaatgttagactgaataaggaaaatgtggtacatatacaccatagaatactatattgccatttaaaagaaatgaaatcatatgttttgcagcaacatagttggggctggaggctataattctaagcaaattaacacaggaatggaaaaacaaatactacatgttctcacttacaagtgggagctaaatattgagcacacatgaacataaatgtgcaaacaataggccctgtggactagagggtagagggaggaagaggggcgggttgaaaactacctataggtattgtgctcactacctgggtgacgggattcatattccaagccttagcaccatgaaatattccaatgtaacaaacctgcacatgtaccccctgtatctaaaacaaaagttgaaatttaaaaaaacaatacagctttcagaaattctggttccacggggctgggagaggctcagaaatcgttttggaggtgtctcaactatattacatttattgatagtcccccagatgtcttgctgtggaaagtctttttgctatttttctttctttcattttttgttctaaactgtgacaactccaggatgttaaggggatcaatctcttgaaaggggagggaagcatacatagtgttggaagctacactttacgtgaggttgagaatatacctctagtccacatgaaagaattggacaggtggatattgtgagttgagggcatgaagcccctttccctgccactgttggtgctgccactgtttgtgaacctgcctaccttctaattcctgacattgaagcacacagaagatcagcaaatttctgaaatcctttaaactcacacccagcctttgtcttctttctggtttaatcgtttccaggttttttataatagtggagtcagagtttaatttatcagataactggtaacaagaccaaaaggaaacagattggcaattgaaaggaaaatgaaaacaagcctcaccaagatcatttactgaacacctatcacatacccaactacatttgtttttgtttgttttttttgtttgtttttcttttaggatttcagtttatcctcaatacaaccctctgaaatagatattttgtcatccccattttataaatgaggaaaacagagactgagagtaaacctctcaaaattacagttggtagtagacaaaggtaaattcatacctggatctgacttcaaagctatgttcctttgactctgccataagtggcatcatggaaaagaaaaagattacaaaagggaaagggaataggtgcatgtggtatggagcgagagaggaaagccagtctgtcccagacacataccaccaaaaaagtcttcatctcactattcactctagatcatctgtcaacataccagattatttcctttcattgtagcttcagctgctatgtcagagtacacgttcctttccattcatcagtcctccagtcactagtctaaccacaactttcagtcacaactgaaatcagttctcatttctttccaaactatgtcagcttctcaccagtcctttttaggtttgatcctatcttcttaattcattctgcatccattgccttcttagtttccatcgcccaaatcatgaaaaaatgcaaaggagccatatataatgagattcatatctagtttgaaaccaagattagaagaatcagtgagatccaggttctttaaatctctgtttcctgacaggaagaaaacgtggtatatacatccttgttggtgttcatgagagatatcagcagccattgatgccaaattctcttctgccagtgcatggctttaattattcttctgtaggtctcttaataagtcaatgccagaatgtgttttgctttcctatttacagaatctctcttcacctttttaaaatgtaggcttcatgtagcttttactgaactgttagtccctagtaaggcagtatagcaatggtgattctgttctattctctgccatgaaacaaacattatttaaactctaagccttacattctagcattcgaataatggaactactaggttagggctttctgaatgtgtagaattataattttcaaaattcatatgacatagtgtttgaaagatgctagttatattacaagaactatttacacactttctaattgtattaggatcctaccaaatgaggtatttaatccagtatttataatattgatgatctctcttaattgttttcctttgtaggtttcttacagtctactgactctggaaaaatgatcagggactaaagtagaaaacatgttgttaataacattgaatagaatcagactcaagtttaaaaacatatttattgtcccgggacatttattcttgaccttcctagttattttaatttccatttcagtcattgttcatgagttaagatatgatctctgtcctcccttctcatttgagtgtctcaatctcagaacaagccattagctctgatatgcccaccctttcttttttgaaggctgacagccttttatataaatgccatctcttccagctgacattcaaatgctcaaacttaatgagttttcagtggatatgttgctctatctacttattgcaattgttatttaaaaaatatgtattaaaagctagagttatgtcaagttattaaaacttagagaaacatataaaatacttaattaaaacaataacacaaaccagcttatgaaaactacagaatggaagcatggggtgtcaggagagaaaccactgataacttttgtattagaattagcttcatggaaaaggttgctagatgtagaagaatgagcaggtttataataaatgcaatttggtgatgtggactttcactaaaaaaaatgtggaaatgtataaaccatgggtaggtatatttgagtatatgcaaataactctgtcataagcaaggagtacgttgaagagcttatttcagcacatcgagcatggcagtatgagcccctcataggctagaatgatttacttaattccagagaaaatggtaagtcattagaagtttttgtgtaagagattatttgatcagagatttttatggaaagcttaatctgtttttgattctgtcattgatttccagaatatattaggagaagaaatggtatgtgaaatgattagttaaaaatataagacaactataaagaggagaacttttgctttttattctataattttggacatgatatacgtgtatgtaactgcctacaggatatttccaatgggttaagctgtgacccacttagagtgtccaaaactgaaatcctgttcttcttcctcttaaaatggctttgtatttcctatattgagtgttgaatgcttccacctacctaaataccacaattagaaacctaggagccactgtgcctctttccttctctttgtcttctgcatccagttcatcatcaagtattgtcagttctgtttcttcaattgccttttatttcttctgccacagcatcagcttatcattatctgaagcttgaactattccaacaacaatttggagtcagttccatcttagctatgttttctcctttacaattaattattcaatgtagttaaagggatggtattcctaaaattaaaacttagccatttcattccctattcaaaacccatgagataatattgttactttcctaaataaggcttctaaagtcattcatagttcaagcttccaatataatctttaattgcagcccattctctttaccctgattccccttcctttccacactcgttttcagatgctatactgaatttctttaggagtcactcacacaccaggacatctcactgccagactcttcacgagctcatttctcttcttcaactcattcttttttttttttttttaaaacagtctcgctctgtagcccaggctggagtgcagtggcatgatctctgttcactgcaacctctgcctcctgggtccaggttcaagagattctccagtctcagcctcctgtgtagctgggattataggaacgtgccaccttgcccagctaatttttgtatttttaggagacacgggtttaaccatgttggccaggctggtcttgaacttctgacctcatgatctgcccgcctcggcctcccaaagtgttgggattacaggcttgagccaccacgccctgccttcttcagcttattctttattacttttacttattcctcattgttcttagctaacttttactcactagtaaggttttcgtattgctgcacaaaatctacacagacacaccacacacattatatttctctggcttcagttttaaggaagcttcttctactctgttctggccacactggttgcctagcatttttgaatatgccagacatgcatcactttaggacccttacattcattggttgatctctctcactgtgattcttttctttcagaattagtacggataactatcaccttatccaacctttttaaaaatgaggcctacctgtgctgatgtactgataatcccattttgtattgcaggtgctcaaacccttgttcctcttcggacaagccatctgtgttaactgatctgacattgctcagctttgacattgttgtggtcataaagtttagcatctgctaacattctacataattaatatatttattttgtttactgtctattgtctatgccccttttcccaatagaatgtaaacttcttcatttttacaatagtagaaatctctgtttttttcactgatttaccctgagcaccctatgtacattatttggccacagttctgagtattttcacaaagctggcttttactttttaatttgctatttcaaagtatatgaattttttttttgacagagtgtctcattgtcacccaggctggagtgcagtggcacaatctctgctcactgcaacctccacctcccaagttcaagcaattcttctgcctcagcttcctgagtagctgggattataggtgcctcaaagtatatggattattttggaaatactgatgtattattgtcattttatataatttatgttttaaccaatagtgaatgagtgtctttttttctgcgttctcaacagaataatatattccaagttaaccactatgcttgtagaaaaatggtatctcattaaaaaccattcattttaaagcttgttttaaaattttgttttatgcagaggttgaataccatttatacttttattggcttattttttctttagtgagacatgttatgccctttacattattttctatttgggtgttagtgttttccttatatatttgcaatacatttttgcacattacttatgttatttaacttaaaatatgtttgactaaaatgttattgttgtttttcaaagaatttatcttatgcttccttttctaaattcttctttgaataatttatcttcttccctcatttatttattgtctatgttatctttacaaacacatattaccaggtttccggacctgctcaccaataaaactatgagctatttttttccctgacctttattctctcctattttgaagaaaacctgcctttgactttaaaagtgctcatactggcttttatctattatttctcaacgcacatttttaggtactttagtttgtgatatttcttctgtagaaaaactttagatcaccattctgaatgattatattgtcttcctcaatatttacttactgaacaatgtgttagtctcttaaacttgagcaatgttgttaagataatcatagtctacccttcacctctattttttttttggttgaatcccagaccttcttgataaagtgatgaaacatggaagttttctgtttctggaacaaatactttagttagtttgagaaatcatggtataatacaaagtgttgtcagtgacacagtgctgatttatactaggtgttaggattttgaaattatgtcctgatgtaattgtaacaactcatctacgtatgccttggggtgatataaatgtatcttgggaataatatggagcacaatttgctagatttattttattgcagatttatttaaattattatttttaattccacaattatttattaatcctttacttagccttatccacatagcctgaaggtaactttatgcaatatattaattaattttgtgcatgaaacaaagtttgcattaagtactcgtgcagaatttttcacttgtggcatcatggcagtgctcaaaatgttttggattttggagcatttcagattttcatattagagatcctcagcctgtatataaagggcatatagtctaatgaagagggcagacaaataaacaggcaattatgccccagcatgataaatgctaaaataaaacaaaggaagctttgggaacatataaggaagggatttccaatacaatcccaaagcatgcagggaaggttttcaggaggaattaaaggccatgctgagacctaagtttttaaagaagctggataaaattatagtaaggtgaaaaaaaggtcaagaaatccaacagtaaattgatgcctcccttgtcttagttttcttgggctacttaaacaatatcatagactgggtggcttaaacaacagatagtgatttcttacagttctggaggctgtatcatggactgggtggcttaacaccatatcatagactggggtggcttaaacaatgcatagtgatttcttacagttctggaggctggaaagtccaagatatgagatgccagcagatgaagtatctggtgagggctctcttaccagtttgcagaggcttgcctgccttcttgctgcatcctcacacgacagagagagagagtgaaagagagagggttttaggattctaaaatcctcagaagagctttgtggcattgaccacatctatggaaaccttgagaatgcttttacctctctctaattgtaaaaatattgtcctatagctactctcacctatgattttaaaatatgctttgtaaaatattttcatttaaaatgtaatgctaaaagttctatcgtctatgttattctgtatatgcaactcagaaattggcctcttggatatatctgtgtcttttaggaaatgctgattctttttgaagagacttagaaaaagaggttgacagaaatgtaaatatagatgtagacgtattaaaacgtttttctgttgttagactcaaactaaaagtgcattttttctctctaaataaatgctaaacataatataaaatactatcttctcttaactctcatgctacataaacataccaaaagaaaaaaataataatgtggaggccagaatcaatgctgaatttagcagaaaacatgacagtgatttgtgagtttaaatgctgggtgaaagcccagataataatgatagtaaccttttggacgcctccatttagaacttgtcagaaatactgaattctattaagttaaatcatggcaattcaataggaatacattcagatctcattttttagagtcaattttggcacagtcaaagttttccattacagagttagcccattagctcaaattgataatggatctggaactccttaaaatacagagggttttatgttgtcagatccaatatcaatggagactaatatttttgaataattcaaaatagtctcaaaagctcaaaatagtctgtgtcataataaaaacaatacctccaatccatcaatattttaaaaattctgctagcatagcatgcatttagagcacagaaaccaagttcctccagtaacaacaattttatgattgtagaacatgtgacaataaccataaattaacactgctttcatatactcattatgtataatcaaaatttacttaatcactagtttattttatatactcataattcagttcactattacattattgataaacaatgaagaaacagatttcaattagtttctatgagaattgacagcaaaaataaatatctcaccaaaatcattcaggttttcaaaagatatacaggttattttaaactaggtgacactttgaattcaatctttttgtgctgtttattttaaataaaaatgaattaatgttaacaggttatagattttattcattcattttccctttctttccgcattcaaaatgtgtcccttttattctcgttctaaataacatgtgctaaaagtccttgagataccaagacattaaggtatgatccttcccatccacaagtttatattttactgatgataatgattgtataacccatagttggaggagtgaattatacctttttcaagtaaaattaccaaaagaaaataaatatgtaggctaaaaaactgagaagtagatgaagcttggcaagaaagcagtgactacatcatgaagagtcttatatgttaaactgaagagcttgccctttgtcttaaatttaatgaaatattgttgatttttaaccaggatggtggcatcatcatacttatgttttagaaagaaatctccaattgcaggataagtgagggaaaatctagatagatgaaaataatttaggaggttttgaaaaaactcaagtgagagatgataattgtccaaagtagggaatttacagtttaaaaatttttacagagagagatttatagaacttagtcaccaattaaatgtggatgtcaagggaactgagtaagtctagcattatcctcatgataagctacttgcaggatcaatgtgtattatactatgtagaggatgaaatagggaagtagagtgtgagagagattaatataattttggacatcttcagattgacttgattgtgggttttagaattaagaaattttgcttcattaaaggtcaaggttatggagtgccttgattataagtaaaaatggaaagctatggatgtggaagatttccctcaactaaaatgtgtagggtggaactagagagatctgagagtgaacattttgaggatactcaatatgaatgacaaacaaaatggaattaaatcagaagcaagaaagaaacttgcatttcagaaaccaagaaagcagtatcaaagagtatattataaattaatgtgcctagaggtcaaccaaatgtggcttacaaatttttaattggatttagcaacagcagtatatgaaaattttatcgtggatgttttcagatgacagataggaaacgccaggttacaagatgtttaaaagttgaatgcatgataaaaagtgaagaagatgtaggtaacttttcagtgtttgagaagaaaattagacattagtaaagaggattgagaggaataccaggtcaacataattttctaatataggaaagatttaagcatgcttaaatgatggtgaggaaaaacagacatagagtcctaggaagaagacaggaggtaattaatgaagcaatgtcactgattatataggaagaaaaaaaaagaaaaaaaataggtgaggcatcacagagaaaaagagacataggtgaggcatcagagagaaaaagagacacatcatgcaccagtgtaagaagaaagggtaagtgtagatatttgtaaatgacaatgttttctcaataaaattgaaagttaagtgtattctcatgattgaggtaagcaggcttagtatgatagattttggaaaatctgggtaagttttttaactagctgcactggagaatatatgcatgctatctagaaatacgccaatatcactagacagtataggaaacatagttgatgttaaaaccatgaagtagttgtgcagttgtaaggttctctcgagatatatagaagcttatgtatagaacttagaaaatggacagtcagttaatattggaacaaaatattaccataagaatacaacagaggagaagagtattgaaaattttgataagatactggttgaaataatggatctttgtgtctgactggatatggaaaaaagtgatgatgagcaaggaaaagagagcaggagaaagtagaactctgtaaaggttaggcattttcaacaattaaaaaacagttcagagagagtaagacaatgacaactaaaagctagacacacaaaaaagatgtgaccagagaatgaaatttttgtaattaagagctcaaatgaggacagaccacaatgatgacaaagactacatggatattgtgatgtgatgaaggatgtaacaaaagatgacaggtattctggaatgaatgggtattcaaattacaaatgaaatgtgtatataaatttactttattacagacatgtgataagtattcttttcagattagaggccctattctatagtcacaaagagtatttggaaacaatatatagtcataccaaatgtttctgaactgggatctcccccctctcctttctccctccctccctcccccctttccttctttccttcttttctttctttcctccttccttccttccttccttccttctttcctttcctccctccctccatccctccctccctcccttcctccttcccttcctccctccatcttgtctttccccttttcctccgttcttttactttcttctaatttgtaaacgtgttaagtgcatgttttgtgaatacaattcttgacctctagggctcactatctagtaagaacacagacacataaacctgtaattatagcaatgcattaaacacttttacagagttaagggcaagcccctattggagtaagcgcttaattttctccttggagaggccaaaaaagtctttcctgaggaagcaacatttgagtatgaataaggtcatcagtcagaaaatggataggatggaaggtagtataccaggagagaatagcatgtaaacaaatgcagactctgatcaatcatgttaaagggtactatgacaagttttgtttgccttaagcttggaatacctacagaacaagggtgagagatgagaataaaatggtagtacagagaccacatcacaaaggacctttaatgccaggccaagaatatgggcttcgtaaagatttcttgaatgtctagtgaaagttcaagcaggaaatcacatgatcaggtttgaattgtaaaatgataattctggatgccaagtggaccatattttcaaggaaggaaagattgaatgtgaggtaaattaagtttttgaaaaaataatgatagacacaaatcaatttattaattaactcagtaacagcagtccaacataattttatgaattggagagggactgtcaaagtgatttcaaatttatcttggaatacaagtgtatgaagctcaaacatgcagttaatggatttgagttatataaatactttcaatgttatataagtccaattcaaatgattgaagaaaatacacattgtaagataaacgttcatggttcagcaggagggataagataacacatgtgggctttctgttgctcctgagtccaaaacaattaaagaatcaaagtgagtaaaggaatacatctataaaacaaaaggaaacaaatgcaaggaactcgttaagacagaacagacactaaactttttaagagttgaaagacaaggggaggaagaatacagactgacacaaggagataaaatcacattcggagatatgctacaactgagtctgcaaaagaaatgggggccaatctgtacagtggaatctttgagacatttggagttggagtcagaagttataatggagaatgtagttgagcaataggtcaggatattggaaggaattttaatttaaagtcagtcctatacctccatgaatcatcatccatttcttgcctcccaccccttgaacacacgcatagattttgggccatttttatttatcttaatgtaaagttctttatcttttcactaaagaaattaaacctatgtttggggaaagatatagttttgataaatgcttgaaggaatggagtcaagtctttaagtatctgggagaaaattattttcaatctagaattctatatccagacaaggtgttattaaacaggtaagacagaaagatattgtcaaacatgtacctactcttctaaccaatctcccacttaaataaaactataaactgagacagagtgaggaaattacatgataatgttaaagaaaacaacaattatgatagctctccagtaggtctagagaaaaatgagtgctgattaaagcaagtgagaggtctctagaaaagttaagggttcatgtgatttagtgaggatgtggaagatgttgtcataagccgtggtgaacccagtgcctaatattactttctgcacatagcaaatacttaataggtggtttcagtgatatgaaaaatcaaacttatacaaataaggcttattacttttaaggatgcttccacatagattagttacttcaataaactttcgacaattcagatagttaagtatttttggcacttaaggtgatctatcatgtatctatatgtactattattacctgaattggtggagcattatgatgccttccttctggaaggtgtccaactagtgaatctgaaatcatgccattttccagtagatcaagtcttactcaattgtttcttggggtgctagcaaatttgccaatgcttccttattttttaaggtttatgttcttttttaggggggttgcactaatatgtttttatattttaataagttcaatcaaatggaagaatgcatggtttgttcacaaagaattgtagtgcaatattattggtttaataccaaaatcatgtacttagtgatttcttttggaaggtatatgccaagacagcaaaccaacacctctgtttcttccagagcatctctgacacaaacccactcaaataaattaatattccgcacttgactggcttacctggccagaataacaagatgctgtgccaatgcatgatgtaactgtgatgaccaatgcataaaaaattatgaataagctttgctttcatcttaacagttttttcagaagcctgtttttctttctgttatctcccctatagagttcacctatcaaatggtgcaataagcgagttggcatatgcctttttagacttaaaatggtgacaggaggctgggatgttaaagacattgtgcagtttgccccaatgtaaggctcactctcacttcttttagtggaaaaaccaaagcagagttaatagaatattgctaatttgtctattagttttctttttcaccatctttctctacattcacacaaacacacacacacacacacacacactcctttataattaggatttttaattattctttttaatgtgtaagaactacacaatgaaaagaacactgcctttttaatttaaaaattggtattttattttgaattctcaggataaattttagaaaaaaacttcagaaaataatagtgatatttaatcaaatcaatatattagtgctgacttacatctggaaattaagtgtgtatagtaaacatcaaataatcttcagacaaacatcattaaaatgaggttcaaagatccatcataagatatgtggttttcgcctcatttaaatatgtcagtggttgcacaatttgtaaatatcgtctacatttgcagccatttgaaatttttaatagaggaatagacaatgatcttaaattgtttaattttagtctgttttttagagtattaatccattgaaatttcttcttagtagggtcatttccaatattcattcataattagattttcccatcacttaagctgctttttaaaataaattaagcatatgaggttatgcttgctctttcgtttttcctgggcatggtacaattaataaatgttctgacctgtcacatggtcatcatgaaagttgaaaagatgtatttcttttcctaaggaacttaagaattataaagatttgggtagattcagttaaaaaataacctatcatattaaaataggtgatattttaaatatgactctataatattaaaatataactataccaaaatgtcacctatcaaaacatttttgttttttgacctattccaagttgtcagctggtattgacttgaaatttgaagaaaaatgaataaaattaatagaaacagttcagctcagttagatatttattagtactgacccctttatacaaattgatttgttagttgaataacttctataggaggaaaaacatttgttgagcacgagctctgtgccaccaggcattgtgcttgacagatttcaaagtttgtacttttacagtttacattatacctatttcctgtcattgtttcctaccaaaaatgttcaaaggattcatatcttaagtttcccatttgttgatatttctcttagtaatacattatctctgattattctcagactgttaaagctaaataacaagtttccataaaaaacacacttttcataaatgttttagatagatgaaattaaaattctatgcaaaaaatatgtatgcatagaaatggatggtatatcacatagcagcaaataaaatgaaacatatatagaaattctgagtaatagccaaggtaaaatatagttgaaaaggtagttaagaaacataacaggtttctaaaaaataactgaaatgtctaaaattgctttctttttattttatgcaaacatgtatatgtttattaaaggaacacctggattaaaataacatatacacctatactttattttacaactcatgattgataaagaatacattctgttctataactacttatatgagcatatcgttgttatgaaaagtactattttcttcactgcagtcatgtaatgagacatatatttctctaatgtttcaaaggtatcatcatatctgtgccacttcaaaaagatttctcagaagaaagacttcttaagttttgatacaccatttgggaaataaagtcagcctgaagtatcttcacattttcctcatatatgggttggtttgagaatcagaggcccagagtagctatgaaacatctgtccttctggaaatcaaattttgctttgtgcctcctggaaatgtgtacatatagccatgagaagaaatttgttttaccctgtaaggcaggccagctctctctgtgtctcaaagttccgatgagttgtgtttgagaagctaaacagagaagactaaaaagagggaaaaaaagaattaggaaaatacctaggaagtgaagattctttttcaattaaaatgttttttaggaattgagagattttattgtttttaaatctttgggggttaatctagcccccaaagttgagggaattcaactataagagtattccttttgaaaatataaaactttaagctgaaactgaagaagatagtcatgggctttggggaagtagaaagagagaatgggttgttgttaggaatagggaaatggatagaccattgctgagggcctcaactaaggttgctatcctttaaaaaaaattaagtagtacaagctacacagtttgctctccagtaatcttccaaagtttaggtatacaaggtggctgttttgattaatcagaagttgacatttttttttcagagaaaatgcagtggaaaaggacagagcccttaataaatggagatgtgtggcacgtggacattgggaggttgtttgatgccagaaatgagcaaaattatgggtagtgtaggcaaatagaatgaacattaagaaaataattttttatatagctggacaaataacgtgtgacgttgtcagagggcagtgaggaaataagggcactcacatcagaacctaagacattggggtttgaaagaagtgaacaaactttgagaaagctaccagagaagttgcgtctttggggaggggaaggtggtggggagagtcttaagtctcaggaaaagcagagaagtagagaaagcatttcgtgaggtggctgagggtatttgataattaattgattatgtaggaggaattttggaaggaatagtggaaagaagaatccaggtaaaaagcactcaagagcatgagtatgggacaatacttggaggaggctgaagagtggattattgcttttggactatggacagaagatgatagttttgaaatgttcagatggttgaccttctgaatgttaaggtattctcagtccaaataaaatcctagttaaaaaggggactgataagattcatccaatgactgcagtcattggtcagtgttaaaagagattactatgaagagtgttattctctcatatgaagtaaaaccttctacactttgtacctaaagcatggaaagatgacctgaatgactttcagggcaagaatcacagaggtataatagggcttttaaaatatttattttaccattgattaggactattacatattgagccctgaatatatgttaacagtacaactgaatctgagtagctgtttttttaattttgtgtcaggatggtatgtatacactccatctaaaaaatataacaaatcgtgcaggtgccgaaatataaagagaaacagaagaatctaaccttgttttacaccttttaaaatagaatgttctctgtcaagacaggcatttttggcccattttcttaatcttattttgatacttacgaaggtgtattaagaagtcttgaatcaatattgagatcacacaaactagctcagaaattatcccagtatgtaaagtcaacgactaaaagcagtttaatgcacaatataaagagtcttcaattatttttgatagttttttggttaaggaagacaaaatagaacaaataattaagcatagattaaggtcattcgttttatatacaagctattagattgaaagaccgatgaatccagttcatcaggaaagaatatggaagcattttaaaagaattaagccaatttatggatatctgttgtatagtgcagtttagaaagaccttttaaaaacaagatgaaataaacattgctcctgggaaaatatcacaaaaaatcacatttatgatgaacgattcgcaaatattaaggtagaatttgggattctgacttaaaatatcctagagcatttttcagttttagaaagttaattatttatcctgtctggagttattggactccaactaaataaaattctaaacctataatataaaaaaagttcaatgagaatttgtgaccagatctttcttcttattaaggtcacatgaacagcacaatgtcctgagctggacaaatgtaaagcaccgtgtctcctaaagacattgtttgtagtctagatatggtgaaaataagattaaagagttgtttaaaaacttttttttttcacatcaaagtctcactttgtcactcaggctgaagtgcagtggcatgatctcgactcactgcaacctccacctcccaggttcaagtgattctcctgcctcagcctcctgagtagctgggactacaggtgcccaccgccacgcccgggtaatttttgcatttttagtagagacaagggttcaccacattggccaggctggtctcgaactcctgaccttgtgatccacccacctcggcctcccacagtgctaggattacaggtgtgagcccccgcacctggctgaaaaacttactttaattacatttttttcagttgactcctgtaaataccacttgaaagtaacttaaaagtgtattgctagtcggggaagagagcctttctttctgttaccccaaccctgagccctcttaccctgttaccctaacctgaggttaggtttcaagtcaggttacttagaagatggaaaataatagtgaagtttttgatttttttgtttgttttaattcccttgtttaagatacagaagcaaagtggtacaccataaaaggttatttatgttattattattaaaccccttcaactctctcattcattcatttagtaacaatttactgagggtcattcatggtgccattttacatgaagtcaagttttcatgcaatagcaccaagacaattgatttatatggaaatttattacttaagaatgtccaccttatagatgaagaaaaactaaaaatattgatcaatagtgttagccacttgattagtaaggtgaataaagtcacacttagatttatcctacaagctgcccttattaataataagttgtggctgtgcataaattagatcagatgcttccttctttggttaacctgactatctacagatgtgtgagctccgtaaggaagtagccttctcattccaaatctttcttgagtaaagttttaacagggctattaatctcagtattcagatcgtatgtaatgattatgcctgccagagtatcttagttataagggttcaaaagacaatcagatcgggccgagataatgcacacattcacgtattcatcacaagtaatattatatactttacatatgctcttttatcagttagataaataaagatgaagatatatgggtttgactagttgaaatttgcctctgctattaaccagtgtaaaaatacccaacttgcttgtaccttctccaaagttaaattttgggatagctccaaaagtgatgtcaattttgaacacataatattaatgtccataagggagactgtttataaaattaattatgtgagttcttactgagtactctaaagatagtagagttactgtatgaagccagcactagcactacctaacattatggaattgggaatgactatttggtagcagataggcttgaatctaggcataatcttataatagttcatgaaaatgcatagtagcaaaacaaaaagtgtttctaaagtgttatcattgatgttatatccccattaacttcctctatgaaattagtggtcctgtctctctagagaacattttagagataatagggttttcttaaaggaattgaataacttagcatattattttatctttatctcttgagagcccatgaaaagaatctaatttcccaaaaggaagtagaaaatgcaagaaaaacccagtcagatctaccaagaatcgatgctagttctctagaccattccatactccactctaaagcctgataattgaatgatggccactgcctgtatacttataatttgtagattttgtaatattttcagatagttattagttgcctcaaataattgggctgaaatgtgataagcttcctggtttttccagaagtttatattctgcaatttaacactatttcccaacaaaacgcagtctttatccacaagacatcttaaatgattttctcaggaaatattaagatataaatgtaaattctgttactaaacaacaacaaaaaaactaagttcatgatgactttttccgactttatcagtagaaagcttttttattatgttgtattatataacttttaatgagaaattattgatgaaattgttagtagagtttctatttatgtattcagtgaccaagaaatatcagagggaataatatcaaaaggatgtttctgtaggttttccaaatttaaaaccaaaataaaaagtagcttacagaaaagtaaaattcttaatgctatataataagttgtgtgtatagctgtctgaatatcaaaatatgtggtctgttgcccttaaaattagaactgccaactttcttttaaaaagaattcagaacagtgtgtatattcccacgaaaaaaatctttttgctcactataattactatgtcaaaaagattgtttaaagaaagaattaatgctcatagaaatatatcaaactgaaaaacatttaattaaagacagattttggttattttataaaagcaaaatcacagatgccctgtcattttacctctgagtacttcagtgtgtgtattttaagaattatagatattttcctacaaagatatcatttctaaaaccaaatgtattttttttggttttctttacattttttggataatttttcaatacaagtttaccttgttacttcaaaaacacaccattcttttggtgaattatacaaaaagtgattctaaatatctgaagttattgtgtttataagtacttactcaaatttaattgtatttattaatgcagtaattccttaacaattataacaaaacttagttctacaatgtaggtctgctcccaagtgggttttgctattctagactaggtaaaatataagtagaaactatattagcagccagttagagagtacaataaactgctaaagaaaggactcacattctgaatctatttcttgtaaattctagaaaaatgagtagttacagatgtaaagatgggtatttgtttccatttataaaattttgatggattatgttgatttgtcataatgtttgtgttttctgaaataatctaacctaccatactgaatttcatcaaaatacaaacaataaggagtaactgaaaagtaaagcctgtaccataaaaatacaaaaagtttatggaaatagttatgatttttaaaagtgttgcacaattgtttttaaaccaaatccaggtagcctttatctcaaaggcttctatttatgttcagtatccacaattaaatatctccactcacatagctataaatttaactgtaatttattatcaatattacttcatattttgcagctgaactcctttggcatatggttttcagtccttgggtattttctttgtctttcaacaaatctattaatataacaagagatgagaagcagagtagaagctacccatcatttgtaaattttgctaccttgttttaaagtagctttgctaaaatatgcaaaagaacaataaataaaaacttctggcaacatcgatgttctttaatacatacatttatatattcatgctatctctgttgctcatgagacatagttggctttaatattcataaagtggagtgtcaaccttattgtaaaaataaagaaatgtaatctgtttctatttctgcaagttattcccatatttttattaaatcaatgcttacgctacacaacatcaatgcctactatcagtagtatgcttgatttttctaaaaaattgattataagaattgattttatattttggtcaacagatattccacatgacatatgatctcgccagtgcagtggtgagaatttttaatctcatcggcatgatgctgctcctgtgccactgggatggttgtcttcagttcttagtaccactactgcaggacttcccaccagattgctgggtgtctttaaatgaaatggttgtaagtaaattctgttattttacactctgacttttcaacgttgtgccaaaaccttttaagtaattatgttacaatgatctgatttcttctctataaatgtttacagacaacttgattttgcttctatgaatataaaatcagatgttatgtttgtggagggtggttacaactaaattttactaattgactatgttcctgagtatgtatatgttacaacatctacttttatatattttattctgtgtatactgaggcatatcttatttcaaagatacaatcataaaatattaccacagtacagcattctttcaaaaatgcctgtggcttagaataacgccttatttcatcaacattttttagctttcactaggttcaagacatacacttttagggattgtaaaacatgcaaaggcagatacatcagcatagatatagattaaatatgtatgaagccaaatgaagtttcagatactactttttgctaaggaaaataaggaaaacttcggggaaaaggtaggctttaaatttacctctgaaagttatgtaaatatttaaaaaactataaagtataaatttgatttaaatagctatgtatattcctatttaattttaagaagatatgttttgatctatataatgcaacactcaacactcacaaaagaattaaaagaacagggaatattttggttgatatatctataaatctctctatatatattttatatatacacacatatgtgttcacaaatgtttgttctttttgtataagttcccatattttcttcctgcattacattttaattacatttttacttaataaaacattgtttaactgtgaatagccctctttgatgtgtgacattttatggtactttaattttatgagatttttacatttttcccttaggtataaatcaaatactgtcttttctcaaactgttctactattgatttgttggcttatttttgtagaaattacatggacaccaaagattatgattttttctcctaatgattgtagcataggttttctatttgaaaaaaaaaaggcgatttacattgacagttaagatgtattgtcttcttttcttccttttctatcttcttccctattgtcctccttccttccttcctttttctttttgtcttttctatgctttcattgatatttgacctgatatttattatatttacctagatctcgcttcatttcattaatatttgcttatatatcactaaatcacaaagagctctcctgaccaccttatgtgtatgtatatacacttttatttgttatttatatttttctgtgttccccacaccagaatgtaatgtctgttctcttctgtcctgtatttccagtggtgtcttggtgtattttgtgctgctataatagaatactatggactgggtaatttataaaaaacagaaatgtatttctcactgctctggagcctggagagtacaagatgaaggtgccagcacgttcaatttctgtatctaaggtggcaccatgctgctatgtcctccagagaagacaaatctatccctcacatggcagaaggtggaaaggcggcaggaacatacttctgaaagccttctttaatctatttatgagagcaaagcaatcatgacctaaacacctttattagaccccacctcccaacattgttgtaatatggattaagcttctaacacatgaattttgggagtcacattcagaccatagaaagtgcctagaatagtacctgacacattaatttgttgtgacttagtcacttatcattgacagtttttttgagaaatattctatatggtagtttcgataactaaagaacaaagtaagcagtagtttggttggctcatttttcaaacctgtgatgtctacttgattatagatctgtcactttacttatctttttgaaggaggaaagtatatggtaaaaatagtaataattgtatttttcaggagaagaaaaggcaacagctctataatctggctactgactgagaggatagtataaaaacattagcactactgccaaaagatgattcattggcaccaaccaatatttaatttggtaaaaaattattattttacatttttcctatgtatctttcagaaaaataccaattgtcatcatagatatagtaaaataactattttgggatgtctataaagtacatatggtagtataattataaggcaatatactacttaatatatctgatgataaacacatttattgaaaaaaattcttgtttttctttaaacatgtctatatgtgctcaaatgtgtgtgttcatgtgtgtgtttgtggtgtgtgtgtgtgtagtatgtttattccaacatagcccaaccttcaaccttttttaatatcctgacattatacaaaatatctttccagaatttgcaattcacttcttggcttttttttttttttggctgcagatttacatatgaagttggtttttattttctcttgtgtttatttaacatttttccatgtgtaactcgaatgtagagagaaggaaaccgtcatgtatgttcaaatataaaagccataacttattttattttattttattttattgtttttattttttgagatgggggtcttgctatgtcgccaaggctggtcttaaactcctggagtcatgtgatcctcccaccttggcctcccagtgtgttgggattacaggcatgagccatcatgcctggcctaatttatattgtggataatagtgatgtgaaggaaataaccataaaaaagaccatttttgaatcaagagagaatcttgatggtatcatttgaccttgaagatactatttttccattctaaagttatggagttttggtaaatcatttattgcaataataaaaagcaaagtatatttatgcacaaggagttataatggagaagtgcaaatccaatatgagaacaaaagcaccctgcatttatttaatacacttactatatacaaaactctgtgctttgaaggatgctatcttatttggtcctcacagcaactgaatgaggtaaacattattttgccccactttttggctagaaaaactaaagtttttagaagttaaatgaatagtcaatgtcacacagctagattatagaaccaagagtagaatgcttatatatctgactctgtaatttctgctctaaaccatgttggacggttttgtgcagcatagattataaagaacagttaaggaaggtagtaataaagagacaaaacctgttagttaaagcactccaactgcagtagaaaatcccattaaaattaacgtttgagctctgacactaaaaagtggcaagattgatcttttgtgagatgtagaaaaccaaaatcaagttgagaaatcaaaaaattaaggagccaggccaggatatatgcaggaatgcactcgtctttcttgggtttgggcttgacaaacatgctatgaccttaggctctgattctaaattatttataataaagattagtgggtctaacaaattctttatgtttattcttcttcattgtatccttccatcattaaattatttttattcttaaatattaattactatatatttatatccttcttaactgtatctgcacttatacccatacttttatctgtatcccactagctagatgaggagaaactcaaagtcaatgctataattatactgtatctgtaactgtagtgttgataatttgtttaatatatctattcttatattaactatttcattccataaatgtaggttcaatctctctcagtgaattcctttgcagtctttctaaattcctcattaaagtttttatttaaatattatttttaaaaagtcaatcactaaccgtcgcaggtgctatggtttaaatgtatccccctaacttcatgtgttgaaaacctaatccccactgcagaagtgttgggatgcaaagtctagtaagaggtgattacataaagagcagactgacctcatgaacaggttaatattgttattggagaagggggttagttataaatataagtttggctatctccagctctctttcacatgtgattgctggccctttcacccttctatccttatgccgtggtaggggacagccgaaaggccctcaccacatgaaactttaaaagatcttggatatcccagcctccaggactgtgagctaaataaatttctgttcattataaattacccagtctgtggtattttgttgtaacaacggaaagcggactaaaagtgcaggctacttaaattgactaggaaggagatactgacttgcaaaacacaacgtgaacaggaagtaactttgctttgtatttatattatttgtttttgtttcattcaagaaataagtctgaattatataattctatctgaatgaaaatcttggatatagcagataattactttctaataagattagttttattcccatgacattttgtggctatgtgtttaggtgtacaacactaaaattatattaaatcattataaacaagattgggagtaatgggtttttgttaaaattacaagtatgaaatattcattttaagaatataagaaaataaatgatgcacgttaacttgcgtattaattttgaactgaatctcaaatatcggatgtaacctagggaatgactttatagaacagataaagaaggattttcagctaaacagtacattcctagagcaatctttctttaaaagtctataggtttactgtcagggagtccatgttttctactagcaatcttataaatatatgattacatgttagtaatcattttgaaggttttaacatagcatgttatgaatttaggattatctgaatgtcatacatatggaatctgaatatgcttttgtagttggagcaggttgtgtcatgaggagttacatcaaataattctggtttttgagcataacaaataaatgatgcatttataccaattgaaagattaataacatattaaatcctgtacacgtttcaccgtagtcaaaatgaagaaaaacttggataagtcaattagtcattccatagcactcagttgtagaatactgtataaaatcacacaatctacaaaacctggcattacagcactacatttacattttatgcacctacttggttttagcaaaacagcattactcatcacagtaaatttacattaagatgtatttgttgattcattattttgtatttgatttgtaaaattatgtttgttttagttttatacttgtatttatttgagtaacattataatcaaaataatttaacccaagtcaagggtatttcattgtaatgattcatttgttgtgatttgaaggaatctgtgcattatttaattttgataagtgctattctacagtgcagacaattggtctttcatgtatctgcatcctagacaactcctataccaactctgcatgtgttgctaactaaaatattgtttataatcaaaatggtaattatcagcattttttaaaatatgtgcaaactaattattcagttatctatttaagtggtcttccttatacagtttttgttttaatgatttgtgcatctcaagttatttttttcaaagataagtaatcaatcacttgaccatactctaaattactgaatttagaactcgtggacatactctaaattgctgaagtcaaaattaataagcctctaattctctacatatctatagatatattaatttccaaaaagttaagatgcgtaaaccaatctagcaatatcagagaaaaaaactgatataaaaaatgtctgtaatggtctaattagtaaaatctatatggagagaataagggattccactggaaaatctaggttactctattttacttttatttgaaacaatgtgacagggacacttactaacaaccaaatagccacgtgctttccatattttctagctgcctttcagttagatgggtacctgtctgtgctattaattaataattaatggcctatgaatagcagtatatttcacttataggtataagcattgaaaagctgctataatgccctcaacccttttttttttttttttttttttgagttccagaagcatgtcttaatttgaagctcacacataacatagcctatcctaactcgtttgtacagaaacatagggggcgaaatttgcagaattaaatttaaagacatacatatcggaattacctcaacccctaaatctgctgattttatgcaagtcacttgactttcttgtacgtagcttcttagctatgaattaagtgtatattatgtattttttcatttaaatgatctattgagtatttctttgttccagacattattctaggcactaaacacatggtagaggatgagacaaagtccctgccctcattaggcttacattctaacatgcttttattcaaactatcttttctgggtactaaaaactatataaaacttgacaaaatgtaagctcaacaatgaatacatttataatccagtgaaatggtaaattatatgacatatctattaataggaatttgaattgagagctctgaaatgtttgcactgcccaaagagcatggttcaagtgctggtgaattactccccttttttctgttttccaaactgtgttcccttgaaaatgaagccatgcaagcctattttctcttcttaatttagatacccagggagtacagtctgttttctaactcatccagtggtgttctagtagtagccctgtgtggattgaaataaaatctatgaaaaaccgagggccagggagacacaaaatagagagacattcatttcaagtagtattagctggctttagatcaggaaccttcaatagagtggggaatcaagatacttcaggcacttctagctcaaaaactataatcatcccaataaatgtgtgctgggtgggcagagaagagagagctatttattgatattttaagtaaataatttggaaaaaaagcaatgagaattattcatatgtaagctcacatatacaattagaatatagaaacccggacaattattttatctattgccattctatcaaatatttaagggcaaaattaaaatagattcactttttgtttacagagcccatttaactacttaggtaatgactgattgacataatatagccaaagtaatattacgaagaaatgagctaaaaaatctcttaattaaaaatatatttcccctctcttgagattcagtaatctattttagatttgaatttctatggcttagaaattgtattattctgataatattaattttttaaaatagaacgtactgccataacagaaagattttatttttttttatttttttttatttttttttaagacctaacaaagggtaactaatttgctgacaagtcactgtagctctactggaaaaaaaaatgccttcgtagctcctatgagttataataataaagtaggtcagcagcctgctgagtgttgcgattctcctttgctgtcctgtctctcccaattagcaaagtctgcctggcaactgctctctattggatagaaacatgacctcatcacaaaagggaaagggttcacatactgtgttcttccttctcagatgtggattctcttacaggaaaaaaataaggaaatcaactctaatctgatattttgttttcagataaaatgtgtatttcagaaaattttaaatcgaactataatttcatcatcgagagggatacaggatattgatgagattgtatattggctatggtgaccttgagttgctttagcaatgtaagaccaagccgttaagttccaaacatgtttttgttcccgcttacatagactggctcttaaattttaagcaacaaatagcagaagaagcactattcatgaaattaccttatctaacaagtggcacctgataaagttgaagaaaaaaaagtattttgctgtctaatatttcctccaaaatgattaatttgctagacttagttctccgttatatccttgctattctaaatgttgttgagacattcacaaatatagtattcatgtatgtataacacattatctcacctattttgaaggaaatgagtaaaaatacatttaccattttaaagataaagagtctgaaacagaattgttattccatttgcataaagccagagacagtatggtagctggttataaaatccatatttccccttggattaaggatgaacccaccataccattctacttcatgagccccagacaacttcatcttttataaaccattgccaatttatgtttatagaaaacaaccatgaattggctgcactgctggaagagctcagaatgtatatgaaaaatacgtgaaaagtcattgtgttttgtatgtgtgtgttgggttttagggtctttccttttactactgtcgtaaattcaaaagaatctggcaaagaaaggcaattataatatcttattttttctgaactcctcatatatttacgtttcacataaaaatgttgttttgaattgatgcagattggaataaaatagtaacattgtcttcaatctgggaatcagtggaatagcagactaatagtttctactgtattattcaatttacggatatacggatgtcaggcaattcatatgaactttctctttctaaagagttcaaggttatcattctctgtttaaaagagacttatatagacttaaattatgtaagctaagttgcctattttcagataattttccagacaagattatatagttgcttcccataatgaaaggctctccacactttgctttttctattccatctcatttttatccctcctgctttataccccagtctaattatgctactctagagatatatgacagaatcagaagtgacatgaagaaagccatgtgataaatgcgggatataagaaagaataggagggacactttttgaaacctaaaacgaacatttcgtaaccccattgtataacccatcattttttttgaagtgtttgttgtttttagagatgtaatttattctggagtaatgagtaaattttatgatgaatttggcttttaaacctttaacttatttcagctattttatacatatattcttataatgtatcaaccactgtaagcaatttattaaatgagatcttaaaatatagaatagactaattggcccattttctttaaactttgagggtctagacatagggccattatgattaacatttaaatactcttttagggaacaacagacagtgaggcctacttgagggtggagggtgggagagggagaggataggaaaactacctattgggttctatcttactatcttatataccccatcattttttagaagtgtttgctgtttttagagatgtaatttattctgggtactatacttactacctgcgtgacaaaaaaaaaatctctatatcaaacccctgtgacttgcaattttcctgtatagcaaacctgcatatgtaccctggaacctaaaaaaaaaaacaaaaaaaaaaaactaaatacccttctagtatttaccagctaggtgcctcagaaacacagctccaatccaaataagagttaatcaatacctgtctctgttctacatccagtatctcatatttcatgcatagagaaataggcacacctagctgtggactgttatcatttattctcatgcataagcttggtaatgataaaaattgtgtagggaaagtttggaatttaccatatctttgtattttacaaaaaacatatagcagtgaatcacaatccattctctatactccagtagcgttttcttgagcatatcataaagtcaattaaaatggtctctaattatattctaaatatagaatgaatattatttataatatctacttataatgtccatcaaagcaaatgatgtgtatttagagatcactgtgtgctaccctttgctactgtgatcaatgtgataatctaaaatcctgattcctacaacatggggaagggcttctagtggaaatatgttgaattttaactacataccaaatgtggatataattgaatttgaccttcttaattttccagaaactatgtttttggcctttaggtgacttttcagatttttttaattgatgttgtgtttttcctaaggtcagctatttattcacttttttaaaaaaaagatttttactgagttcaatgaaattataatataatagaaaaaggtatcatttccatggtgggcattattatctccccattgctcccaagctaaaagtaagcattaatgtgccatttatttatgattacatttagtctacaacttttgtaattctgtcctcgactgagttatcaattcttaaggaaaaagaagagaaaagaaatttaccatgtgcctgaaatcagtaaatattaggcaaatcaaaccaaaatgtagtaatctgtaacatttaatggaaatcattctcctgaggggcacctttcccttacattcatcagtgttattatttctctatatttttctgttctgattataccaagagatcagaactttttaataagtagctcttttgaaaaatattaaaaagaaatgtaaataaatacagatttttatacaaaggatcatgttaaaatagaaaccctataaatgagagatgtagagacagtttatatacaaatatttatgagactgtcatgctctaaagtttttgaatgtatttctcgatcatttaatttgtattcaaattcattgtatgaacagggtaatttccatggtgatttagtgttgtacaggaattaaattattgcaaaatttgaagaaaccaaaagtaggataaacacattatcttacagaagaatgaaaaaaggaatagaagtaggagatagaagccaaatagctaatacaataaaagcagattgtcttttctcctccaggctgttttttgccattgagaccattcaccattgtcactaggtggtactgaagcctgccctatttcttgcaaaggagataaaacttataacctttatcataaccatgtgttgtttgagatcctaacactatttattttcctgagctacattcttattaagatcttttatttcttgtccaggaagtaaacaatataagtttatggatgtaattctaccaactactattacaataattcctatacaggaactgctcccacatatctaatatttagtacctgcaattcattattatttattttgcttatttatttgtctagcagttttgtggtatctgttcacaaccatgtgaagcaaattgtctgtattgattaataaataactcattaatcatagtgtcaaaaacactttttaaaagtactttatatataatcaccaagattgtgaataaattatgaattaggaaagagacattcaaattatctataaaactcaatcagaaagctggtgacagaactggaactaagaccacagtctccttacttgtactaccttctattttccatcaatgtatgaatatagaaatcatatactgatatattaaggtccagatgattgggtaaaatcaaactttgcttcagtttcattgtttttatttaaaaatgggagtttatctttaatcagttgataagttagctactgaaataaacagaaataatatgaagcttatcaaaacctctcttgaggcaacactttgaaagataaccacaaataaaacttatgttcggctgggcgcggtggctcacgcctgtaatcccagcattttgggaggccgaggcaggcgtatcacgaggtcaggagattgagaccatcctggctaacatggtgaaacctcgtctcttctaaaaatacaaaaattagccggacgtggtggcaggcacctgcagtcccacgtactcgggaggctgaggcgggagaatggcgtgaaccctggaggcagagcttgcagtgagccgagatcaccgcactccagcctgggggacagagtgtgagactccgtctcaaaaaaagaaaaaaaaccaacttatgttcttacaatttcaatattcttatgcataggtatggcagaatgatacatattctaaaggaaatcataaaattttgggggctagaatttattattgagatacattttttaagaaagaaattgacctaactggagaagaccaggtgtcatatgggtacacactacatggaaatctagcatgctgggaaggttgaaataaagcggtataaagaaaaaaaaaagaaacattaatgaagaagtgttattaacagcatactagaaggtccaaaagtagtaaaatggaggcaggtttagggcacaccttagaactggaaaagagatgggacatctaatctccttaaagcagacgactgatgagctcttggcatgcctagttgacagtaaaaagcatagaagaaatgatgagaatctacttcaacaaaaactgaatttgttggttagagttaagtgatcaaaatctgataagaagcatgcaagtaaagttaaacaaaatatgagaagtggtattgtgaagtggttagcataatcaagtcctggaactagattatttagattcctctactggttctcttatgctagctatgtgaccttggacaactgacttaacatatttgtaccttggttactttatctgtaatgtggggatgataatcataattacttcacagaattttgaggtaaataaaggtgcttatatatgccaactaaataaaacgattttatttcagacaggtcactccatcgcccaggctggagtgcagtggtgtgatcttggctcactgcaacctcgtgggctcaagcaattctcatgcctcagcctcccgagtaactgggactacaggcacgggccaccacagctggctaacttttgtatttttagtaaaaacaggattttcccatgttggccaggctggtctcaaattcctgacctcaagtgatccattggcctcggcctctcaaagtgctgggattacaggcgtgagccaccatgcctgaccaacaatttttattatacttctcaagtcagtacacaaaagctattattaatagttgtatttgtgtgtgagttagagttgatattccctatcaatgtattggtatatattcctgtcatttcaaaaatagaataatttcaggtagctgagagtacaagcagatgtactgtatacctagaaatattaacagaacaatggcagaaaaagaaaaagttaataatgcataaacgtggctaaagaaaccaatagtatttgaatgtaaaactttgtttttattttgctaccacctgcagaatactagacaaaatgttagtttcaaagaacatttagaatgagagaaacattaatggcatttagtaatacttggagcaaggaccaggaagtgaataaaccctccatttgggatccacataaatgacagaatgttagtggaatacttttcttcttgtttaataatgtcttctgtcaaggtgaaatattttaaactgaataaactggaataaagtccagagaaattgaactccgagacaatactttggtattccaaatgagctcaatcccctggcttatgtgaattgcaccttaagatggtcatatattagagaaaaatgatggactgattgcacaggatctttaataagcaattaaaatgatgaaagaactgtttttccatggaatatgaaaatgatgtatgaatttacaaagtgagattctgtaccaaattataaaataaattatatatgagataattatcattataatttggtaattataaaacttatgtaggaaaagtttggaatttaccataatatctttgtaatttataaaaaacatatagcagtgaatcaaaaaatgttctcttttgtgttgcgtggtcagagaaagctctagtttaatgaaacaagtcataacagattagcctttctttctctgtctcatatatatatatatatcataaaatatatacatatgatattatgaggggaaaaatcttgttgcaaaccttgctaaggacatataccaaacacctccccctttttgaggtgaaccttaggactagcatatgtacttatacaaatgtttctacaaggtgctttctgatatgaaatatttggactaacacactatagaactgagttaagttaataacaggttgagcgaatgttttctctccccagatcctaaagtacagattgataaattgagatcaacaaagatgaagatatgtaagaggacatctttaggatcctgtcttcagatcggagttattttcaacatattaataataacctgggccgggtgagtggctcatgcctgtaatcgcagcactttgataggccaagacaggaggatcacttgagctcaggagtttgagaccaggctgggcaatatagtaagaccttgtctctataaaaactttgaatagctagagaatgtggtggcacatgcctgtagtctcagctactcaagaggcttaagtaggaggataactggagctggggaggctgtggttacagtgagccaagatcacaccactgcatcatttcaccctaagtgacagagccgcacctggtctcaaaaagaaaaaaaagagactaggattgcaacccctgcctttttttgttttccatttgcttggtagaccttcctccatccttttattttgagcatatgtgtgtctctgcacgtgagatgggtttcctgaatacagcacactgatgggtcttgactctttatccaatttgccagtctgtcttttaattggagcgttaagtccatttacatttaaagttaatattgttatgtgtgaatttgatcctgtcattatgatgttagctggttattttgctcgttagttgatgcagtttcttcctagtctcgatggtctttacattttggaatgattttgcagcggctggtaccagttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctgacttgtagagtttctgctgagagatccactgttagtctgatgggcttccctttgagggtaaccggacctttctctctggctgcccttaacattttttccttcatttcaactttggtgaatctgacaattatatgtcttagagttgctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggctttgttcgtttctttttattcttcatgtctaaacttcccttcttgcttcatttcattcatttgatcttccgtcactcataccctttcttccagttgatcgcattggctcctgaggcttctgcattcttcacatagttctcgagccttggctttcagctccatcagctcctttaagcacttctctgtattggttattctagttatacattcgtctaaatttttttcaaagttttcaacttctttgcctttggtttgaatttcctcctgtagctcagagtagtttgatcatctgaagccttattctctcaactcgtcaaagtcattctctgtccagctttgttctgttgctggtgaggaactgcgttcctttggaggaggagagatgctctgctttttagagtttccagtttttctgctctgttttttccccatctttgtggttttatctacttttgttctttgatgatggtgatgtacagatgggtttttggtgtgcatgtcctttgtgtttgttagttttccttctaacagacaggaccctcagctgcaggtctgttggagtttgctagagggccactccagaccctgtttgcctgggtatcagcagcggtgtctgcagaacagtggattttcatgaaccgtgaatgctgctgtctgatccttcctctggaagttttgtctcagaggagtacccggccatgtgaggtgtcagtctgcccctactggggggtgcctcccagttaggctgctcgggtgtcaggggtcagggacccacttgaggaggcagtctgcccattctcagatctccagctgcatgctgggagaaccactgctctcttcaaagctgtcagacagggacatttaggtctgcagaggttactactgtctttttgtttgtctgtgccctgcccccagaggtggagcctacagaggcaggcaggcctccttgagctgtggtgggctccacccagttcaagcctgggggctgctttgttgacctaagcaagcctgggcaatggcaggtgcccctcccctagcctcactgccgccttgcagtttgatctcatactgctgtgctagcaatcagtgagactacctgggcgtaggaccctccgagccaggtgcgggatataatctcctggtgcgccgttttctaagcccgtcagaaaagtgcagtattcgggtgggagtgacccgattttccaggtgccatctgtcacccctttctttgactaggaaagggaactccctgaccccttgcacttcccaagtgaggcaatgcctcgccctgtttcggctcacgcacggtgcgctgcacccactgtcctgcgcccactgtctggcactccctagtgagatgaacctggtacctcagatggaaatgcagaaattatccgtcttctgcattgctcaggctgggagcttgtagactggagctgttcctattcggccatcttggctcctcccctaatgggtgcagcacaccagcatggcacatgtagctaacctgcacattgtgcacatgtaccctaaatcttaaagtataataataataataataaaagaaagaaaaagaaaaaaagaaaagaataaagtaaaaataataacctggttgaagtcaccaaagatgcagccaacaaaaagcaaaaaagaagtggctagtatgctgggttatagattcatatttaagaatatcttgttatataagaagatgaacttagcctaagagaatggatttcatatgacaaacataagatcccataagagattcagaaaaaaacaaggataaggacaagtacaagaatcagacaaggctcagccaaagatgtaaagcatactaagggtttttgtgactataacttcaatatacgacataattgaaatactgctcattttaactacataaagattctaaacaataatatttttattaaaaatagttgaattttggtgccaaatactaagatattttgattcctcaggcaattattttctaactagtagatacttctttgaaatgtaaatactcactggctgtctgcttatattctgaaatgatgctttcaaaactaatttaaattcatttataaattcatttaaataaagactgtgacagattagtaattaactttgtttttaatagcctcttactgaactcacttgattatttgacagagcatttagatattaagaaagcagtaaagtacaccttcatattataaaaacctgccaaaagtgtagcagaaaggatgaaattatgatgaattgaacaagagattttattatttttacagttaatcttttaaattatgcaaatagaaaacaaaagctccttgctttgcaacacatttctctgtgtagtacatttcttatgtgtagctgctttgggttcataactttgtattactcattatggcagatcaggatgatgaaatccttgactgaaaaacttagaaatgtgtggcttttctttcataaaccatagacgttttgttttataaatattgattctatttgtctttattaccagtaataagaaaaatctttaaaattgtaacaaaatagccttctagattaaattaactatttgtcagtttctatttggaacacaattagagaaaaatattaaattatgttttaacttgagggaagaaagtcagaagttgcatatttcacaattcaccaaaagtaatgtcagccctaacataaatgtgttgtatttgctagtttatttcattgctgattattctcattgcaaaaaacttatggaaaattaagcctacactttcctaaaaatgcttatctatatagagataatggatgagttaacgcatcttttttctataaatcttttaattgtaaaattacatttacttaggggacttaggaaaacctgttggagaggagagttaaatctgtatgaaataaacaaccaaccaaacacctgtgactcaccttccatgtcattaaaatagaactaatcaaaacctttagataatgtattttttcatttactttcctaaaatttgatgtacaaaagttcaaatagcaagaaaaatggagaaagtacctgatagttattctaaaatttatgttagccaaaataattcttggctatggaattaatgcaggttcagtccaatccagtgccctgtatatgcctcttcgtagcatactacaattgaatatattatggttatctaaaaactcctggttatcaaaaaacaatttaatattgtctatcatgtttcatttaacatgatgggaaagaaaaatcttacaccaactttcgaaggcaaaattcccctgtaactatgtgtcaagcataacaagaaaacttaattctctaaaaatgctatttaatatataaattgtactggatatagaaaaagttaggtacatgacaaattggggctatcaagttaaactagctcttgaagaaaactaccaattcaaccaaaagctgttacccaaatattctctagcctaatcaaactgattaaaaattgatagcaaactgacatgcctacagaagccattctcataatatagatgtatgaattagaccaaatgtaagataaaaggcagcccatgactttggtgaattggtaaagcatactctgtccaaggaatgtgcctacttctcagttttatctaatgattatcatgtggaaatgtatgcctaatgatacctagagtcatcaagaacagctgaatattcagatgttttttattgtaaatgccattatattttatatatggtaactaccttacatatatatacacatacctatagatgcatctatatgtacaaatagatatgcatatgcacgttttatattatttaatatatatacttatatatcattttatataattattgcttttaaaaaacaatgtgttccaaaggaaaaagcttcagcaagccagatttagagccagcaggccctcagtttccacctcctgaaattaatcaaacataatttcgtatgttcttatggttgagaacagaaatgctggctttgcctctagatatgttggtatcttgtctcagactcctgccttaacagaattcttcctttctcctccatttacaaaagggaagaaaaatcagtgaatgtaaaaagcatctggggaaaacagaagaaaaggaatttgtctactttagcagttcagctggactttgaagatttgttgccctaatttgaattccttttcacatgaatttaactggtttgacaacttgcttcaataataatatgataaattatcaaacagcttatgtctgacagatcaagcctagataaaatacataaataaagttaaaaggacacaacagacaaacaacagacaagttaaataaagactttgcatgagaattctttattgttgcaagggaaaaaataatattaaaatattttagttgtgatattcctgtaaaacagcatacattaaccttgcagaatttgttgagcattaagggttttcttaaagttaatgtctcctgtcttcttcaattctcatgttacctattgttgagaaacatatattgagcactccattaattaataaatcaagagctagagctttactgcatccatagccataataaacagttaccagactcggggaacctgagattctagctttctattccaaatatttcatttaaagaagatttttcttaattattttaatttcttaatccacatgtcagtgataaaataaaaatatttcaagcatattaatcgtatcacaagagttgttgttcagttttaagtatatggtgtccaggctggactgaaaaagatttggtagagtattgcatgtgcaaggtataacaccccttcccataccacaggatcaatttgcctccacttgttttcttgagattaggatgtattaaatagtatcaatctatttatatatcttccctccctccctccctcccttccttccttctttccttccttccttctctcgctccttctttgcttccctccctccttcatttcttcctttcatgttttctgtctcgagtagctattcttatatgctttgatctaatggcaaatatattgataataaaacaaagtcttttcctcatagttgtctgtttttctcagaaaaaaatagaacataaacaaattaaacagctataaaatatgtcaagcagcacaaactatgttacaaaatttaaagcaaggaaacagaatactgtaacctgggtcaagcagatctttcaaaaatagaatagttcctatatgccatccccaaaaagatgacatttaatcagaaaactcaaggaaatgaaggaagaagttatgctaatatctggaaaaagaataatccagaaggaagaaacagcaagtgcaatattggctggtgtggctggagtggagtgagagagaagaacaaaaataatgttagaagatgtgtaggagccagccaaatcccaatgggtcttgtaaaccatagaaagatttggggttctgttcttggtaaagtgaaaagctaaatgaggctgagtttcctatgttgtgatagtttctaccagggttgaagacagaagagagtgctattttgctattttacagaatagctacagcaccaggaactaaagtgcctgtgagcaaatgtttaagtcagtacacaacaagtaagtggtttgggcagaacaacacagcagttggcagtgagcaataaatgcttgaggtagacaaaacagagcaacacgcagcagcacagggagtttgatgtgaactagtcagggttagcaaggaaaacagcagctcacttcaccctgggggagagcaagaacacagtggcctacctaagtatatcagacttatttgaaaatgtgtgtcatatttctgagtattagtgggtagtcacaagaggggcatgagtttcttggttatgaaggaagaagcagctatgaatataatttaaatataagtattaagcagacataatgttattctaggggggaaattattcactctttcattctgtcagtcaacaaatatttcttgactgttctttgccaggcagtgttgtaggcattattatcttaccctgggagttctacattctaattgaatttgttcctatataaggactaattgaaggtaaacttgatttcctcaagtatagtaatcagtgaagataaactaaaacaaatgtttggtttctgacagtcttggacctttagtgatgcttgaactttttgatctaagtttctatctttattatttgaaaaaattctcaacttttactccaaattgaggttgatcctttatctatatatgttatataataatagtacattacattatatgatactatataatacattatataatattatcattatatattatatatgatatttaataatatatttttgttatatttttataattacatacaatatgactaatataatgtatattatgtactattctatataatattttatcaaatgttagtgttttatgtttcttcgtaccttcctgccagtctccttcaatatcatctgttccaggaagtttgtcttcgtctgtgaactagcatttatatcacataaaatcattagctagctattttaaaatgctgctactacaattataaaaataatatcctgttggttagctggccatcatttcttaattctggagggaatcttcagtgtctctgaaccatttgcactgtatcactctacttacatcatgatacagcgcagttggaataacttcatggaaataaaaacagaactctgtttaaataaaaagggagatttgaatttgacaatttttctcaaaaataacattaatttacagtctttgccgttttaacccatcattcattacacttcatttttctcttttgctaaaagataaaaacttactagaaaatattaaataactctatacatttaatttgaaggttaaggtatcatttggcccattacatatccccaataatattatttttttaatgtgaaatttgttttcatcatatgtgctctacagccactctaatatgtatatggaattgtatttgagagagattttgggagccattatattaagcttacttatcacttctctgaaagagagaaacttacactaaaattcataaggaaaatatttcttagtgaccttccagtgaaattttaatgggctattggtacttgaaaataaacaagataatcatattattaaattgaaatagtgcttattaaaaatataatcacgagtgagaatgcatacagatcatcccttggaatatatttttgagttctataagatttataaattttcttttgacaaaagaaagatttgttgagtctaagggtattcctatcttattaggcaatttatagctgtccataattatagtcacaggggttgttatgaaaagagacataatttaaatccatactctttctatagctagggctagtagaaacatattagtcactattgtagaccaaattaaagagtatattcctttttctacttgttcctttactttaataattgtgcttactatatgttaagaaacctgacgtgtacatcatctcatttaatttttactaactccaaagtatacataactgattccaattttatgataaagaaactggagttctgagtagttaatatcactcactgtaaatagtagagctgcaatttaactcaggtgttttgttgtttttgttgttgttgtttgtttttctttttttgtttgttttgtttttttttttttgagacggagtctcgctctgtggcccaggctggagtgcagtagcgcgattcggctcactgcaagctccacctcccaggttcacgccattctcctacctcagccccccaagtagctgggactacaggcacctgacaccacgcccgctaattttttatatttttagtagagacggggtttcaccgtattagccagtatggtctcgatctcctgacctggtgatccgccctcctcggcctcccaaagtgtcatatgtgtttttaattccctacctcaagagctctttaacatcttagccattctgtatcaacacatgggactctactttcaatcttctatcagtttaactccagcttggcatatcttgtagatgatcaaaattggatgtgttaacatgttgctttttcatttggtgtggtagacatctcccaatggtactactttgtagtattctaaccctaataaattccctcttacatagtgccaaggttggcctgtgttaccaataaaatatgttagaagttatgatatgtcacttatgagattaggtcaccttctatcttgggttctttcttggatcacttgttctgggaggggcctgctgttatgtatgagctgcccaatgcagagccactgaagcctcctgccaatacacacatgaaaagctgaaagtggatcctccagcccttcagatgaagcattcctatctgacttctgtactgactctgtcagaagagatcctgggccagaaggacccagctaatctccttgattcctgattatcagaaagtgtaagaaataataaagtattcttttaaactgctaagtttcagggtaacttgttatacagcaatagataattgttgcacctggcattgtatcttgtattttttgtcagcatagccaaggaagcttccaagccatttctcttcttcactgactccagtgactcaaatgtcacactctttatgaaaatgtttattcaccttagtagtctcagagtttaaagttgtgacctcagctaacagcataatgtgacaaatttgttgtgtgcataccatgaatgtgaatggatgagactagaaaaaggtattcttggaaataataaaatcactttattcaaatactatacatttataattagcggttatttggcaagaaccagaatgaaatttgcctttcattatctataaagaaaatattactgagaaaatgtaaaagccttggtttgtaaaaaagaaattgaaatatattaactaaaaacattttcagagtttgtgttttataatcacattgacaagaaatttacatttatttatgttgatggctatgatacaatggaactgattctcttatgtggcttgatcatacccgattcattcattctttctaaaattattatatgtattaaattagtaccctattgtgtacatttaagcatatgtttgctgatgtaattcccaactgctagctaactgaacaataaaactgcatgcatttcttttgaaacgaatctgatactgacttgccaccaatttggatttgccatatacacatgggtttatagtagggatgttttgacataaaggagggagtattgtgcagggcatagagtactagataattaggaaaactagattctaatccaagttttcatttactgtattatttaatctggttgatcggacttattttctctggtctctttttgctcatctgtaaaatgagggagctaggctatatgtagttagccttggaattctttattccaacaaaaagtgcagaacaatatgtcaaataaataactgactatgtgaatagaagcctagatgatctggcccaaagtacgggtgtggtcctggagcccagactttatctctccaagtccttcaaaggccttgtcagtgttactgggaccatggtatgactattgtatttataatattgtaattattcagtagaaaacatttaataaaatatatatactacttgccatagcaaactgagattgagtaaagtgattttcttttggagttcttcttagttcataattacttcattttactggtttatcattaaattatcactattttattattctatcatgattggtgacctctgtacagtgacctatattaaaattcagtggattgaattagcctcccatatgaagtatgtaaatgtagcaagtaactcaggtatggtacaatgcagaacctcccccctgccttaagcaacagatgtttgagctaagaacatctggagcattcacatagttagttgggtttaggtagggaattcattattggcattgtatgctgggcttagttaaaagctgattggacaaaccctaaaactctgagtaatcttctgccaaaatgaaataaaaactgtgggaatgaataaatctgtgccataaggagtcttctccagtgacattcacagaagccatacagcagattgcacacaagtgctgtctatacattcttatagtcatgtatttatatgtatgtcagttaaatgtttgtaaatatagagaaaactgaagcttcaattatttttttcagcatgcatggaataattcaataattcaagaagtccagataaaatgctgaaataatggaattttattggcgggggtctatagaacagaccccactgtgaaaagcacactcttggacacttgttcatgtatcatttgttgtaggattttccccctgaaatgttctataggagaatagttctgtcataattactaattttgtggtgtttttgtgagtttatctctagtatctttttttggtatatttgcgggaattgattcttctttaaagaacgttagaagaaaatgtcattgagaattttgattagtagattccagcttatcaaagtctcatttaatatcttttcttcttctctttattgatattaaacccacaccccatctcataaagtgttatgtatggcaagtgtattcttgtaaatctagcagatctctgtgatttgttttcattacattgagtcattgtcattaataaggtctaacagttgcctgagccttttctaaaataaaaaatatgatattatcttattgatatagttttctaattgtctagaacctagttaccaaacagcaaaatgtatttcatattgattttacaggctatcttaaccaaaaatttaattgaatattggaatgactgatgtttcagaggaagttagaaaaataatcaactttttaaaaattttaaagtgaaatatgcattttatttactaattctgttctgcaagagatatatcagaagaataaaataccatgataacatgcaagcttcagtcatcgtatcaatacattggggaactatttgattttcctgcacaaataaatttactttttaaatatataaattagtgatttgatgataagtatataaattagtcatttgatgatatgctttgtaaaactgtactgtaaaatataccttaaattagttagatgttttctttttgacaaaaatataaataacagtattcttatactgacatattggatgttgttaattagctttgactttgtgccctcttcaattagtcttaacataaagacaatatagcaagtgacattttttaaaaaaaataaagatgatctatgactacaatattctttaaatatctattggctcttttggatgatcaggactataattcttttataatatagatatatatgttatgaaaatagaacttcactttgattattctctattttttctttaaaagttttaaaagacccaatgatgccatactccttgcattgttgtaagacttataaaactctctataaaatgcttagcatatctggcatatagtcaacactcaaaatattagctattaccaatataatcctctatgtgccaaaatttgacaaaattagcaattttcaaatcacccatactctttgtcattgttcagacattggccaaatgccttctcaatctgcagctttgcatagtgatgattttaactctcatttaatttattctaaaaaatgtcaactgttcctcctccacgttcttgtatctactttaatttctacgttctagtatgtatcttagtgttctttagttccaccatccatcttgattcctactgaataagctttgtctaacatgcaaatagtctttgtttcacttcagaaggctgcctgcggatgtccatttcagagctgtgtaaaccttttggattgaaacagtgctggtgcagatgtcctaaaggacagaccacaagtgtgtctccaagggtattaccaataattaggaacccatcatcttgtacaagtttataaaaatgcatattataccactttcccagtaaaagagagaaaataggttgcatcagaagactcagatattaagtctataaattcttcagaagcaacttaaaattcattttattgtactctccctagaggagaagtgaaaagcaatctttgagctattaaatcacctgtgctgaatacacctttgggggagtgaggaattaacctcagtatttctctgacactgggacaccactccatttgcttaactaatataccatgcatggattaatctcctccttaaatcacattagttaagtttaaggataaaccaactatttttatatcctatcctcccacaccatgtgatattttgccaatttgaattgtcattcaacagatattgattgagcacctactatacattaggcatgtgctaagtcttgctggcacaatgtagaaaggaaaggcatttttttcacttttgcttctcctcaggaaataaaattatctagtttgaaatggtgcatttctcaggcatttgaaccttcaacaaaacacataaaaattgcatattttgccaggctaatgacagaagaggaagaaggaagagaaaaatacatcagcagctgtgctttagtgcctataaacaagaatatgatgacaggaatgtatctgcatatatcaatactaactttgaatgtaaataggctaaatgcccaaattaaaaggcacagagtgccaagttggataaagaagcaaaacccaatggtatactgtcttcaggagacccatctcgtgtgcagcgatacccagagactcaaagtaaaaggatgtagaaaaatctgccaagcaaacagcaaacagaaaaaaagcagacattgctattataatttccgatgaaacagactttaaatcaaaatctccacacaataataataacaacataaacttcaggctaatatttttgatgaacagagatacaaaaagttttcaacaaaatactagcaaactgaatccagcagcacatcaaaaagcaaatacatcatgataaagtaggctttattcctgggttgcaaggtagttcagcgtactcaaatcaacaaacgtgtccatctgatatgatttggctatatccccactcaaatttcatcttgaattatagctctcataattcccatgtgtcatgggagggacctggtgggaggtaattgcggtcatgggggtctttccatgtgctgttctcatgatactgcgtaagtctcatgagatatgatggttttataaaggggagttcccctgcacacactctcttgcctgcctccatgtaagacataaattgtgactttgctccttgtctgccttccaccatgaggcaaacacctcgtttgcctccctagccatgtgaaactgcgagtctattaaacctctttttctttataaattacccagtctcagatatgtctttattagcaacatgagaacagactaacacaccatcacataaatagaactaaaaacaagaaccacgtgattatctcaatatatgcagaaaaggcttttgataaaattcaacatctcttcatatgaaaagccctcaacacactaggccatgaaggaaatacttcaaaatagtaggagccatctatgacaaacctataaccaacatcatactgaatgggcaaaagctgaaagtattcccaatgaaaactggcacaaaacaaggatgccctctctcaccactcatattcaacatagtactagaagtcctagagcaatctagtactagaagcaatctagtcctagagcaatctagtactagaagtactagagcaatcagactagagaaggaaagaaaaagcatccaaatgggaagagatgaagtcaaactatccctttgcagagaaaatgattctatacctagagaaccccatagactctaccaaaaagctccttgatctgataaacaacttcagcaaagtttcaggatacaaaatcagtgtacaaaaattaatatcattcctatacaccaacaacattcaagctgagagccaaatcaggaaagcaatgccattcaaagtagtcacaaaaagaataaaatacctaggaatacagcaaactagggaggtgaaaaattgcaataagaactgccagacactgctcaaagaaatcagagatgacagcgacaaatggaaaaacattatacgctcatggataggaaaaaatcaatatcgttaaaatggtcatgctgcctaaaacaatttgcagattcaatgctatttgtatgaaactaccaatgacattctcatagaattagaaaaaagctattttaaaattcatatgaaatcaaaaaagagcctaaatagccaaggcaatcctaagcaaaaagagcaaagctggaggcatcatgttatccgacctcaaactgtgttacaagcctacagtaaccaaaacagtatggtggcgctacaaaaaaaggtacatagaccaatagagcagaatagagagcccagaaataatgctacacacctataatcatcttatctttgacaaagttgacaaaaacaagcaacggagaaaggactccctagtcaataaatggtttggggataattggttagccatgtgcaaaagattgaaactggatccgttccctataccatacacaaaaatcaactcatgatggattaatgacttaaatatagaacctaaaactgtaaagaccctggaagataacctaggaaataccattctggacataggaaccagcaaatatttcatgataaagatgccaaaagcaattgcaacaaaagcaaaaattgagaacggaaacctaattaagctcaagagtttctgcacagcaaaagaacctatcaacagagtaaacagacagcatagagaatgtgataaaatatttacaaactatgcatcaaagtctaatatccaaaatctatgaataaattaaatttacaagcaaaaaaacaaccccattaaaaagagggcaaaggacatgaagagacacttttcaaaagaagacatacatgcagccaacaagtgcatatgaaaaagtattcaacattactaatcattagagaaatgcaaatcaaaaccacaaatgagatgccatttcacacgattcagaatggctactagtaaaaagccaaaaaataacagatgctggtaaagttacagagaaaagagaatgcttatacactgctgctgggagtttagttcaaccattgtggaaagcagtgtagcaattcctcaaagaacttaaaacaagattataatttgacccaggaatcctaatattgggtatatacccaaaggaatataaatcattgtatcataaagacacatggcacatatattcattgcagcactattcacaatagcaaagacatggaatcagcctaaatgcccatgaatagtggagtaatttttcttttttttgaggcagagtctcgctctgtcgcccaggctggagtccagtggtgcgacctcagctcactgcaagctccacctcccatgttcacgccattctcctgcctcagcctcctgagtagctgggactacaagcgcccgatgatggagtaaattttaaaaaatgtggtatataaacaccatgggatactacacatccataaaaaagaacaatatcatgttctttgcagcaacatggagcccaaggcattatcctaagttaactaatgtaggaagagaaagaataataccacatattctcgcttataagtgggaactaaacaataagaacacatggacacaaagaggggagcagcaaacactggggcagacttgagggtggagggtgggagaagggagagaataaaaaaaaaaaaactacctatctgttattatgctgattacctggatgacaaaataatctgtacaccaaacccctaagacacacagtttacctatataacaaacctacacatgtacccctgaaccataaaataaaagttaagaatcatcgactataacatggtcttaccacttttgagatcaactcagcaaattgctgtggctaagtcacatttttagtcatgtcagtgttacctattctttctgtaattaggatctgcctaattgtaagacagataatttgatgaatgttggagttttattcttttatattaattttattatccagggatttataagaaataatatattggaagatttttgttttgtgtttgtatttctttatgcctagagtctttgtacttataatagctcaattcttatttatattactgcttacggaacattatcttgcctttcttaaaaaaaaaaatccatctttgatatcattactgtactgttaactaccactccatattatagtctatccccaccacttctcccctatgccccatgaaaattactttcctatgttgtttgaaggtctcatctccaggctcactgtcagtgtgtccactactacttctgctatttttcttctggatttcagtatccaaatagatgactctttcacctccttcgatgacctatctgccagcctaccacagccactcactcttaagctctttgcccagacactttcattaccaattcaatattccttccaaaatctcaaacattctgctttctggccatgagttcatagctttccagtttattccctctattttctcaattccagaaatgtttacagcccactgggaaattaaatcaattaattgattgcacctttttttttcttatctgtcatgcaactcgtgtcctcacattcacccctctcaaaagagatgagctctccctccccagccattagccccagctgaggttttaatacacagccagcactaacttgtcagctatgtgagtaagggatatatattggaagtggattatctagccccggttgagaagcccccatataaagctgaacagatcagagaagagccattcttgctgagccctgcccaaatttcacattcctgggaaaagtaaatgattgttattttaatccactaacttttgggctggtttcttttacaataatgtataactagaagaggtggctattgagacaaaatcttgagattgtcattgccatcatttcttataaattctgtgattctcagagtgcacattaacttctttgagcatcagttccatcacctataaagataataataattcaaacctctaaaggttattttgagggctaaatgacaatgcattcaaagcccttagaatactttattcaaaataatttgtcaagttcctggctaacattactattattttgtactaggtattttccagttgggtacagaatattgtttccattttttctctcaagcctttattgacttccttatgcacttttccgattacatatgaaacattatattgtgtataatatatatagtacattaatattttatttagctttttaatctttcctatcctttccttgctatttcagctttttctgtcatttcagtggactgttactcattccagcctttctatctttttgctatattatttcaagcccaaatttggtttccaaatgctgcagggtgataacaatgcattaatttaataataaatgaaagatattaaatcagttcaaatcatactaaatgtttaatataaaaatgtgcagttgcctttattgctagtaaaacaaagttaaaaattaaatgtgtatataaattagctattaaatacttaaatacaaaatttgctaatgtaattcatttttacaaatttatgagtacacagtgaattagagtgacatgaattttttttaaatgaatgattctaaatttcttcaagttagcaataagatagttgaaaagcaagttaatgataaagaagaagggaaagtaaggacccaagagaaacttgacattgatcatcaaaattctaaataaaataaactcattaacattaacaggagaactgaactcctagaagaaaatttgaaactgaccaaaatcatctctaaaaatcaaattgtacaatatatcaattgtttcatagtgagactaggagtagtagttctgtttttttcaaagtatttacaaatgttgcatctatcatatgccaggtgctttgcattcattatcttatttaattcttttaatgtttctatgagttttatccatagataaagaatagaagtgaatacaggttcatagatattaagtggcttgaacaatgaaaaacagcaagtaaaaaaccaagtaagaattttacttaagaaccatctaactctacaatacaccctctttccaccatactacagatttcacaggctgaggatataaagttctccttcagataatgctctaaaattttgaaaatggagcataatgaaaaaactatcttcatacaatcatagcaaagcaggatctgttttcagagccaagttgagcaaggacctgaatactctcttgtaatactcttatgctacatgacataaaaacattttatactttgttttaatgtaaaaatgttatcaataactatagtcaacaagcacaagaacaaataaaagcaatttagtgcaaccaaacatttgatatatgtatctatatcttaggaatattacattttaccaacactaattattgatcaatgtaattataacttttccccaaaaattatgttgtcaaaaatctagattttggtcacatctaacaaaacacctgactgctttgcaagttaatttgtaggatacctaggaatagtataggaagagagattgaacagattttggagaaaacataaatattcagatattttagaaagaggcaaagattttttattagcagaacagttataagacttaatgttaactataaaaatagaactaaaacctaaaaactaaaacctggatttggtaccacttgtcataaaaaataaacaagataagccagtgtactacattctgggaacagccactagttcttttgtattttttttttctgttttgcttttgacatttaaaggtagaaaattgtgatgtattcagcccttggtatcttggtatcttagaaacaagcagcttgtaagaagcaccttaagaagaaaacattttaagaaaaatacagctgaccaatgtcaacatgctgtgtaggagtcaactcatagaaaatgctggtatgcaaaaagaatttaaccttatctcatttgaagcacggcaagactactcgaatatgtgtgtcatattataggtatgtattatgaattaaaattcatattataatataatgaatatgtatatttattataattatagccatatagtataaaacattgcaagactgttgagtatacctttcatgtgacatagaaactgctaaattttattacaaattcagattacataattacttttgtctacactatagtttaaaatttttcctttagtttagcaggcaattggagaagaaatgtaaggttttttatttttagtacagttaaatacataaacacacattctcagatttcatatgaagagcagacttgagtgcttctgaattcttctcagggactgtattagttcgttctcatgctgctaataaacacatacctgagactgggtaatttataaaggaaagaggtttaacgaactcacagttccacacagctgaggaggcctcacaatcatggcagaaggggaagaaagagcaaagttatgtcttacatgccagcaggcaagagaaagtatgtgcagggaaactcccctttgtaaaaccatcagatctcatgagacttattcacgatcatgagaacagcacaggtaaaactcacaaccacgattcaattacctccaccaggtccctcccatgacatgtggggactattacaattcaaggtgagatttgggtggagacacagaaccaaaccatatcagggacatatcctgtttgtttaagttcttgctcccatgaagaaaagagagagatttccatgactaaccattcacattagctccataatccatttgtttggaggtttccaaataagtgagccctaaaatggacagaacaaaaaggtattcaccatacatgtaaatattgcaacgtaagaatcacatgcatgagattcatcatacttgatttcaacaatttttgcctattcaaacagttaaatggaattaactacagagaaagatgaaaccctactttaagagaggagaggcggcatagaagaatcttgtttatcctggctcaggaacatatatacctagtacctatcttctcattcccacagaattacaacaacaccattaatcagctcatttttgctttcacatcaagttctagtttgttatatgctttttatgtgttctatcttttgtcattcccaagcatctgtctttttcaagtattatttcatatttaggttacaaacgaaatcccttagttaatctgccagcctcccttctctcctgacttgattccgtatcacactcttctgtcggtaaaatctcttaatcaatgaataaaatcacaatacatttctatccttgaattccaatgattcttttctaaatctctaattcattttaaaatgtgtagcatagaattaattcaaagctcttcctcaaatggctcaaactacttcattacttagtcctttacaaagtagttgtttctttgttctaatttactgggaattagattattttctcctctaaatctttatttctcctgccctctctttcgatcactaccatcctcatatgaaatttcttctgccatcttctcagctaaaatcactaacttacccagttctacttgaaagtattatttgacatcttgatgtgattactaatatgttaacaagaattatcctagagttattttatgcacttttgtaattaatgtcaaaggatttaatgaatgatttttgagtttatcaaatgatcaaataaatgaatttcttggtattaagtgaaatgccacacagatggagttaattataattatgtgcatataaactgtgttaagtacttaattgagtgatgcacagggtaagaaggcagaagctgttaagtgtgggcatataccactgcagttaacttatgctgttgattttatattatgcccggcaatagggactagtttaaaagtttggcaagaaaaagtacaaaccaccacttatcccttgctgtcagttacagtgtgccaggcattatattctaggtaattgtaataaaacatcgatgccattttctccggtttaattatattcaaatgacaaacacccaaactatggaccgttaatgagattgataagaaatgaccccttgattgaaaacatctattataattagtgatgatatggataatttcctatgtgtaatatataaactacatgtgtatatgtatatgcatgtatatacacagtatgagagaaatgaatgtgctttccaggatagacaacagcagtaaacgttatttttctatcgcattgtttatttaatctaatcttattcattaatggagaactaaaatactaagactgcaactctgtattctagatacattttcaacattgtcagtaataaacagcaaaaatatatataataggaaagtgctaaagttatttttaaaaatctccaaatgtagtttatgaaataatttaataatatttgtgattttatattgcatttcatggcatcttattagtgaaagtaatactgtttccccagattttggaacattttggcaaatttgattatgaagaatttttttctctcctgtgttgtgattctgaaccatatgtaacctgactcaaaaaataaatttaatcttcttattttctgcagaaattattaggacttgatttcatggtgtgtttttaaaagagaggaaattaatatgttgacacgattcttaggcacagctttaattttagttgttgttgtttttattttttttgtttttgttttttgtttgtttgtttgtttgaggcggagtctagctctatcacccaggctggaatgcagtggtgcgatctctgcccaaggcaagctccaactcccgggttcacgccattctcctgcctcagcctcctgagtagctgggactacaggtgcccgccaccaagcctggctaattttttttttttttttttttttttggatttttagtagagatggggtttcaccatgttagccaggatggtctcgatttcctgacctcgtgatccgccctcctcggcctcccaaagtgctgggattacaggcatgagccaccgtgcccaactgctttaatgtttttattcttttaaaggcaaacatcaatttttatggagcactttaagcaatgaatttagcaagatcaggaaaagtatacaataagcatagttctttctctcaaagaggtttaggtaggaagacaatagaaaaataaaaatatgcaatttaaagaaaatttcaagagagtagttgaagatattttggagtttagatgtttggaaactctttattgaacctctatcccattctaggtaggcactgcgagaagtcctaatatgatagtaaacaagtgagttgagagcagatgatgctgtacagattggctaacaaataagctttttacaaatgagaatttgtatagcaagtctaagaaaatagtttcaaagaagaagaaaaaatacgagctggatattcaagaatggatatgattgaaatatgtagacagagaagacagttttccagacatgtagaatgtagtgaacaaaaatagtccttaggagaaacactgatgcaggaaagtctaagtgttgttggggagttaggagattgactacagtggaggctttgtgaagggtgattgaaatagagtaagttagaaaggtaggaaaagaggctggagcctgattgtgtggcaccttgaatgctagaccaaaggagatggatttaggagatttttgtgtctcttactcttaagccacatgcagtaatccatctctattctgcttcttgagcttcatgttttatcccattaacacctcagtaatgtaaaataagctagaaggtaacaataagtatttttttaatttttaaaattttatgggtacatagtaggtgcatgtatttatggggtacatgtgaagttttgatataggaatagaatatgtaataatcatatcagggtaattggaatatccatcacctcatgcatttatctttgtgttaggaacattccaattgtactcaaagcttttagttatttttaataactaaataataataaatgattattgactgtagtcaccttgttgtgcaggcaaatacaagatcttattcgttctatctaaatatgtcattgcacccattaaccaccctcacctaatcccccactccctactacccttctcagtctctagtaaccatcattttactctcattttcatgaggttgatcattttaatttttagctctcatatatgactttgtgagttgcagaaatataaaaggggtgggagagttaagtgatatatatattttttaaactgatgtattatggtgaataaaaaaactattgctgattctggaaggttttctgaaatggtttgattagtttagaaaagtgggccctaagccaaatatttgtctgtctacatgcacaaatttatggttataattatttaataatagtgttagaaagttgacatttttatggactaaatgtttgtgtctttccaaaattcatatgttgaagtcctaatcttcaaagcaatggtttttggaggtttggcccttgaggggtgattaggtttaagtgagttatgagggtagaggctccaatgacatcataggggagagaaaagtagtatcttttcctcacccacggcaagattcgtagctgacacctctacaacaaaagaaatattaacaagagaaaaatattacaaatttatttaaacaaagttttatgtggcacaagagcctttggaaaggaagacccacagaaacagggaaaaccgcatacctgtatttttatgcttaggtttgatgaagagtagacagtcatgtagaagtatgattggacaaaaggcaacatgatctaatggcaataaactgggggaaacttagcaaggcctgtttgttcagattcttgttgtcatctctgtgtttttattcctttcttccacacatgggcagggcacttgttatatgtgagggttatatatatttcagggaagataggtcagaaaattctgttatgtctagctctcacacagaaagtgggaaaagatcagagagtgaccttcctgcttttgctgttttctcagttttcaaggtgccatattttggggtagtgtgtcctgtaccccatgaatgggattagtgcctttataaaaagtaggggagaaaatctttctatgtgtgcaagcaccaaggaaatgctacatgaggacatagtcaggatgacaaacctgagcaagaattccaccatactgacacttttggacttcccactttcagaactgtgataaattaatgtttgttgtttaagacatcagtccattgtattttattcgagtaacccaaactggttaagatagcattcaacattgaaatctgtatatttcagttcctttactttaaaaaatagatttaaaatatatattaaatcaaaccaatatattttttggaatatactgttggtttctgtttcttggtttttttttgttttgttttaactttatgtaaaggttaataagctgttcctttatcttacaaggtttgcttccttcactcattattttgttgacatattaatccatatagttgcttattgctgtagttgactcattttcaatgcagtatgatatcccatggcatctgtatacaatctctagtttttttgttgttaaaaaccatgctgctggccgggcgtggtggctcacgcctgtaatcccagcactttgggaggcccaggcgggtggatcacgagatcaggagatcgagaccatcctggctaacacagtgaaacccagtctctactaaaaatacaaaaaattagacgggcttggtggctggcgcctgtagtcccagctactcaggaagctgaggcaggagaatggtgtgaacccaggaggcagagcttgcattgagctgagatcgcaccactgcactccagcctgggcgacagagcaagactctgtcaaaaaaaaaagaaagaagaaagagagaaagagagaaggaaggaaaggaaagaaaggaagaaagaaagaaaagccatgccgctgtgaacattcttcttaacaagtgtaattgtgcaggagtttctcttgggtatctaactgtaagtgaaactggtaagttttaggataaggaaaccacatggattagacaagttagctgtcactttgggaattagagccttacctggttttcagcacagtgctggtaaactttgaggcactggattgcttatatgactaaaaatgggaagtagactttattgtgacatttaagtacagagtcctgatctgagtgtttcgaggagtaaatggtgtgtgtgtgtttgtgtgtgtgtgtataacagtgattatgttctactttgagttagagaaataaaaaaagactttatgttggagaaacaccaaaaacgtcattatgtaagctctctcaggaaataagttgaaagaccacccaaggctggcatgccacttccacatgttgtcgcaccagcctgccacgatcactctccggaagacctccccaccctaactattacacccaaatttcaggaaagaataggaaggacagagggcagaaaaagcacacattcccctgagacagccttacatgtttccagaggccccatccagtaactttgacttttacctcattagccaatactaaatcacttggctgccctattcttccaaaatgtataaatcatatgttttattaagctgggcatgttgccaccccaaattttggggggttctgtagcagaataaggatgaatattgataaagcaatcagtagtgtgccacaggatgcaagaaggatgtaaaaaaacagataccaactgtcttataatcatgttttctatatttagagtcatagaaatataaatttttaaaggcaaaaagaaacttcagatcccttcgcaaatttgctctttaaaaataaaaagatgcctagagaagataaatggctttcttcagtgcatagatttattagtgatagatgttgagccaatgtttcttgactctcatgtgagttttctttccgttttcccatgtgcattctcccctttctacctatatgctacacaggcagggtcccaacagagaacagatgtcactcttaagttacaaagttgaaggaagttttaaaaagaagactgtttaccaagttgtgggtggaatgttggggactaaagaggagatcagggaccccaggaatagtagtaacagaaatgttaccaatgctaaaacccagaaaagaaagtaatgtagacaggactgcattgacaggagtagtgaccttcaacaggaaacacagccagctcactgtcttcaaagcgggagccccagtactggtcacattttccttcttctgtctgatcttctttcagggttctccattagcctaatccaactgaggtcagagggtaatggagtttgttgttggaatccatacaggtcaatttcctgaacaaaaggtagctgaagaacagatttggagggacaaagagatttccagtacaatggctcattcttaggtaacagaaacactgtcttattagtataatataaacactctcttatttactcaaatatcttagagggcttctgattctggattgcttggcgtcctggttatcagtactcctttaggtttctaattagcacactcttgtgtgcttctttttgtctcattcttcacactccgagggtatcagcctgtctcatagggtgctggttctttgcatctgaggtgcttctcattagctacttgctggtactgggtaagcagttacttggtaacttgttccagtgtttccatgatgctttcctatcctagttgctatgccatagttctttcaagatatgaaataatagctcaaagtcctttaggttttttcaacataggaagcttgtaaagtgtcatagtgtaccacatgctgagctttcccaaagttcatcccaagttcctgaaagtgtccaggaagatacctggcaaaaactaagttctccatctttgatgatttctaacacaaagcgggcacaaatgcaagtggaattgaaatgcatcactataaatcacatagcagtctgtggtgaagatagtcacttcaattttattgtgtaatttgtgctctggtgatacttctggatctgattatgttaatgacatatagaattatatataaatcttcaaattaaaataaaatattcttacagagaggcattagaactttctaaaggaaaactggcttatagatttatattttctgctcaaaaaaggaattcccagatatctgacatccttaagcatactgtttgcttccattttcataattgtattttaccttccttttccacatctgtgttaatcttaggactcagctgttgacagttacgttgatttatcagcattagattctaatgggaaatgcactattattctcctcatgggtttgccagcctaaatatgtgacctttattctaccataatatcttttagaaaggatcagattgcttgatcttaaaagctgcatgtaaaacaatattaaataaattagaagtccattaatgctatcagcattatttgttagctcagatgagctctgtgataggtgatagtttttagcctatcacagagctcatctgagctaaaaaataatgctgatttggcctcatcatatttatgaaggagggagaaatagaagcatgtataatgtagaaaaacgtatcttatccttatgtttgcatatattgttgaataaatatagtttaatgaatatgttttctcacctttctttgcttgcatttcaacagagtacattataaacactttttcttttatcattctaaatatgccaagacaagattaaaagataaataacgaaaatgcatttgtatctattgataaaatcaatttgtagtcctttgtttacttttttcctaaaatttaattctcagaaaattgccactttattattttaggtactcacttttccagattcaaacttgtgcagtgaattctttatgccattctaataagagacattccatgcccaacttcaactttgtcaaccttactttgtaaaaatatatatcagtatatttagaattaacacgtttttctatctttttatttgttcagtggtctaaatgagattttgaaatctgcctgacagttgtttctctagcctttggtttcttttctgggaggtatttggaggattgaaattttccaccatgaagtcatacaccttgagcgtgaccttgttttttttttttttttttttttttttgtctctctacactaatgagaccctgggtagctcttatttaaggaagctgcttttgtctgcttggctaaattaaattgatcatagctgactgtggataacctgttgttatatttatttatatttttgagtacattcagaaggtctaaaaaattctcagctttatgttggatatcacaattaagaatatcacactgtattctttccagtcacctgctggaggcaatgaccttgtatttattttagaaatgaaactggatatatcactatcactttccctgtaatagctatgacaaaacagcatttaaaggtcaaatactacaggacttagtaaatacaaactatagactctacccttaattctgaccttaacatagcttagtataaaatactgatgaaaaatggcttctgcaataattgctaggattttgtttttttaacatactaaaatattatagaaacattacattaatgtagtaggtgaaagggaaatttattagtgtccacttgtttaattggttgtacacctagagacaaaaaaaatgtcaactttcaatagataccgtgagctatctcttgaaaataaacaatctgctaatatttaatggctacacactacatgcctggcactgcactgagagaaaaccacatctgaatgttctcattactactgaattttgagttttacgtaatttcaaactaattcagggttgtttgtaaagcaggttcaaactttagtgtatttaaatgtgttctctgttattttgtccatacatgaatgattctaggaagcctaggaaattctaatattaggcaaaaagactaagacttaaaaacagaaaagttttgaaatatttgtgttgcctttgtccttttttaaggtgttgggggagaggggagacaagattcagtgtctcctatttttccaaaatctgtagcttattcttctatgggaaaacttttgccacttttattttctaccttaaaatgaaaatttgagcatattgaatacaatcttatccaattaattgtttatgaaagtgaaaaagttgttctgctttcatttctaatatacttaggaaacatctaaggctaaacaataatagcatatatatagtactgtgtatttatgcgtttgccttcatccttctcttaccaaatctataagcacttatttcactagtctagtcacatttctaaatctgagtaatagaacacactttttactttcaatgtcagtgctgtttttgttttcttcatctaaggaaaccaaaagcaatttctgctgtgtagcttgtcaggttgtatatatcatatatgcattccatatttgtttcctcagaaaaatatgtgaagaataatatttgcattactacagtggtatttccaaatttaactctaggcactttgagtccaggaaagcataaatatatcattgtgaagggacattttcattcctcactcgagtaaatcaagtgaggagtgggatatatgaacgtatgaaaactagccagtgatgcttacccccgacaatgcattcatgattaaaataatacctaataaatttgaaatattttgcattatttcaagttttctattagtgttaaaatatatgctgaattgtttatgatatctgctatacatatatcaattgggagaacagttgatcagactactaaaggcatctgtttaatttcattaaatttaaagttcacatttcaaccatagttagaaataccctgaatcttaaggagagatactggtttcttttgtggctcagatgaagacatctggctttttaacttacaacataacttaaggtacattatcaaacaggatgacatttgtatactgttattaagtcagttcaatatttttcctagataccactcatatcaatcactctgctaaatgtcttggatacaaagatgtttaggacatggtctatgcccttaggaaactttggttatactggtgaaggcaaacaaataaacagacggtacagcaatcacatgataaatggaagcacaagtgctgtggccatttagacaagaagctgaaccaggctgggaaggctgaattgaagggatgaaggtcgatctttgagaaacttacaaaatgagctgcatcttgaaacactgttaaaagtgtccagtcaaagagaaaggagaccagaaaacacactgagtcagagaaaactacctatataaaagcatggcaaataatgaattggcttgtttggggaactgcaagtagctcagggtggcaggagtacaatcttaggttttgttataaggcttaggaaagttaagcagtattgctcaggagagatgcaggggatacatcatgaccaagtttttgtgattctcatgagaggttcaacttactcttgaagctatgaggaaactttaagcatgggagtggcatgatttgacgtgtaactagatgctttgaagaatggactgaaagggagttaaactgagatggcaaattattaaaatttgttttaaaatttgtattgatctagaaaagaaaaaataaaagataaaacattgttttcattaaaacaaataactgctatatttttcaatttcagagcaaagtaaaatcatggttagaaaaagtcttatgtagtcctagaaataaaagaggcagaatcaaagtccaaggttggtgaaagaacaggtggttaagtttaacatttaaccactgcttacaagatatgacaggatgatatctaattgtgacagagtgtacggaagtgtaatttggttttaacaaaaccttggaaagtaaacaactgacctcagaattattaagggtcacaaggaagaaatgcacaaaagacaagcatagttattaaggatgccaagtcattttacatatggcaaatatataataatagaagtaacctagggcctaagatagtctcaaatcaagtgataccataagactgccctgagataagcactaggcaggaatgggaacctgtgtattgtaaagagatgggacaaaagaaagattatttttaattgtcatttgtgtatgtttgattggttgtttgataagtatgcactctccaggctgctagcctgataactatttagtatttaaatggtaacagtagaagcagatactgttcagctgttcttctgtctagaagctctggacccacccagtggagaaaagaggagtacagcatggagtcaatcaagtgatactaaactcatctagggattcagagaaaacatgttttatcagcagcatactcaggttaaatgaattcagtttggacacacagatttgggatgtttgtgtaaagctgagtagagacaaatgcctccatatagataagatgagaagtcaagagagaggcctcttttttagatgaatgatattcaactctgttcacctaaataattgagagtaacccaggtttgtttttagtctgttgattgttttttgggaaggtgaggcatggaggagggagacaagattaacaaataactaagatggtattggagtgagacctgtgatagttcactcaatagtaagactatgtaagattttctcctgcttagtctattgagtggtagctcagagtccctgtgatgccttcagatttatgttatgataggctaatattggcgaattggccataaagatttgctttctgaaactgttgttctttttcccatggtctaattgattaatatctagggtatgctgcaaagttcaggtatttactgttttttcttacactttggcaacaatttgttgagcttcaaaatatgtgaatcctgctttaagattgcctttaatttttgtattgtacattcatagagatattgttgatcatttagtttcctaaaaaaagataatttattatgaatctatttttttcaatatttcagccaagcagtagattattgtctttgaaaacaccttgattccttattgcatttgtctttggaaatgtcatagtgcattctaaaataaaaattttcctatatggctaatgttatcaagatcactactttaaccaagttttcctgccccttcatatccttatgattatttattgccatttaaaatactgaatattctcctttttcatttctacctctgaaagttttcaacctaaattttgttgacagcccacccatcttacttacgcaatttgctcctgcatggtgtagctaacaaactatggaaaaatacataaccaaaaacaaatctgaatatcctcaaattggcatgtataattggaatcatcagtcagctatgtcattatcaatgtgttgggctgactaataataaccgtattgctattatttattctctcaaggcaccgactggtttacaaagaatatcaatacatttacctcttctggcaaaatgatactgtatctcaacagtgttgaattcaggtaaatcataaaaaatatctgaaattaaaatatttatttttttattcctgacttactttgatactctattcctttgcttggatctcacattcattgtgaataataaatgttctgggatttaacctcttgtgagttagctatttcctactctaagtttctgtaaaactttttattccccaaatggaattgtacgcatcttattttttgtccttaggcaactttctaaggtgacttaccactaatctagcatgtcacttcaccataatcgattagagaataaaaagaaccctttgaatcattccccattttaaccagacactgcattttcaataggtggcaaaggcaagccaagaatgttcaaaactaatagcaatctttctgcatgccatcttatgtgcttgatatacattcactctaacttgttctccttttaattggagggtccaacctctgccatttttattaacttttatgctattcagttcttttcatccccaaaataatttcttatgagatgatcctcatgctctcttcatcctttgtcaatccgtgctcacccagttccagcctcttggggatcaacctgaaccctactggggcaaactatacaacctccaggccatggaaggaggctatttgaatactgacttaaatgcaacatacacgcattcaaataacagccttccagagacattgccattgattttactttcttatgtaaatagagagaagcttaatagaggtaatttcaagcctctcagaagaagatatgggagagatttctgagtaggttattctttgtctttttttctgtcatcagagaattaggtactatcctcccaaacctcatctgcagtgtgattgcagttgtctcccttgagacttacactgttcccggctccactatccatagaacctggaggtacagtgctaccacgtttgcttgtacataaaggagaccacaatgctacacttcttctaggccagcctggggtagatatacacagatacccacacctcaatatacgcagatgactttgttaacctttattcccagtgcccaaagaaaagtgaagatgaaatgctttaaactcactgaagcagataaatcattttagaactagctcaggaaaatctggcatgagtcacagaagctatgcacaagagaaatcattaagctttgaatgtttacttcctttcctgaacagtccctgttgactaagaaatgtatgctgataattattaaggtattctcttgctttgtcagtaagccatactgttgtttccctccacattggaggaggttaaggcaagacacctttatgatctgtctggatatattccttaaagttagtctgccaatttgtggcaaacttggcattctgcttgattaaattataattcactcttctacaggaattgcactaagtggtgtgctcccttcaaaaattgccagtaattgtgcttcatacccaaagtactcagaattgtgggaactgttggcattaagtaatattaggatttgaagcaaataagagttctactgaaggagtcagggatgctccatttctgggtctatttaattattttgcccatttcttctccattcctgaaaacagaaatctcataaatggattataatattgcatttgcctttttcttaatgtttttatcattcagaaatgcagtaaaaatgacttatttcctaaaggtaaaataaccttcattttcttctctgtgccataaaaaatagctagaatatcctcatgagcatgatttcaagtggaatgcactaaattttaaaggggccctgcttcgctttattttctttgactagtaatactatgattgaatatgcatttttttcctgattttagataactgaaaggagctcatcagaaataggaattacgcctgaatcaccattggtttagtcttgtaactgggtagaataaaaaaaaaaaacagaagttaaaagaaagagagggaaaataaaacagattgttgcaaatactcttttctctgtgcttgtttgctaacagatttccaaatcagtctacatctgaattgagagatatgcctgagagagaataatctgggccttgaaaagaaatctgtatctctcagtctctctctgtctctctccccaactcttcctcatgccctcaccccaatgtacacacacagagagactcaaatgtaatgtgagtggagaatttatttatcagagacaagtgattctctagggatttaacctttatgagtgctagtaaaagggtatttagcttgattatgttgatctaagaagttgtgttttgcctctcttaaatactatttggtatttgaattctctgtgaagttgtctgtgagatcaaggagtctacacatgataaaacttacacttgtatacagcttatgtggatttagacgtcaatgctaaatgttctctcagatgggtaactgacacagaagcctttcatactaagaacacactgaatacacaacataggataagaatttaagttgggaattaggcttctaaaaatagctttaagtgcttaatactttctgcctttttacacaggcttacacagcaggggatttcctaggcttatcttgttatacttcataatcaataaacaaagttctagcattacttgtaattgaagctttatttatttgtttgcaatttaaagtcatgtctttagagttgaggaacatgcgttgttgctgagttatgtaattataacttagctgtaaataagaatatgacttttaaaaatacttttttaataaagtaagggagtagttttaactgacgtcattcatgttctaaatgttcattaaaataactttagcataggagaatggttctctatataatttgattagctacagatctcataagagtacttttgcctgaaatagataactctatggaaatattggacagtacagatcatagtatcttcatcattttaccaaatagattacaataataattagatttgcaagcactatatctgcaatcagcagcctagagatccagtagagagatactgctacctatcatgacccaataggctactgaatgaaactctgaactttatccacatcagtaaatgaagataataaagactgttcttgctaccacaaggctcttgtgataatcaccatgtctattaagttccttgtaagagatctatgcaaactgtactcatgtttctgctattgttagttgtgctatggtcagtattatgattatgcaaatataatgaaaataatacttgcaagcacatcagacatgagtttgtattttttgtttgttttgtttttgttttgttttttaattcttagacaaaccagatcagaccttgggcaagtaacttaatgttttccatgaccttaagatgtattgttccttacatactagatttgaataaagttgggtaatctgaatatatttaattatttgtttatttatgtattttgatcttataatcatggagattctgaaattcagtgtacttataaaaaggataaattgttatacagatcccttacaattccaactttctatgaattgatggataaaagtcagtctaccataaaaatatttaatgtgccactattttattttattgtactatcctttcttatgtctggtagtgggaaccccaacccagtagtaaatctaggtagaagaaaaaaatcagagatgtttgcaccatgtcatcaaaattgcgtggacatgttaagtgttaagggtaaattctaccattactaagatggaattttagaatctgtaaaggtgagagcatgatttttgagataatgggaaagctctttttaacctcaatataaataaccaattactacgtaagctgcttatcagcatacacatttcctttctctatagtttaagtttgtctatattttagttatgcccatctctaagcattagattttaataaatttttcatgatttatgtatttgcaaagaggttagaattgttactcatagcaaaacgtgctatgaacatatttttccattaaaacacacacatcggtaagaaatttatcccctcatttacaaaactctttcagttggaaaacagaaagcttattatttattagctcttttatatagagcttgttaatatagcagccttttatatagtctcttgtttaattatcataaaaagtccaaattctttccacattgtaccatctatcatataaattgaaatatatgcaaattatctagaaataaaatctaatgccttactctcatatatggtaaaagaattccatatacaaaactgcatatttaataaattttatgatctgataaccgacataaacacccaaagactacacatatgattaaagacattcttaactcttctgcttctttaatgcattaggcagctactttgtttataaagagcagaaacttgagcccagcacaaaaatatatacaacgttttttgttttcactttaatttcactttgttagtagtttttaacactccagtgtgctcaaacctcaaaatagcagcattaaacacttcaagaatgccataaaagagatgatctactaatttgagaatgatcattgtaaagctgcttggtgaaagttcataaaattaatttaaacgtgcacattaatagtacttagcaatgtaatgtcatgcctgtcattagaaagatgaagaaacactctgagaagtatatccttaggcaatattatcattgtgaaaacatcatagatggtacttacacaaacctagacgatatagcctactacacacctaggctatatggtatggcctattgctcctaggcagcaaacctctacagcatgttgactgtactgaatactgtaggcattggtaacacagtaagtattggtgtatctaaacatagaaaaggtataataaaaatacagtataaaaaataaaagggtataacagtgtgaaagataaaagatggtacatcgtgaatagagcttgcatgactgaaagctgctctgggtgagtcagggagtagtaaggcaacgtgaaggcctaggacattactgtacactactgtagactttataaacactgtatacttaggctacactaaatttatttttaagattttctttaataataaattaaccttagtttattctaacttttttactttataatgtttttatttttatgtttttgactttttttgtagtaacacttagcttaagacacaagcacattgtacaactgtataaaaatattttctttccctgtacttatattctatatgatttttttctatttgattttttctttacttttaaaacttttggttaaaaactaagacacaagcacacacataagcctaggcttacacagggtcaggatcatcagtatcactgtcttctaccaccacaccttgtcccactggaatgtcttcaggagcagtagcatgcaaaatgttgtcaactcctatgataaaaatgcctcttctgggccgggcatggtggctcacgcttgtaatctcagcactttaggaggctgaggcaggtagatcacctgaggtcaggagttcgagaccagtggtaaaacaccatctctactaaaaatacaaaaagttagccaggcatgctggtgggtgcctgtaatcccagctacttgggaggctgaggcaggagactcacatgagccaggtaggcggaggttgcagtgagccaagatcgcgccactgcactccagcctgtggaacgagagtgagactctgtctaaaaaaataaaaataaaaagcctctctgcgatgcctcctgaagaacatacctgaggttgttttacaagtagctttatttttgtataagttgaaagaatacagtaacaataaaaaggtagtatactaaatacataaactcgtgacatagttgtttattatcattttcaagtattatataccatacataatcatatatgctatacttttatatgactggtagtggagtaggtttgtttacaccacattgccacaagcagatgagtgacgcattgtgctatgacattatgatagctacaggatcactaggagataggaatttttctgctccattatcatcttcttatagaaccactgctgaatgtacggtccatcattaactgaaacatcattatgtggtgcatgattgtacttattttactttgtccaggtgttgagtgaaagcacatcactcagtgtttcagattgaacctgtcaccctgtgccatctgcacctttcatactctggagtgctgagcctcgggcaaggattttcttctagaggactgttcctatcagataactgtatagattgcttgatcccaggctttggggttaggtggaaagaagaattcattaaaagtttttgactaataggaaagtataaaactaaagtacaattttaaggtcaaactatcttcactgacctcacactctccaggaaattttacctcagcgtttttctctaatgaaaaccttagataatttttctctaaatgtccttaaggtataatagaggctctcttttggtggttgagaagaaacatagtttaaagaatttctctgttatggttatgttcttaaaatgcctgaaaatcctatgtataattatcatgaattttattcatataaaagtataattatcatgaattttactcatataaacggttatgacataaatggctatggtctttggaatgaagagagtttatagtgtggttcagacagatctgtgattgaattccagatttggcacctacaagtgtgtgaactaaagcaagttatttaatttttccaacgtttgcatttccaatccataataacaatatcaagttaggtttcactgttaagaagagcaatgagatgatgttataatagtaccttgcagtaaataagtcctcagtgtatgctgatttcttctatgctggctttatattaatgcatatatgcttgcatacacataaaatatattcactaatacttatatataaacatatgtaaaatatgtttgcttatatttatttatgttaacaaagaggtaccccatagaaatatttgatttacttgaaaagctaattgtaattgaaacatcacacttacagtatttaagtaatgtcaaatttggggcctgttttataaatagtaccaatgaactcttagtataaaaaattggatgaatgaacaagtcaaatttaaaataatgcattgatttgtttaatttttatttttaaaataatgtaccaatatcaaaaaaataagaaaaaatctgtgatatcaagcatcactaaattttaatttataagtctatttaatgcaaattttgtattttatcatcattcttgaagcaagaaaaagtacacttagaacttgagtgattaattgaccatggaacaagttgagaatgaactctcaaaataatcagacatcactcttcatggcaacagtaatttagttatgcaatacttctatattttactgttaaaaactgtttaaaccctcttataaggcaaaaggttgttatcagaggtacaaacgttttttacgcagatcatagcactaaatataagaaaaatacgccgggcaaagtgtcttatgcctataatcccagcactttgggaggcagagccacgaagattgcttcaagccaggagtttgaaaccagcttcagcaacatagcaagaccttatctctataaaaattttaaacataagctggtcatgttggtgcacgtgtatagtcctagctactcaggaggttgaagcaggagggtcacttgagcctagaagttccagctgcagtgaactatagttgtgccaatgtactccagcctagggaagagagcaagaccctgtctcgaaataattaattaattgattaattaagtcaaaagtcattctatgcccagggttggcatccttaacgcctgcattgttcaaagaccaactgtttacagataataaaattatggtgtattcaagtaaacacactctttttgacactgatgacctgttatacttcttatgactgcaaatgaattatgctacactatattcttttccttaagaacttttaaatgcaactttctatctgattggcatttccaaaattgataaaaatgatatgtttatgcaatgactgcaggaaaaaaatagacatggtgatcaacattctgtagcctagctctaaagaatttatactctactcatggctttctaatttcacctctttattatccattaattcttcaatattttagcagttggtttgtgcacttcagagtctctgagtgccatattttagattttcctaagattttacctacttcaacacgtttatacttgtatttgcttgcaaataataaagaaaaattaattctgatattcaataatggaaagttttggccccctaaattaaataaatttcagctcatgtgaaagctagtggactggagagcttttgttcccatggcaggctactgagtggctaagtttgaattggatatattatgtcaggaggtctaggacactggagaataaatattcctttttctttctttttccttttttttttttttttttttttttttttgcaaatagcccttcatcctgactccctaaatttagtaacaatatggacaggatgactagaaagtattttcattcaagcctatagaaagctcaaaatgcattattactaagagaaagttctcaggtggaataagcaaaggtacttactatgttcccattaatttgactcaatatcttttcctcaaaaaaaaaaaaattattttcagtgatgcctaagtgaagtgattaactaaatgaacacttttaataacaaaaacataatctaaaaggaacaatttgttggtacattgttacctaaaatgaaaacaagataaacctcagttgaaacagttcccttatattttatttgcttattgtctgtgggattcagattatatgaaactgggtatatttggactgtatggtaaaacactttgagtatacagtctcccattcgcatataatatcatattagtaatgtacactaaaatataatacagtcatctttacaaggtgaaaaaggaatagccatgtaacacaagaaaaaaggcagaatgggattacaaacattcctagattttcacaaaactttctcagatgatagcctaaatctcccattcaagccatcattcaatggtagtagattaaaataaggcaaacaggatgcccgaagtggggcaaaaaaacctatgacttttgtaggcttataaaaatgagagcagtgtaatgtaataatactgtggtccttagaaggagactgcatgggttgaaaacactgaatcttccacttacaaaattttaaccctgggcaagtcgcttaggttctctgcttcagtgtcattatttgtcaaatgatggtaagaatagtactcatgattaaactagtttaacataataattggtgctttgaacagtttagaaccatgtacctgatttataatatactgcttataaggataacattttgtgtgtgttttatcacagtcaatctattttttctccttgagccctgatatggtttggctgtgtccccaccaaaatctcatcttgaattgtagttctcataatccccacatgctgtgagaggaacccggtgggaggtgattgaatcatggtgggggagttatccccatgctgctgttctcatgatagtgagtgagttctcactagatctgatggttttataagggacctttttcccttttgcttggcatttctctttcctgccaccctgtgaagaaaggcgtgtttgcttccccttctgccatggttatgtttcctgaggcatccccggccatgctgaactgagtcaattaaaccactttcctttataaattacctagtctcaggtatatctttattagcagcctgagaatggactaatacaagccctttgttcctgggattttaatgatatgtaggtatgatggaggaggggttaggatgtcattcctctacttggaattctttcaacaccagcctcagaatctgctacttaaatgctcactttcctttgttatggttcacttggcccttgcaaacacaagcaatgtgtgtagacaaaattcagtgtctaaagaaagcaatattggccttgtagagtaacagagaagatccttatgcctaatcattcactcttcatgaagaatagcctaaggaccagatacagtggcttatgcctgtagtctcagctactcagaaggctgatatgggattgctggagcccaggaatttgaggttacagctcaaattctatgagctatggttatgccactggactccagcttgcataaaagagtgagacaaaagaaagaaaagaaaaggagggagggagggagggaaggaagtagaggaaggaaggaaggaaggaaggaaggaaggaaggaaggaaggaaggaaggaggaaagaaaggaaagaaaggaaaggaaaggaagaaagaaggaaagaaagaggaagggggagagagagagagaaagcctatatttcattaatccttctgaattttccatgaatccctaatattctacattctgtagatactgtcttctcaaaattgttattgttgttgctttatacttttatattatttaagttctcatttcacttctcataaacttgtaataacatttatactgacttctgtatttggtccttattacatccttcctctacctcaggatttttcagcctcaccacagctaatattttggacctcccaattttttgttgtgaggcaggagagggagtctcctctgaactgcagaatttttaacagcatcactggcctctaccctttagatattaatagcacctctgccagttgtgaaaactaaaatgtctgctgatgttgtatgttgccatgtctcctaagtggtaaaatcatccttagttaagaaccagcactctgcaattctgcctgatcaatcttcctaaaatacggtttagatcatatcattctctgctcacaagttttcattggcttcccgttttgtactgaaaatgtttaaggactcagactctggtcatcactgtgttgcctggtatgttccctattctgtcatatttctggtatgctcctcattccctcctgtttcttctctacaatttagactggctaaaattttatatatgtacacacacatactatggggtttggtaacttttctcagcctccaaatactcctactccccatcaaacttcgtgttttagatttttacctgcatgacccatggtcttactcaaattccctcacacagtagttcagtttaaacccctgttggaattgagatggtccttgttttttaaacaaggaccttgtttaattaaaccttgtttaattaaaactcagtataaaagtggctaaacagagcagtgaaacaaaatattgagcccagacacaaataccatttttatagagacaatatataataaaagagatatatttctctatatggagacctgttgatttactaaaagttatatactggcacaaaagacattccattaatttagaataaagaaaatgtgaacttttctatatccaaaaaaaaaaaaaacctttctctaggtaatacgtgtaagtataagtaaatataaaaaataaaataatctgaaaaaacattcaggacataggaataatcttatttagagatagctttttaatcattatgagaaatccagcagctgccaaggaacttacagatttaattttcctacataaactaattgaaatatttatatgagtaattatatgattagaaggtcaataggcaaatgataaattaggaataaatatttatagcacatatcagttaaaggggtgatacccagtcttcaaggaggcattgcaaattaataaggaaaaaaaaatttcattagagatgagcaagcccatttggtaaataaatacatgaacgccttctcaaattccttggctagggaaatgctaataaaaataacaatgggttattatttctcactctataaggtgatacagtatatttttacacattggaaaaggtactgccttttaaatcaatctggcaatatattttaaaatcaaactgaaaatcttactctttgaaccaacaatcacactcttgggagtgttactgacagaaagaaaagatatatggataaagtttttaattaaagaatagtttgtagtggcaaaagctggagaacaatggaaaaaatgactgaattaactatggtgtgatcaacaaactattacatagttatgtgaacaacagattatttggaggcattttatatgtgataacaacaataagagcatatataataggattcatttttgtgggaaaaaaagccagaatcatggatttgtgtatgtgcatgtgtgtgtgattatatgaacatggagaaaggcacagaatgatccatacctgattttggggaaatgtaggtagagaaagaggaatggaaacatgtgaagaatggaaaatagaaaagttgctaatgattttaaaaataagaaagcattcttaggctgggcacagtggctcatgcctgtaatcccagcactttaggaggccaaggcaggtggatcgcctgaggtgatggaatttgagttcgaggagttcgagaccagtacgaccaacatggtgaaaccccgtctctactaaaaatgcaaaattagctgggcatggtggtactaatcccagctactcgggaggctgaggcaaaagaatcacttgaacccaggaggcagaggttgcagtgagttgagattgcaccattgcactccagcctgggcaacaagagcgaaactccatctcaaaaaaaaaaaaaaaaaaaaagcatttttaatatatatttatttcaagtcatttaagagcatgtatacacaggtgtgtgttttgtgtctctagtgaaataaatgagaatagacatagctgtattattctgaaaaactgaattaaactttcttttccagctccataccctgcctccattcatacaaaaagaaataaacaataccaatagaaataaagtgtagtctccactcgacaccccattgaactttttattatttccattttatctaaatacctcaagatgctttaacaatataccttgtctgtacccttatgtggagaaaggaaatcttgaattagattttacattttagtaaatgtaaatataccatttcttgttcatggaccatctagaattttggaaatcttagatgtatttctgagtattatacattttcactgataaagtaaagtataaatttgctcattctccaaaataagagtttttgcatgagtttattatactatgtacatattaaaatatgacatacaactaattttcttgtgttaaaattaaatcttattttttacttttgcgaaaatacatatatagagaggataatttaatatgagcaggacttttattataattaaataatagtgaatttcactttaagaacctcaatcctttcagctaaatggggctagttattttctttattttttagcaactatgtgcagttccaaggtttataagactgggcttttcaatcttctgttttattgtttaaatctacaaatttgatgttggaaaaccctattaacaacaaacaaaactacccatatctattcaaaataaaatagcttgaaaagtttatgataatttaagagttaatttgacaaatgcaggtttggcttcattgatatgtgaccttgaagttgcacagagcccctcactgtcaaaagaaccctgtgcttggtttaatgttctgctcctgccatcttgaaactcttaataattttatctttgaacttatgttttgtaagtgaagtccactaggacaacagggtgtgaacatgagcagcagagctgcaggatggcagcatcacacacacagattcaggcctgtaggcacaggagacatgcaattggcctagcagcaaggcagcatatgcatcactcagcagtctagatgctatgtgtccctgatgtggccaaaccaggactggtcccagattaggagtgactatctgtagcagcaggagaagcagcagcaacaaaggcagtcgtgagagatgaaagtggctatccatgcaggcagggagaacacccatggtgagtagagagcttgctcatcagtcccaagggaccatccctgtagtatctaaacagatattaaatctcccacctaaattccaagacaatacccatggcactcaggcagtaaactttgtaaataaattattacaaaataaatgtttacacatgggcacggcagtaagcactttagaaagtcattagaattcctcagtgtttacaatgtccagttttgaaagctgctgcaaaattgcacagcagatgtccataaacttagaaatacaaattaaatttaagactcacatttgatggaaaataacacgatttttatatgaagttttaaattaaaccaattattaacaaggaagataatttttaaattaaactttctttgtaactaaaaatatagcaatacaatatataaacaggcattttaaattatatgcaaatcttgaaactactttcaattttttgcacggccttgacaagttacaggaaatatcagaagaaacactaaaacatccttgcatacatttaaatttaacattcaattcaataaaaggcagtataagtgacccttgtgatggaattattctgtgtcttgactgtggtaataaatacatgaacctacacatgtgacaaaattgcatagacataaatacacacacacacatataggcacacaaatgagtacacttaaattactgagctataaatgagatgagtacattatatcaatgtcaatttcctgactatgaaactattctatagtttgcagcatgttacctctggggaagctgagtgaagagtacatagaatctctctctattatttcttataacttgcatgtaaatctgtaattacctaaaagtaaaaagttaaattaaaaaataaattcagatataaaaactaaattcaatgtgaaattggtatgaaacagattggcatgataagttaaatatttattgaaaagttgttctatgaaaatcatcagctccaaatgtactcaaatatatatttttaaataaattatcagaagttgaccctaatctcacagcctataaaatactcctaataggtttaataacatttgaattaatagaaagatcatttttaaatttaaaaatatgtaaaatttaaaatttaaatttaaatttaaaaataagtaatcttccaatagccaagagcaactaatgtcattttcaactaaatcattgaaaataaagttgttaattgtataaattttgataatctaagaaatgaatttcagaaaaataagccagaaaaattttatgaccaatcaaaatatcacattaatacagtattatttatggtattacatataactatgacattaaaatattgatttttaaaatttgtaagcttatatttttactcatttatcactgttatcacattaggttttataaataataaagtagttttaaaggaaaaatctttatattttattatatttaataagtttttttcccgcattttgaaccagagccccctcattttcattttgctctggcttttataaattgtgtaatacttgaattagggagttcaataaaatttatccaaaaaataatttaaattttaacaaaaattagataagatacattggacagcatttttaaaaaattgagcttgcaattttttttaaatgacatcagaagttacaactaataaataatctcagaagtcagcatttcctattgttttctccaggacataagccaagatgttcttttgcctatttcattttattattttataaaaagccaacaagattcagccgtcttcaatcctgacacaaattacaatatacatcacttcgagagagggcttcaaggaagtctttccatttatcagacctgtatttccaatatatatttgttcaaatttttatttaaggaaagttgtagtggtaaggactatacagctatatcaatatggatttttaaaatctgaacttcatggttttgataaaaatgtttatactttggcctgtatgtgtcatactgtctgctgcatttcatagcttgcaaatatattattaatactatttgaccacatttccttgaaaccttaaagcattcattcttgtcattattacatggcataccattgtcccaaaaggaattttagttttaaaaacagcaaacttaaaactgacaaagcgcatgtaagtaacagcagactgtttccacttcatcatagtaagaaagatttgaaaaacatcatttaattcacagttagtgagaagtacatttgtaaatgctccattgtaaggatttttccagtattcagtattttataatgcttctgtgtacaggtcctactcacttttcattctgccatcctaatggctcagtcaattttctttttatcttatgttgcagaatgattcttggggaaagcagtattcatacgcactcttcaaagctatgagtcacatgctgtgcattgggtatggagcccaagccccagtcagcatgtctgacctctggattaccatgctgagcatgatcgtcggggccacctgctatgccatgtttgtcggccatgccaccgctttaatccagtctctggattcttcgaggcggcagtatcaagagaaggtaatttgttttatttatcgccaatgtctttaaccagctaacctgaaccagtaaattgaattgtgttcaagataactacaccatctcctctataaaaaaaaaaaagagataaaatgtttaaagtaaaaacacactatcttctttgatattttgaggtttcttcaagatagttctcatatcttttgcttctcatttctcagttgaataataatctttttaaatgtgactttacatctacagaaaaaatagctatatatttcaaaatgtaaaaagctgatagaagatgttatcatggctcattttctatcatatgtcaatagttaaaataaacccttctctcgtatgtgttagaaaaatgttagctgattaagtggagacaggcagctattgtgcatgtccctctgtaccccccctcatctataatcataatttatattacaatccatatgcttagctgagcatatattacctgtatatctagataagtcgccacactctccagtcttaaaactggatataacaactgctgtgatgcattcttatgctcaatgtgctaattaaaatgattgctgctctaaacttttctcacaagagagagaaaaagtaaatataggcaatgatttattcattggatttttttttcccacatgaagaatttctttggctagggctaaatatagggtattgggacagtactaatattcttgaccaaacatcagtagctttctgacagataaataagaatattttaaattaatggaacaatgtgtaatgtaggggctttgttgatcctgacagagtcatgcaccttgccaaagagcgtttctgaaagtaatgattaaaatggctctagaatatttctcttggtgagtgataacagcttagtctcagaattgttttcaaaacatccaaagaagttttcagttactgctttatttacagaagttttcaacactataatcacacaatatgagaaagggaacctagatatttcccttgaatataattatactgccactagctattacagtgagcaagttggcattttattactgaagtaatgaaaagataaaccacaaaaattggtttgaggttcatttttaaatagtctccaaatgaattggaaagaacgaagaacgtagtaaggaagaagagactttatacaatgctgaatttaactaagaattatatacttaaaggaatttgggctaattttatggagatttaagataagactacatcacgttaaatctgatgtttctcttacactgttgcttttctttcattttatgttgcttttaataaaaatgcccctttcacacttttttttttggtctgcatcattgctatacattttctcaataagaaaacaaatgtttaacttccaggattgcagtgattagcattttattgcatattaaataagttcacaaagtttatgtttttaaatttcctgtattagccaagtttaacttggaaactcaatgtattcacttatggaatcatagatatttgtatgcaaagatgttatgattttgtaataattcaaatcatgaagttcttgatcttataagtgtttgatagaggacaagaaaactagtataaccctttggtatttactggcatttggaacaatgtaatcaggaacagctgattaaaagaatataactttttttttttgaaatggagtctctgtcacccaggctggagtgcagtggtgcaatctcagctcactacaacctctaccttcggggttcaaatgattctcttgcctcagtctcccaagtagttgggattccaggcacctgccaccacgcctgactaatttttgtattaaaagaataaattttaggtctacaaaccaagttctgccaagaagtttagttctaaagttctgtactcattttttagtcagtgtaatccaggataggtcttaaggacattatgttactttttaaaaattttactttttatgaaaagtatatgtttaaatttcaatttaatcttatagcatggctttacatagtggatgagtaatgtgcagcttctttggtgatttgccctctttgagttttggctaaattattatctttttatttaggtaaaattctgataggaggcactcttgggcaggacccaaaatggaatgctggccctcctatatggttcagatgtagtccacagagaagcactcatgcatccttctcctagacaatctgttagcactcctcttccttctcttccaaaccaatgaggagagtgtatctagccttccttgacgatagtcagactccagcgttcgcagactatttacatgttgtcagatattattcagagtccagatccatgtctcccaaccacatgagcttatttcaaagatccttaaatgaatttgtttcaagtgttttccatatgtcaggtgttagaaagtagccttttcacacccctatcccaaaagaggttgtaaagggactcacagcagaggaacttctctctcaaaaggaatgtattcactagttctatcaggaaaaatctcaccttaccccctgatctctatatagaattgataagactgaagcctccaggagttatgatcctcagatcaccatttacaatttttacttgcatagaagacagcctcttacataagcaatattctgataactctcagatttgcagttcaatgagcataggacagattcagtccttacttagcatctttttagaccattctttatctcatctaatccaaaagcgtccttcacagacatgtcagtattatgcatatataaaaacaatgccctggtcaaataagttcagaaatgttgattgaaacaatcttacagaagtgttttttagtgtaaatgtgtgtgccctgaagatttaacatgccatctttgaccttcatgccaagcctccatagattttaagttactaatgtccaaaggaattaacctataaagacaaattctccatgatgaccattcttttatttttaaactgattttgagtggtcactttcttttctagatataattgcacttcatctagccttcatgaaatgaaactccttttgatcaccttggttttttatactactacatcttagttcatacatttggacactcctgggaagctgactattatttctagttatgtcgctgtctccaatcaaataactatagtaatagaagctttatgtgttcacttcttcctctgcaatgagcaagaattttggcacaatataaatcatgacttaagattcagggatttgcaactcaccttggtatacttgatatacatgaaagacttttattgtgtaaattaaaatacgaatatcaccaacttgaatatgaccaaagaataactttaaatatgtgaggaagttatcaattccaaatccctttatggactgaatagcatcctgaaactgtgaatcagactgcataattccagggcaggtgcaaaatgagctgttaaaatggactgtgctttctaatggcagggcacaagataccaagccaccaagccagttctatacctagattcaaatattgattatgttatgtaatgtccaaagaatgtgctgagtctcagtttatcgagtatatgaaataaaaacgctaaacttctccaaaatgacaaatttatcaagttttgttaatcttggaaagagtttatgtgatggctttttttttttttctttgagatggagtctcgctctgttgcccagactggagtgctgtggcgcgatcttggctcactgtaatctgcacctcccgagttccagcaatttctgactaatttttgtatttttagtagaggcagggtttcaccatgttggccaggctggtctagaactcccgacctcaagtaatccgccaaccttggtctcccaaagtgctagggttacaggcatgagccaccgtgcctggcctatatatgataactattagtggccttttggaaaagaaggtaaagtttaatgtaagtactctctcagctatacaaaggagtaatatgtaatcattatccacctatataaaatgattcaattttatgtaatcataccaaaaaataatgttctaaacctatttagctcaggcaaatgtttttgtttaattgcttagttttaattaatgatccatagatccttgttttttcttgtaaatgaaggcccataatcagaactgccacataaatttattccatagatacatttttaatttttttaaatcaacctaatatttcaaatttgtgtaagctaatggtacacccagacacaaaaggtgagggaccaaaacctgctcttatcttcaagctattcaaatcccatttgcaatagagtttatttcagctcatttaaaataaaataattatggttaagatatatactttcttggttatatgctcttcaagaaaaatttggatgtaggaggagtggcgccaaatcaactcttaaggatccttaaattcttaaggatcattgttctctcaacataccaagtgattcttaccttcactccacccccttaaatacttttacccctttcactatttacatagattctgccttttcctttggaaggctgtgggaatgtttcttgatcatgccattgtatagtcatttgtttaccgtatttactctctctgtccagagggagtataaggaccattttcttatttttattttgcttgaacacagatcactttttagaaatgaaatattcaatctgctttctcttctagaattctgagatttatttccctgggagcaagaggcatattatcaaagtgcctctcatcagatttgaagccatttcttagtcttgggctaatcatgggtgtgttctgcttcaggagatgatggagcctcctctctcagaaagacagatgggagagtttgtcattattgtcatgtaattctaagtcttcaattttttaagctatatgactagaataatggctgagcaaagaggaacagtttggagtaatgcccataatcatttatgaataataccattatttagttttaaaagaaaaaagttacatcctgttttatagcccatcttcattacatcaagaagcttagttgagttactaatttggtttgctgattttgtagcattcagtagcatctgccttcagaagagcagagggactttgaagttataatgatcttgaccttgaaaaatcatatcgactgagtacttaaataaaaaatgttttgataccctaatgtgcattaggattattcttaaggggaagagctagctctgagatccaagtgctttcaatcaagcatttcacttggtttccttcataattcttaaatgctttcctctttcctttacaaataagaatgccttgagtacaactcccacatagtaccttagtcaaaaattttttattaggctacagcatgtactttgcttcccgggaactgaatttaacataccgtggtatgttaaattggtagtagagccaaacgttctcaggcgagggagatcctagggctgggaacctctgtgagattctcttgcaggaaaacaccagtgtgacaatgcttggaataacttaatgtagccattggagttgctagcaaatcaggctcctggtacaacaatgttgctttatattctcatctggggcaaataatttttatattaactaagtgttgttataaagtctggagtaagtctttataagggagggagtttgagacttaatttaactaaatagaaaaacagaaacttaccaattgtaaatcacatatcccatgatttttcaaactttgtattttgatataacccactgtggcatatggcatcccttttccccagtgataatttctgtgtcaatgctctaagttatatgctggaatgccctacatgtatattgtagatattcacattttcaggactgtgcaaagtgctaaagatttctccatactaaaccttaatttagttttttgctgtttacatttattattttttacagcacatatgttagcttctttttatagctctaaagtagagctgtattttccatttaattaattgattatgcatttgatattttagaactgtttgaatttttgagtttactccccaaagttctctttcaagtattcttactgtatttgtattccttatatgtcataagatagaaacaaactgtgaagcactttcacagggaaacctggtgaccagggagccactaatctgataagaacccacattgacaagaatcaacctgcatgtaacttgtgtttggttagccgctttactgggatgcactggaaatggaccttgaagaatgaagaggtaatcagcaggcaggattagtcaccatgagagaaatgtctcagaaaaatgtccaaattctgagagaatttctggcagacaggaacaaagtgtgcaaaggccctgaggtagagatgtatgagacatattgaatagtctaatttgaatgaaacaatagctaccttgctggggaaagtgtgaaatagcctagattatggccaaaaatagttttgaattctggaatgatgagattgtacattattaaagggatatcctttgaaaaacttagcaatggtaagtctgaattaaaattgtcttttagaaaaataaatcacaacagtgcatgagatacgacgtattcctaacctagaatctaagattccttgatcaaaattgtttctgatggaatcattaatacaaatatgttaagcaggaatttgagcccattaagtaggtagagataactctaatagataaaactttaggaaacaacatttttataagtaagtaggatccaaatagtcttcagttataagttgtcgtgttatttgagcttcaaataatctattttgttcctgcactccatgcattcctgcagaatgctaaccatgtgtcaggcctactaccagatgctaggcacatagtgagcaagtagacatggtacctcctctcatcaagcttcttgtaatatagtgggtggggttaggaggatatttcacctaatagaatgattcatagaaagcactacattatttttttaggaaattaatgctatgagtggaaatgtacaggcgagataagagattttaagattttttacttgattcatatggaatactgtagggtgaaatggggggagagaagaagaaattatattatatttgagaagagacctgaaagatgagaagtaagacatgaaagtgaacttcatgagaaaaaactgaggtatgaagaagcttaccacagttcatgaacagacagatagaaagtgtagctagaacagagagaaaggtgaaatgactctagataagactggagaggctgatagggatcagtttaggtgacaccttataggcctaggcaaccatgctatcttgtagcctaaatgccttgagagtctagtagcaatttgaaatggaagagtgatgagattagatttgccatttttaaaaaatgttaatcaacagtgtgtataatagattaaaggaaggcaaaactggcctggtcttctttggcgttacacagttttccagtgcaaacttgcagagacctaggtgagatttccattttagcgggtggacatattaaacagggtgggaatactaaatagccattatatattgaaaaatactattaggacaaatactaaacttctgtaagacagagactcaacaattcaataacttaaagaactatatgatttcacaaataaactttgtgaaatgagaggggtaagtgggatgacactgctccaaatggccatttgtgaatataggttcatccaagttgttcctccactatcacctaggacaatgctttccaaactttagtgtgcctcatagtcacctgaaaagcttgttaaaacactgatttgtgggccacatttcctgagtttctgcttcattaaatttgcagtggggcttgagaatttgtgtttccaacaagatctcagatgctgctgctgctaccggtccagagaccagcaccaccctagggtattgttcttgtctgcatgtttgaagctgtgcaggagacatgtttgtcttccagctcatgacaagaggaagagaacacagcgggacaggcatattacttcttctcatggtttattgatgagaacttaattattaatatatttctactcaaggaggctgagaaattttttctaactaagcagaactgtgaccactcaacaactctatccatagggaacaagcagagaagagatttaggtgggaaaatagtggcctgtgccacagatacaagaacaaagatgaagagctaggaagatgcttggaatttcttaggaagttcatatattttgaatgggcagtggagtacttgaaaaacaatagtagctgtaaggcctaaaatcgtctgtatttggtttggtaggcaatggagaaccactgagactttgagtcaccatagccctcctcttatccatatttttgttttcagtttcggttacctgtggtaaatcatggtccaaaaatatcaaatggaaagttgcacgaataaacattcacatagcttttatcacagtatattgttataattgttctattttattattagttattgtgcgtctcttactgtgcctaatttataaatcatactttatcataggtatgtatgcataagaataaaacatagtatatgtatagggtttggtgctatctgcagttttaggcatccctgggagtcttggaacgtatgtcccactaataagtgaggactactgtatatggcctggtgctgtaagttgatagatgacagagaatgtggagatatacagggtaagaagtggcaaaataataaaatgtagggcgaaattgctatcttctcttaagccatctgttagaaatgttggaatgcattatctagaatgcatcttatacaccgtgtcttatttaccaggagtaatgaagtgcccctaagtaaaacattagttaaatgtatcctctttattaacaaagatatcactgttattaaaaaaaattcagtatgtaaaatatttatttaccaatagttttcccctgaattttcaattgtaatctgatcatttattgtgaatcactaacgtggatttttctctgccattcttaagaaaaggaaatttgtataaaacataattatattatttgtatcataaatagtatgaaacaataatatgagagtaagatattatagtttactttctgaagtcaaaatgtttctctctgaagaatatatgaagtaactcatacattttgaacagaatatattgatactgtgaacttaaaatacaaattaaaaacttttgatatatatatgagacaactataaaccactttgggacaaaatattttcaactttttttctgactataccagtattttacttaaaggatcaaaacatatattcagattataatataacataaatgattatattccatattcattgcttaagctttgccaagtgaaattatcttacaatagtatatttgttttaaaagatttcttgctgtctcccacttactgaagttattactagaattaatgaactaaaaatttaaaagttactttagcaattttggaaaagcctctattaaaatatttagattggcatgtataataaaaatgatcgtaaattttagcatgagagtgttattaagtgatatttagagagaattcaagatttctattaaaggatgtaaatagactcaagtttttcttccaatgagaatataaaatactgaattttattttaacgtgagaagatttttaaattttatttccaaatgatgagctgattagagcactgaacaattttttagttatttacagaaataacttgcatatttggagctcagattgctagtaataatgagcccctgaactaagctccacctttgaactttgtagaaaagcaacacagtataagtagatgcagagctgctaaaagtagatgcgcagaaaggacagaagagaaagagaaaaggttggctgggagctctggctcatgcctgtaatccctgcactttgggagttcaaggcaggaggattgcttgaaccagggagttcacaactagcctgggcaacagagggagaccttgtctctagaaaaagtgaaaaataaattagatgaacatgatggctcgcacctatactcccagctactcaggagtctgaggtgggaggatcacttgagctggggaggttgaggctgcagtgagctctgatcacaccactgaactccagcatgggagacacagcaaggccctgtccaaaaaaaaaaaaaaatctataagcaagcaagaaggaggaacagaaaaatggtaagtacaataagtataatattcagcaactgaaatgtccccactgctgtggcacaatacaatggaggaccatgacatatagctttcaattgatttagataagactctggttgaaggactcctgtccagctccactaaaatgtggtcaattcataaaatgtatttttattacaatgagagctccttctgttttagtggtatctggcaggaggattgtagagctaagctggtcctggagaatccagaggattgggtcccatgtgctgtaagaggaaatgaggctctgagtcacacaacggctgtgtccagccaagaatgcgattattcccaaacagacacatggcactcaagtagaatgtggtaattgtggaattttatttgccaattcaccgaaacttacattttatatttaattgcattcactatttaattcctccgatttttcacccagtttttaaagtatttaaagacaaatgggatttttaataaccactgaaacataccttgcaaatacggtaaatattgtttaaagtatcaagaaactttacaatagattttcagaaaattcacaatagatttgatcatattgaaatatgttaaaatgtctttaaggggtgaaaggttaaaagccttaattgcctttatttcctgactagatgactcattcttcctggcttcttggcagtaatattatagctttcaactcttgcaagccccaggaagttatatgaaaacacaaatttaagaaattaaatttacaaatcaatttcctttttttaattaaaaaaaatcgaatgactaccttctcaactttcataaattaataagtgctctttatgcagttacagtggtaatccctcctatgagcaatgtaaaaaatctagcaataagggatattaggtccccatgttttataaaaataatataaaatagtcccattctcaacccagttttagatattaactggaagctaaattcacacaacagctaaagaatcagaataaagaaaacagtcagtattctgagtgtgcacaggactaactagtgttagcatatatcgacattttaaattgctaaattaccatccagataattaatgctatgtagacaatattgacacaaatattttcttagtttaaaagttgtctgtttaattttttgaagtctccagttctggaaaaaaggaagacttttctatttatgatcctcattatgattttaatctcaattaattcacattgtagagataagaaaactgagatccaaagagattaaattagattccacatttatacctctaactagcagagtcacaaagatacaaagcagcattcttatttcccaaacaaatgtgctttggagaaatccatagataaatgatgaacttaaaattctcagaagtgctttgcagatcagcctttgcatttttcttccaacctccaaaattagtccataacatccaaggaagacctcactgagagctagatttattattctaagatttttttccatccgtaaaaacaagtttatttgagaaagatcaaacatttgatgaacagtttaattaaattcttccctgtttgatcacctgtgtttagtaaacaagaatgttaagtgagcaatatattgaaatataaataaatcttcacttaaaaatttatgttctgcagtgctgtttatgtgcttttggccatataaacagtgaagttatactttagaaaattgattttcatgagttttattaatttaaaatagtatgaactttgaaataatatgaaataccatagatctcacattattccaaagattttctgtgactatattggatgtaatatagacatcatttagatatctgtgggtgtttttagtatcttattacattcatctatcacaaggcttttatctacttgaaaggaaatgtacttggcattgtaagcagctttactaaacaccaaatactgcacggggatgtaaaggaaacatgagtatatacggtggctgttaagctttgatcattagaattcccccagcaaactctttgatgagttattctccctatttagtagatagagaatttgtggcaaaaattaattataaaactttttctaggatacagaacattttactgttttagaatataaataaatataatcaatttcaggagttttggtagcaacttcttacctgtttctcagatgttgtataaggttgtttttgtttgttttgttttttgtggagcagaggatgtggaattactaacttggtatacaaacaaggcaagagaatctgtgattcttttgtattttactattaaaatattgtggaaaaaacaaacattttatattatctggaaataacccaagttatttttgattaattaaagttaatagttttcatatttcttcatggattttttttttttgaaacagaatctgtctctgtcacccttgctggagtgcagtggtgagcacgatctcagctcactgcaacctctgtctcctcagctcaccgcaacctctgcctcctgagttcaagcgattctcctgcctcagcctcccgagtagcaggactacaggcgtgtgccaccatgcctggctaatttttgtagttttagtagagatgggatttcaacatgttgccaggctggtctgaaactcttgacctcaggtgattcgtccgcctcggcctcccaaaattctgggattacaggcatgagccatcgtgcccagcctcctcatggaatttaaatctaggtgtagattttgaaattatgtaccatgttttaaaattataatcatttattttcagaagccttagtttaaaaagttacactaatttaaaagaggaggtggtagcaataaaacatgcaaattagtaatctataacaaattaccagaattctgaatacatgcccattgcattttttaaaatgtactttaatcaattggtatagtagaaaatgcatagacgatagcatcacactgaaaaatgttaaatcccagctctgcatcttcataactgcatgaccacaacaagttttatagtctcttagagactcattttcttcatctctaatagtagttaattatttttactcaataacactttacaaacaaacgttatgacaaacctcctatatagagatcattttaatctcaattaattcacattttagagataagaaaaacaagatccaaagttttctctactgtagtgtagtagttatatttttccaaattttcctttcctaacattacaataaagtcccccatttaatcataacaattgcttaagtgcatcagtgaagaattgggtgtattcatcatttcgtaatttcatgatttcatcattatttcatctgagataaaattcagaaagggaaatgtactttctaaggcacacctgttgattcttcttgtttgaatagtttatcagattcattaattcatcaggtgttatttagtgctaataatatttcagacaccaaagtatttccaaaatttgaaatacggataatacagatatgaccactgtcttcatgtagaatacaggttaaggaggagacagaccaaaaatcaattaataagtaagtcaaaaatttaaaagaagcaaataagcaggtatatctgtgtgtgtataaacatgatataatatggtgttatgaagaaaaggaatgaagaatttagagaataatgagagttatccagttaattcatatattaattcattcagtcatcaaatccagtaccttctatttgtcaggctcttttctaggtactgagggtaccatattaaacatgacaagtctctgtcttcatgcagcttacagtgtacacaggtagtaaatactaaaacatacaagggcataagatgcttgcagatgatgataagtgctctaaacaagataaaacaaagtaattggatagggaataacatgtggagggaagagagttactctattctcctagaagggttagttggagaagtcctttctggtgaagtgtcacttatgctgagacaagaatgcaaaaacatctgaaggaagatgttttattatcagagaaaagagaaagtacacagccgctgagatgggaagaggctaacttgctctagcaattcaaagtcagtgatgtaggaacagagtcagtgcggaggacaatggctggacagtaggattgaagctcaaataggaagacaggccagatcaggaggcatctccttgtctgattagtttacatttcaatggggagccattggaaaggtataagcagggaaataatatgatttgtttttagttttgaaaagaccatgttggctgtggtgtggggtgtaggtccagttaggacaagaatggaagcaggggaattggataagagatcccaggaagatgtgatggtctgggcttgagagatggcttggatatagcaaggagtgggaaggtctgggatttatgcaggcaggagaagtggcaggacttgctggattgatggaatagatgtgagaggattataggcaggtgatgaatctggaaaatgtctctttagcaaggtaacatcggacctagccctgatggatgaaatggagctgaccatgtgaggagtaagggacgagggattgtcatatgggaaagaatcattatgacaaaaatactaactttacatgaatgagagctttaagtgagcttttttactttatttgtttcaaatttctgatggccattgctttgtagtttgtaatttatctatatagagaggatgtagtagaaagtaaaaaattcacttggccctgatgtatccataatgatagaagagagagaccctagaatctacgttttgggaagaaacttatctgaagttgttttcctatcttatatcgtaggataggtttctgctggttcaaagaacttctcagaatgatttttacaaaaatattaaattattttcaaaagtatcttattttatgaggcttatacaccttaatataccttaacaagctatgttcttcatgattgcacttgctaatcctataattattattgagattcttacataaattaactttaagaaattgaacaggaaatctagttttgttgccttcaaaagagctttgcaatatcataacaactctccttcaatggaaaactctgtatgattcagggtacctgaagatagatgctaattatcactgtgctcacagcacactaatcttgactgtgccattttctctggaagaggaaataacatttaatattttctagttttacatgaaggaaggtaattaatctcactttgagcaagcaacgggatgtcttatctcgtggttccagaaagtttcccatcttgtaaataataaaacgatttccttatagttctttgccacaaaaatagaatactactttttctatagtgtgtaatgggaactacaggtctaacaaaggcacaaaatgtacaaagaattcttattaggagtcttattaggtgtcatggccatgaagtcttatgtgctctagtttttattttttgtcataaaacatacgtaacataaaatatatcatttttaccattttcttctgatgaaaaatgtgtccatttattataaacatatttagtaacccagaactctgcagttttgaacctgagtacctccataaccaaatctcctatgtaacttaaattattccagaatgttttctagacatatgctggatatccatagaatatacagagactaatggtgctactgtttgaatgtttgtgtccctccaaaattcatgttgaagcttaattcccattttgttggtattaagagggagccttttgggaagtgattaagtcatgagctcttgtaaatggcattaacacccttataaaagaggcttcagagagctgcctggcctttttgctcttcaattatctgaggacacagtaaacagcaacaaggcaccatcttggaagcagagaacagacctctccaggcactgaatctgctgatgtcttgattgtggacttcccagcctccagaaccatgacaaataaatgcctgttctttataaagtatcccttctaagatattttgttatattgaagcatgaatggactaagacaaatggatcctaactcttcaaacttgttcctcaagttctctcttatttacttaatatatattgaatatatttacatatctgtaccgtaaatatgcctctctttttttctctttattttgtcatgtaatcatcaccactatccatttctcgaacttttccattatcccaaacagaagctctttacccattaaagagtcactccccatcattcctattggtttttattattaattttcagatgtggttttctttctgtatcaagtagtattttaataaaaaacagaatctaagattgtgttttatagcactatccaagccccttgttatgcattccatgaaaatatttgttagtctaagctttcctcatagatcttatacagatttgtggtaaccacaatgttttatttgtattcttaagcagaaaaacacaaatagaagtttcataatacattcataaaaataaggaagtatcttgtgtctttggatgaattatacagacataaattgattaattcatgttatcataccagattggacattacccaggctatttgtgttttatttcctttacatagtttcaaacatacacaaacttttcactaaatttaagttttaatttctcaaaagtaatacttcttagataccatatttcttagatacaattcagagaccatgaaaaatgaaaattttcctaaatagtgtttcacattaagaggagcgtatcatagaaaagagctcattaaaaagtcaggaaacaacaggtgctagagaggatgtggagaaataggaacacttttacactgttggtgggactgtaaactagttcaaccattgtggaagacagtgtggcgattcctcaagcatctagaactagaaataccatttgaccgaaccatcccattattggttatatacccaaaggattataaatcatgctgctataaagacacatgcacacgcatgtttattagggcactattcacaatagcaaagacttggaaccaacccaaatgtccatcaatgatagactggattaagaaaatgtggcacatatacaccatggaatactatgcagccataaaaaagatgagttcatgtcctttgtagggacatggataaagctggaaaccatcattctcagcaaactatagcaaggacaaaaaaacaaacaccgcatgttctcactgataggtgggaattgaacaatgagaacacttggacacaggaaggggaacatcacacaccatggcctgttgtggggtgaggggctgggggagggatagcattaggagatatacctaatgtaaatgacgagttaatgggtgcagcacagcaacatggcacatgtatacatatgtgacaaacctgcacgttgtgcacatgtaccctagaacttaaagtataatttttaaaaaagtgcacatgaaagaaaaacaacaaacagtgacccaacattggaaaattaatcaatgaatggatagatagacaacaattacttatcaacctccacatggagataggggtgcttaaattttccagttagaggtagagaatatattctgatgttgcctggctccaggcaggttctcaaactcacatggaacatatacggttactccagaatggaatacttctttcttgctggacacattttctaaatgcctctttatctagagttatcaagaaaattggcactctagtttataattattgtagttacaaaggatataaaagtttgacccaagaattaataagaactgaagaacaacaaaacatgctgaatggtagggttgatgagggataatgacaaagattacgcattaggaaattggaaccctggttttcttcctgacatttgctaactaggtataaaatatgtggaaatgaatttgcctctctgggtttcttttcctcatctgtaaaattaacatagtcagattaattatctctgtggtgccctccagttctgaatgtctctttctatactaaatatgtattaatctcctttggaccacccaaaaggcactttaaatgtcttttgggtcatctttatacacataattcattaatgtatagtactggttgaggatacagggtaaggagatcccctttcttaatatcatctgacctcttctattctatataaataactttcagggcttatgccagtaattatttctaagactaaataccatctttctatacagccctcttgggaggctttcttccactagctgtaggtttgagctacaacccaatttgttatagtcttatgtatttatagtaacacccagtcacatacctacctgacttctaactatctcaagtaggtcagtcacaaaaccggaaataattaagctaaaacactgctgagtcttagggagataggtgtcaacatgtaggtataaggagtgtttgcatttcttgccttctcaaatacatcacttttttttaactggccttaccaaagtcattaactttgctctcggttagtttcagcaggcagtctgtcaactaaggctataaagattaggttgcaagtgattgtgtaaaaaacagccccctaagtatttgaaaagttatattaaaaaatagatcagaccacaaagaaagaagcaaaaaagatcatttttaataaacacatttgttttgattattaatatttaacaaatgcacaaaatattaaatagtcatgaacagaagaatgggaattaggtctcaagacaaatgtgaaattttattaagtatcttgaaatctgagatctagttattttttacatctgcattgaattccgactgccaccatttttcttgatctatggttgtccatttttgtttgagcagttttctgaaggctacaacttcacaaggcttacgtttattattgcgatattttaattctgtgaatttcaaggcttctatttttctgacacctgtatctctataacttccaccattttctctagttctgcctagtacagtagagctaagtcaaaccttttcttataattactttcttgtccaagatagcattccaagttttctcaacaagtcttcatatgccctatttttctcacatgacaaacacctggttgcactcttcttattctagaccagtggttctcagacctggctgaacattagaattacctgaaatcttctaagaaatcataatgtcagaaagtcacagaagattttaactggctcccttaccaatatatgacagataattcacagaaaaaaagtgagcatgtgttctatgtataaaatacatggttcagaatcccagtgacacaaggaaattgctgaatggtattaagaatgttatttcctgccagtgaacctcagggtcctcatgaagatataaacataatcacgtctgccctgcatgactcatggaatagttgggactattaaacattctttgcaaactttaaatcaccagccaaatgttatcatgcttgttatcatcatcctttaaattttagaagattgttttgttttggtttagcttatgcaacatttatatcttgcagttctggaggctgacaagtccaagatcaagacactagccaatctggtgtctgatgagggcaacttcctggtcgttaaaggccatcttctagtagcatccacacattgccaagagaatcagctctagtcattttctctctctctctctctctctctctatatatatataatatatgttatatatgtaatataacatattttatatataatacaatatatatctatatattctatatagaatatatattctatattctatatagaatatatagaatatatattatatataatgtattatatataaaatatgttatatatattatatgtaatatattatatattataaaatattatattatatataatatattatattttatataacatattatatattataaaacattatattatatataatataatatatattataacatattatattgtatataatatatattataaaatattatattatagattgtatatgataaaatattataaaatattatatcatatataatatatgtgataaaatattttatcatatataatatatgtgataaaatattatatcatatataatatataagataaaatattatatcatatataatatataagataaaatatatataagatatatcataaaatattatattatatataagatatatcataaaatattatattatatataagatatatcataaaatattatattatatataagatatatcataaaatatgatattatatataagatatatcataaaatatgatattatatataatatgtatcataaaatatgatcttatatataatatgtatcataaaatatgatcttatatataatatgtatcataaaatatgatcttatatataatatgtatcataaaatatgatcttatatataatatgtatcataaaatatgatcttatatataatatgtatcataaaatatgatcttatatataatatgtatcataaaatatgatcttatatataatatgtatcataaaatatgatcttatatatcatatgtatcataaaatatgatcttatatataatatgtatcataaaatatgatcttatatataatatgtatcataaaatattatattatatatattgtatatcataaaatattatattatatatattgtatatcataaaatattatattatatatattgtatatcatgaaatatattatgtataatatattatatattataaaatattatattatgtataatatattatatattataaaatattatattatatattataaaatattatattatatataatacattatatattataaaatatattatatataatacattatatattataaaatatattatatataatatattatatattataaaatattatattatatataattatatataatatattatatatatatataaaattccattcctttgagtatatactgaataataggattccagagtcaaatggtgatcctgttttaagttcttagagaaatcccacactgctgtcgacaaactatagtatagttcaactttccatgaactatagtatagttctctctctctctctctgtctctctctatatatatacccatgaaccaaaaataagttttacaaaatcacttgaagaaaaagatatctatctatctacatatatatggttttatatatatatatatacacacatatatatatatattcatagtattttgcaagtattttgttgaggagttttgtatctgtgttcatcaagcatatttacctgaagttttctttttttgttgtctctgccgggttttggtatcaggatgatgctggcctcatagaatgagttaggaaggagtccctccccaagtttttggaatagtttaagtagaaatgctaccagcacttctttataaatgtggtagagttcagctgtgaatccatctggtcctgggctttttgtggttggcaggattttattactgattgaattttgaaactcattattggtctgtataaggattacatttcttcttgattcagtcttgggaggttgtatgtgttcaggaatttacccatttcttcatcgtggtagtctctgagggatatatatatctctctgagggatatgtatattatatatatataatgtatataatgtatataatgtatataatgtatacaatatatataatgtatataatgtatataatatatatgttatgtatataatgtacataatatatatgttatgtatataatgtacataatatatatgttatgtatataatgtatataatatataatatatattatgtatataatgtatattatatataatatgtatataatatatattatatatattatgtatataatatatattatatacatatatgtaatagatattatatatattatatatataatatatataatatatattatgtatataatatatataatatatattatgtatataatatatattatatatattatgtatctactgtatgtaatatattatatatgatgtatataccgtatgtaatatatatgatgtatataccgtatgtaatatattatagatgacatatataccgtatgtaatatattatagatgacgtatataccgtatgtaatatattatagatgacgtatataccgtatgtaatatattatagatgacgtatataccgtatgtaatatattatagatgacgtatataccgtatgtaatatattatagatgacgtatataccgtaatatattatagatgacgtatataccgtatgtaatatattatagatgacgtatataccgtatgtaatatattatagatgacgtatataccgtatgtaatatattatagatgacgtatataccgtatgtaatatattatagatgacgtatataatgtatgtaatatatattatagatgacctatataatgtatgtaatatatattatagatgatgtatataatgtatatattgtatatgatagatgatgtatataatgtatataatataaattatagatgatgtatatctgagggatatatattataatatattttatataatatatatttacatatattatataaaatatatattatatttataaatatatattttatatattaaatatatgaaatatatattttatatatagtatataaaatatatataatatataatataaaatatatataatatataatataaaatatatattatatataatgtaaaatatatattatatataacatatataaaatatataaaatacatatatttcatatattttataaagtacatatatttttatatatattatatactatatattttatatatatgatatactatatgtattttatatatattatatttttatatattatatactacatatattttatatatattatattttatatatttaatatatgtaaaatatatatattttatataattttatttttatatattattttttatttattttatatcttttatgtataaaatacttatatatttttatgtataaaatacgtgtatatttttatgtatagaatacgtacatatttttgtgtatagaatacgtacatatttttgtgtatagaatacgaacatatttttctgtatagaatacgtacatatatttgtgtatagaatacgtaaatatttttgtgtatagaatacgtatatatttttgtgtatagaatacgtatatatttttatataaatacgtatatatttttatatataaatacgtatatatttttatatataaatattttatatttttatatataaatgttttatatatttttatataaaatgttttatatatttttatataaaatgttttatatatttttatatgtaaatgttttatatatttttatatgtaaatgttttatatatttttatatgtaaatgttttatatatttttatatgtaaatgttttatatatttttatatgtaaatgttttatatatttttatatgtaaatgttttatatatttttatatataagtatatattattttacatatttatataattatattttatataatttacatatttatataatatatatgttttatatataatatgtaaaatatatatgatatatattatataacatatatatttcacatattatatattatatatgaaatatatattatatatataaatatatatataaatatatattatatataaaatataatatatattatatatattatattatataatatgtattatattaattgtattatattataatataattatatataataacatattatataatatattattatattatatatataatatataattatattatatataaaatatatatataattatattatatataatatataatataattatattatatatataatatatatataattatattatatatattatatgatatatactatatatattacattatatataatatacataatataatatataattatattatattatatattatatataatataatgtatattatatattttttataatataatgtatattatatttatttcatatataatattactaatgtatattatatatattttatatataatataaatagtagaaaacagcacatatacaccttgtgtgtgtatgtgtgtgtgtacatatatatatatatttttttttttgagatggagtctctcactgtcacccaggctggagtgaaatggtgctatcttggctcactgcaaccttcgcctcccgggttcaagtgattctcctgcctcagcctcacgagtagctgggattacaggcgaccgcccccaagcccagccaatttttatgtttttaatagagacagggtttcactgtgttgtccaggatggtctcaaactcctgacctcgtgatctgtccacctcggcttcccaaagtgctgggattacaggcatgagtcaccgtgcccagccaggattttgtatttcagtgggttcagtggtaatatcccctttgtcattgttgaatttttatttggatcttctctttatttctttattagtctagctggtggtctatcgacttatgttattaattttttcaaggaaccaactccaggattcattgaccttgtgtacagtttttactatttcagttttcttcagttcagctttgattttggttatttcctgtctgctagctttggggttgatttgctcttgtttctctaattcctctagttgtgattttaggttattaatttgagatatttctaacttttcaatgtgggcatttggtgttataaacttccctcttatcgctgccttagctgagtcccagagattctggtatgttgtatcttaagactgcttttcaaaattctcattgtccacagtttacccaatatatgtcccaacgtctgtaatgttttcttccttctctagctttgatatatttttctcctctcctttgcttatcctagcaaataaaatcaccaaactcctcgaaatatacatatttatggagaatcagtaaaaagaatttttaaaatttacatttttaaatgttccatttagctccatcatcactatactgccattacttcttttagagtgtgtgcacataaaaaatatttatctttaacatttttttgcattttgtgtcagtgaagagtaagaataccattctacaatcaggggaaaatgtttctagttattgctggcgcatgacaatagctagctctgtggccttatggcattatagtttggaaaagaataaataagcacacacatatatgataaattatatttatctcttgggagaattgtttataattatataaaaactttgaacatcaataaaaatatgtagtttctattatttacacatttagtttatattttttaatttataaaggtagcaatgaggaaggttctcttcttcaaaactctgatgttgaagttcagaaggctgtgaaacaaggtgtatatgtgctgttttctactatgacctataacagtatgttgaatatatgcccaatgtttctgacccactaaaatatctactttaatatagaaaaaaaattaatgtaatgggacattatttttaaggcaggaaaatagggagtacctataaatcaagtttttcagttaacatctttatatattcaggtttttttaacttgttttaatttgataatattggataaatatgtccgtttttaatcaaatttggtaattgtagttttatataaagttatgtctatttgaagaacaaaaacaaccttgtattcttcacattgcagtagtttaacatactccattaacagtgaaaacatatatatgctattatattttcaaagaaaatatgaatctcataccattataatttttcccaagaaaaaattaactgagaggttttttttttatttcaaccccagtggaagtacaattccagtcatacatcaggtcttatagcacagtatattttgttcctgctatttttgttattgttatttacaaacttgaaaacttgatttaagaaaatacagagctaacattatttattcctagaggttctcttatctcttaggtatcttattttagcttgcgctataattacatttctttatgctcatgatccggaataatcaattaagtcaataatgttcacactcctttaccaagtaaaactacaatgcagtgatatttagatacatgcactggagtgttttggggtatatactaatgtcacttgtcaaatgttcaatttttacaggattttctataatctgtattattctaatattatagttttaaatttcttaccactgaagaatattgatgatgcaggcagatgcgaatatatctatttcttgacttctctgttactcttgtgctccccactctccttccaggcttgagagtaccaatcaggctggggctgagtgagcaaggacagtaataggataggccatgaaaggctgtgtttcataggcccatacaggttattgaaatattttggctttccatctaagattggaatacttggaaagtttaaacaaagttatgccatgggcagatttacattttagaaggataatatgagatactgagttaagaatgaattatgagcagtcaaaaggggaaacaagccaattagaaggctatcacaatcatacacatacaaattcatggtaaactgggctgtttgtagcaatagaagtgaacaggtaaatacattataaaagtagatccaggaatattattcagaaataaagaaaaaatatctacggatatatgcaacaacatgaatatatcttggaaacattgtcctcagtgaaaaaaaaaagccacatgaaaaagaataaatgttattccatttatgtaaaaatctagaacagggaaaataagagtgacaacaaaacagatcagtgatttcctgggaccaggggagggaatatgacctagctatgaaggtgaatgagggaacttttggaacggatggaaacattctaaaacctccacatgatgatgatttctcacgaaaatgttcacttaatttatggatgttattttatataaattatacttcaatgaaactgtaatggaaaaaatagtacatctaataaaatttgctgacagaagcggtgtatgagagaaaaaaatatggcaaaacaaaaactttacacttttggccccagctcccggtagaaactcatctgatatgcagaacactagtaagatgaggttttgatgaaggatttcagctttggatgcgttaaatgttaaatcttcagtacacacccaagtggagatgccaattaggccatttagtatatgaatcttgatttaatggagtagtctagcctagaaatacatatttaggtcttaccagtatatatagagtctaaagccataaaactgggagagaacaacattctctatcaattaatgttgatatagaagagaaatagtgcactagaataatttccaaatcaaattattccattatttatcatttctatttaaatgtatataactcatccttagcccaccatcttaactttaggaaaaataattatgtttttgctataattttctcattgcctagttaaacacctgactaagaaaatgttcattagcagtgactatggattaaatgtgtctccttaagatcattcagcatggcgaaaatagaagaaaagatcaaattagtgtcattatcttgcagcctcagctgattttgagaaattgtttataatgtgagaacacaaaacgtgtattaattgaaacagaatctactcttcttctattagaataaattaacaaaaaatcttattgattgttaggaatagtgtaagctcctggttcctttatggtttgagtggaacacaactggaaactcctttgttttgctctcttctcacctcatctacagtcaagatccagtaacctattggtccatttcttgcatttcacttctttactttgcataacccataacagccaattcacttcctgcctgataacacatttatcttgactcaccctcattttatctgaaaccactggctttgtattaggtccctaaatttttagtaagcagctgctctcaattattgctgtgaagtttacctggaaactttgttttgttttgtattgatgaatggttctaattttaataaggtagttttgactttattgtagttagattggaagttctttgtcttctctcactacttcaggaaacttatttggaagttacgatggtgacctggttctgaaaagccagtcaaattttagatttagatcaaccagtgaccattagtttcatactagccaagttgagaaagtttggatcaattttcttttataaactccattaatgattttctgaaattgtcctcttaccactggtaacatcatgcatcatggttatgctactttcctgagttgctatcaaattcaaagcagtgtcaacaggtaactaaaaactcactgccaattcaaagtattgttcaatttatgttacatatatagtcttacattcagaaattcatatttctgtatgttgacatgtatgtgtacaaaatacatacatatatgtgtgtaattcttttgaaatcaatcattgatattcaccaatatggatcttttgtatacaatatgacatgtatgtatacaaaatacatacatatatgtgtgtaattcttttgaaatcaatcattgatattcaccaatatggattttacttaaataagactcgatttttaacttaagactcaaggactatgatttttcttattctgctgtgcaacactttgcactttcttctaataacatctccttactctttagtaggtacttactaatgatcattatagtgtttatattttgtcacttcccccattggattagcacaaaaattcaaattgatttatgttgagactgataaccaatcaatacttggatctgaaacatagatgttgactaaatcttcttaatatttatgtattcttcttcattaattcttaataccacatcattcagacttgataagtaccatgataacatccattttgatcttgttttatattatgaatgtaaagaaaatcaggtttttaatttgtactgaaggaatatctttgttagaatttttcgcttttgaaaaacaaatacaaagataaaagttaagcattataaatgctcctttcttcatcagatatgttgcttctgcatgataatttgctggtgagtcatttaaaaattattcttcagattatatttacacttagtaattatccatatcctcagatattcagttgctttaaatttggaaagctacaaacaataagatagaaacagttgcatttcaaacaaactagagagatttacaaatgtaaatcaagctattactaatgctaagaaacattttgactaaaataatgaagtagaagattagtgatatttaaacaatgtcctgttttaagctattactgtttttaacgcattttcatatatatacagggcttacataataatttatcatctatcactaaaagcttaaaaaatttgttggggctgtggaaaaaggacattaggaatatattatttcttaaaaatcacttaactgtttattgcagatagtgaatatatcttcccaatggaatggaagttaaacataattaaatttcctttttttattgaagaattaccacacacacacataacatacaaagaagagaatgtacacacatacacacacacacacacacacacacacaaatgctataatgtaacaacaatcagtgcacccacattttcaaaatatttgcatcattttaatcacccaaacttatctaaattattgctctaaaagctgcaatctttgatagcctagtagatttagccctggtgtgaaatagtatctctagatttatgctaattggctttataatttatgaaacattatgtccttaatcatctaattttaagaaattaaatgggaggtcatttaagttaaaatttaataaactaagttatggatccttcaactgcttaaggcatattacctgcctttgaggaaaagaaaagtaggtattttatgacaacaaataggtgtctgacttgcttgtttctactgtatcattagaagtcttttttaaaaaaaataagtaaaacgatatggagattctcaaagaactaaaaatagaactaccgttcaacccagtaatcccactgcttggtattgacccaaaaagaaataaataattgtataaaaaagacacctgcactcatatatttatcacagccctattcgcaatgacaaaatcatggaaccaacataagtatccaccaacagttgaatggataaagaaaatgtgggtatatatgtatggaatactacacagccataaaaaataatttaatcatgtcctttgcagcaaagtggagtttgaggccattattctaagtgaaatacctcagaggcagaaaatcaaatatcatatgttctcacttataaatgtgagcaaaacaatgggtacatatggacataaagatagagataatagtctttggggactccaaaagggtggagaatgggaggtgggtgagggttgaaaaattacctattgagtactatgttcaatagtttcgtgatgggtacattagaagcccagtcaccaccattatgcatgtaatacccatataacaaacaaacacatgaattccctaaatctaacatgaaaaataaaaataaaaatatgtaaaagagtttaaatgatttacatatatttgatcgtatgaaaaaaatggcacttttatttttaaaaaggacttcaaagcttgttcttgacaaagactaaataatatgtttgacaataaataatattttagaacatattaattaatcaattattgaacaccttcaggaagcttatggtctgcaaagaacacaggtaatttcagtagaaattataatagtgtgaaaagagccaatgcatgggaaatacttgatgttataggagaataaatagctcatctaatctaatctaaatctcaactactgtaattctcttactaccagcattagcatcatctagaatcttgttagaaatactaaaatttcagtttcaaccccatacatactgaatgtgaatcttcatgttaacaaaattctcatattattttaatttacattaacatttaagacaagcattagggaaaattactcagagaaagtggcattaaaaattaactcccaaatgacaagatggttagtttgtgaaaatttaaagtaaaatacgttggaaacagagacatgagtgtacccaaaaccaagtctgtagcctaggctgcaggttggatagagaagacatgcaggaaaaaggaagacaatttcaattttgcgtttgatgtgctcatgaaacatgttgtaagggtagatgtttaaagggaagacaggcttacgagtcgagatcagggatttgttctctgctggaccattgacttgaagacatgcaggaaaaaggaagacaatttcaattttgcgtttgatgtgcccatgaaacatgttgtaagggtagatgtttaaagggaaaacaggcttacgagtcgagatcagggatttgttctctgctggaccattgacttgaggattggtggtatattgatagtaactgaagtcatgtgagtgggaaggattgtccaaggaaaatacgtaaggtgaaaagaaaaggcggccttgggcatagtctttggaaataccaactattaaaagatgccaacaaatgagactgaaaagagcagccaaagaagaaacacgaaagccagaaccatatgtggatggagaagacacaggaaaagatgtcttaggaggaagggctcagtttgtaatactgtcttagtttggaatctcctagtagcagagcctaataaaagaatttggggtgggtaatttactgaggaagaactttaagaatcaggattaggaaacaggagtagtaagaccacgtgtattagcccatttttacgctgctgataaagacatacccgagactgggaagaaaaagagatttaattggacttacagttccacatggctgagaaggcttcagaatcatggcaggaggagaaaggcacttcttatttggcgacagcaaaagaaaatgaggaggaagcaaaagcggaaacccctgataaacccgtcagatctcgtaagacttattcactatcacaagaatagcacaggaaaaactggcccccatgatttaattaccaccccctgggtccctcccacaacatatgggaattctgagagatataattcaagttgagatttgaatgtggacacagccaaaccatatcaccatgaaaaaggaaaatctaatgaagggtatattattgaggttttttttagttatagacaattggggcttagtcctactgacactctctgaggaactgtgtagaatgaaccttatacttgtttctctgaaggataggggctgttattaatctggagactcaagtccctcattggttgaacgttgccttatgtggtgtaacctacacctctcctcaccccccagaagaccatgcaactctaggttgagctgagcaagttttctagagttcccagagagccctgatgcaaaaaccctgagatggactttccaccattggtacagttgaggtcagaggtgggtcagcttacaaggaaagacgcgttgtatgggacatcaatagtgttaaccactggtgttcagtactattcagatatatatatatatatatatatatgtatatatatataatatgttatatatataatatgtaaatattatatatattcagatcacaaatatgtatatatatatatttggtatatttgtgaaatatctaattaagtatcatggtagtaatcaggaaataatggaaatgcaagagtattattagtgaaatagaaggaatggaagctataattgaaggttttaatgagaagtagaaagttagataacaaaagtagaccacactttcaagaaactggttgagaaaggagagaagaaaaataggatggtaagtagagggctacttgtgatcaatagagagtcattttttgatgacaagaatgtcatgcagcaaataagagcacagtctgaagccatattgcctagattcaaatcctggcttcagcactaattagctgtgtgactttatgcaagttatttaaattctctgtgcctcaatttcattatctgtaaaatgaagatcatgatagcaatctcacactgttgttatgaggattaagtaggtaaatatgagtaaaaggtttagttgagtgccaggaaaacagcatttaatatccaagggttagatatgattatgattttaattattgtaactggacattcaaatacaggtgaaagagtagctttaaatggaattagaaacacttctttcattgtttataagagaaataaagacagaaggagaaaaaatagatttctctttaaatgagttagtagatattcttaagtaaaagcttctatttctttttgaaattctatgtaaagtcatcttctgtgagtgaaagaaactgttgagggaaggaaataggaaagttgagacagcataaaatgctttaaatggtccaatttaaaaaaatggaagagtgattgagttaaccatggtaggcatgttatatcagtccatactcttgttcaattaagggccagatcatttccctacacatagatagatacacacacacacacacacacacacacacacaaacacacacaccaagcaaaactatagtaataaagtttaaagtcatttagagcaggaaaactaaaggattttaaaaatattcaagcacacatttagctgtattacaatggttataatgattttttctacttctaccaatcatctaacccttgacccttattccataattacaaataaattaacatactaaagatgttttagacagacaatttacttgtttagtaatcaaggattttcttctaattgctaaatacactaaagtctcatcatcactttttttcaattacatgcttagttaaatcttaaacaatgttaaattgacttttcaaaaacaatgctcaacttggccattataaaataaaaacataataataataattgataaatgaaaacctatgtagtgtaaacaacttccaagttcttttgaatcctgcatttttacatagatgaaagtatagtttcttgtgaaatatctgaatggatagctaagttccataagcaagaaagcaaatgactatttgtattggaagagattattctggatggaagaataacacgctttacttgtaatatcccagcactttgggaggccaaggcaggtggatcacctgaagtcaggaattcaagaccagtctaaccaatgtggtgaaaccccatctctactgaaaatacaaaattagctgggcatggtggtgcatgcctgtaagcccagctacagctgaggcaggagaatcactagaacccaggaggctgaggttgcagtgaccagtctgaccaacatggtgaaatcccatctctactgaaagtacacaattagctgggcgtggtggtgcatgcctgtaatctcagctacagctgaggcaggagaatcactagaacccaggaggccgaggttgcagtgaccagtctgaccaacatggtgaaatcccatctctactgaaagtacacaattagctgggcgtggagatgcatgcctgtaatctcagctacagctgaggcaggagaatcgctagaaccctggaggcagaggttgcagtgagctgagatcatgccattgcactccagcctgggcaacaagagtgaaactccatctcagagaaaaacaaataaaataaaataaaataaaattacattcagttggaattttgactgttttccatgcaaagtagatacatattttatttcaaaaaagcttttgcatatcttgagagctaaataatcattattccatagaaaaatctatgttttgttacccagctttccaaaaaaggaaatataaaatgaagataaaataggagtatctgactcaaacttctgctaaaaagcaaacaaatctctaaaccatctgctttccctcatttgtgattttcctttagttttttcccattcattttattgaaaatcaaattcaggaagatttcatgttatttttatgattatatgacttactatgtaaagactatgtgacttaaaactttttcataaaataaccagcaacacatttttactgagaaaaaaaaattctaaaagatatgcattgaagatgttgctgtgtttatagcatagttcttgaaaatagttcaatcttgctgcaaaaattctagaaacaatacttgttaaatgaattagcatattacccagcttttctatatatatgaatttatgtatttttaaatgtaggataataaagagaaattatggcttcaattgctgtgtaaatagctggcaatactagaatttttcttggtaaaaattaagatagattagtcataagcccagtgattatttatttaaacataaaaaagttaaaaagaaagttgattgttggtctttgaagagcaaacaattttaaatattttcttattatttattattatttgtcaaattacatttaaaacacatgtagtcactggaatataaaatttatacttttttattctataagaaaaatacctcttcagaaaccattttagcattgctgtgtttatattgagaatgagacatatatttttattcaactggatttttaacctgtttgctttttaatgatatttctaataattactatttattatttattatttatcacataacatacatgcagtatcactactaattttcatggcacccagtacgttagatattatcatttcaaattgacatataaaaaactgaaaaactgaaaggtaaaaaaaatatatatatatatatatactcaaagtcaaaagtcaagaatatagtgtagattaaacactgacaccactggttccagcactcatggagttttacaatgccaataaaacttaatgtggtcagttaagatactcagatatttttaaattgacactcagatatgtgtaaacacccttgaaattgtaacacattttcatgcatgtttattttggcagatgaaggtctatgcctttcatctgatgctgtaggttgtcctagaaataaagtttaaagaagctctatttcagctagtgtagcctactttcaaatagctagttaatgtagcatttatgatttatttgaacatggaaattagttccatcactcaccaaaaagtcttttgccttttaaaaaaaagtattaacttttgtttcacaaaaatagtagttgatgtgtattgatgccaatgtacacatagataccccacaggtaagactctactgtgggcactacactataaaattatcttgagatattataaatcaggtgatatatatatatatatatttttttttttttgatgcttcctgaaagtaaaaagttaacttcttataggcagtgttttatagatttgagacatggggatagaatcatgaacttaaagttccctctgatttgatgagtaattattaataatttgctatttttcaatttatgtgatttgcccctctaatacaatgggaaggacagcttcttatccctgtcttccaggaatgtgaagtgtataaaattattcctgaagacctgtaatctgactctataacacaaactggtaatagattaacaggaaaaaagggcatacaaatttattatctgcacatgtatgtacaggagtcatacaaaatatgaaaactcaaagaaatgcccaatcattgatgcttttataccatcttggggttacagaaagaataggggcttatggcatggcaagacagattgtcagagttagagcagaagaagaaaggcatggagtaaaggcaatcttgtgcagatgtacaggtagcagccctcagaaaaaataggtgatagtctatggtaaatgtttctctgtcagatcttaaaaggtgtcagactctctgttaatctttcctagacatggacaagcggggcgtcaggaaaagcttgcttgcatctgttatttatttcactttattgcctccacagatgcaaatctccccacaaaaggcacctttgtagggctattcctgtctgcaggccctctgaacagccatctcaaaatatgtcaaagaggtatatttggggtgaaatatttttagtttcctttaggggtgacaattagattaacattttaaaaagatgtctctgtctgaatcatggaaaatgagttagagttggaggaagacatgtataaataggtacagtgaatgtagttaagaagctggtcatgagttgaaggagagagagtagctttgaccagaatggtgatgcagagaaatggaaaattattgaaacttttggtaggtaaaacttacataatttggtgatgtcttaaggattgggatgaaggagtaggggataaactaaggtgtttcagttttataaataagggtatcatttcatggatataaaaacaatataaatgtgatttaaaattctttagattgcttactattcttctattagattgccttctattcccttcaattattcgtcagttctcacctcatagacagctcgtgatggttattatacttatgatttccattgccacttctattttccattatcttctctcttagtccatttttctgttgctaaaaaggaaaacctaagatcgggtaattaataaagaagaaaggttatttggctcacaattctgatggctggaaagttcaagtttgggcatcagtattggtgagggcctcaggctgcttccactcatggcagaaagtgaaggggagcaggagtatgcacagaccttatggtgagaaaggaagcaagagggagagagagaggggagaggtgccagaatctttttatcatcaagctctctagggaactaacagagtgagaattcactcacgcctgagggagggcataatctttgtccttgagggatccacccctatgacccgaacactttccaataggtcccacctacaacactggggataaaatctcaacatgaagtttggagaatcctatccaaaccatagcacaaatcattacagtctgctttgtaacatgatccctactcctaacatacacacatagggaaaggtcaccaaagacattactgaaactaaatctagagggtaattttgaattcacatttagacatgtcacatattttggagaataaaagcggcctaaaaatcattttcaaaaatctcatattagtatatttttaaactaaaaatattaaaagtacagaaataaatgatcaacgaaaaggaggcggaattaatgttttctaagaatttcagaaaatattctagaatgtaggggaaatgttggggaaatatagagaaaatgtagggaatgcagagaaaggtaggagaaaatgcagagactaaatacattaaataaagataagaaacaaatcaaatccagcatagagaatcaaattcagatccaaagcctcaacatccaactagaggagttcaacctagaattctatatggagtcaactttgagagtttaataaagacaatttcagacatggaaagattcagaaaacatacaatctttcttagtcgtttacttggggattttttccagcaacatgaataaataaaccaaaacagaaacatggcatttagaaatactgagccaaaccaaggatgttgtaaagagaaattctataggaaaatctttgaagaaaaaactcaatgtctatctggtgggataaggaggctagaaaaaaaataatactaaatgaaggctaattacccaagaaataaatgtgatcagcaattgcaggattaacaaatccattggatgaacaagtcttgttaatctactgatgagcaagaaaggaaatgtcatcaaatactcacaccatttggctttgtggtaaatatttacatggccagagtaatgttaacactatgagtttggaagttccaattataggaacaaagttataatctacctttacattgtaacattagagatgacagaagtcatcaaatgaaagtgaacgagggagtttttttactttcacctggtaaagtatcttagagttatctgaacaagaaataatagtaaacatggtgcataaaggtacaaagcaactaaggtaagaattaacactagtgacacagctatagcatgagaaaggaagatttggggtactgtaagtggcaaaacaccattttatgacagttagtttataaacaatgcctgtaattatctatataagaaacgggaacaagcatattgcttagtgatatggattaaacaccttttaacatggaaaagtgagactggtgggtttgaaactggatccttgccgtgttttataaacactcttgttagatctcatttttaataatcatgtacatgcatacttttataaatttttataattatacagaaacttttaaaaataaaaatatattagaattttaagtgataattattttatagtctctttagatctgatggaataaacttttgatcttatgtttccaaagaattgtattggcatccttgcttttcaaaaatctatttgtctgtgactactaaatatactaagtcatattttgcatatagtatattactacaactattagaaagtttgccattttatcattttttgactttgccaacttacacattacttgtaacatctagtttgtttcacggtctgactaccactactaagtgtctttttcaaagaatagttggttatttttattcacatcacatggaagtgatattttcatacattcttgcaagtcttgttaggtgtgggagaaacagacaaaaagaaaaagaaaaagctcctgtttttagtgtgttgtattctaacagagattactacctaatttccaaattcactggccactgttcagtacctgttttcttagaatagattccttttgaccacaccccctgtgaaatttaatccttctttggattttctaatcatgtttttctggttctgctctcacatcttggcaggtattaacagtacccttaattaatcagtctcctggctcagctgattttaaaacataagttccactttttagccttttcgcctcatttgacacatcctcccttagtgacttcttagtcaccaatgatgtatatattttcttctctgagtgcctgacctacatagaggcattaggatgtgctatgggcatcttaaacttaacttgctgaaaactaaatttactttgtttcccccacgctcactcaagcatgcttccttatgtcctaagatgacacagtacttggcatatagcagcgattatgaaatttttgtgtatgaaggacctgttaaaacacatactgctgtgtcccaaatgtagagtttctgattcagtaggtctggagtggagactgtgaatgtgtatttataaagaattcccaagtgctattggtggtttggcaaccacaccttgagaactactggcatacaataatcatttaatgtttgctagatcaatagttactatgagtcaatgaatgcttaaaatagtaatatagattcaaacttcaaacaatatgaataaatgataagaaatagtcatataactttaaaattttagtttgaaagtaaaaggaagatcatttagtcaaatactctcttattgttgattcataaatgagatctggaagggttaaatgacttgtgtgaggaaaaacaattagattcaatcaaccctaagcttcataaaaataaaataactatacatgtaacatttgttcttagctacaaagggattaattttccaaattcagagacagagatagagcagattatattttccctagattagtaggtctttgcatacaagcactaatttcccaaaaatgaataaaatactactaagtttcagtgctgctcttcatatttctgagatgcatggaaaagaaagtagaaatgaagatctcaatgtgtcagttaaggtttcagattctcacccctccaagtagtgtttgagcaagcaagttacttcagagagatgtacataggccttcaggctttaaatagtttgatggacagtctggttatcaaagaaagtctcacgacaaagtggtatttcctttgagggtactaatgttcaaaagggaatgttcaaacaatataatttttttgcaaaatgaaagtatgttggaaaaaatgaagagatgcaataaaatgggttgctgtttctcattagctaggtctattatcaattaccaagtacaattacaataattatgggcaaagagtcaggagatctagatctagtcagagctgtgttatcaagaaaatatttcagaaaatcttgtccatataaagtatatcaaatgtgtgttacatgaggaaaaatattattttgacatctttatccagttgtgttaccaactattaaaatttgtactcgatgctgtcatctatacaatgaaacaaaatttttaagacctaattatttttttttcagtgtgtggtcttatgaccccctgcatttgaaacacctagggattgtttctcaaactttaaggtgtatatctatgcacgtgagtcatctggagacgtttttaagatgcaaattcttattccataggtcttggatgaggcttgaaattattctcttctaataggcacccaggtaatatccatgcttatatggtcctgtttgactatcagggatgcagggatgctacttacaaacaatctctctctctctctctgggtgtgtgtgtgtgcacgcgcatgtgtgtataaatataaataggcagataggtcaatagaatcaatctcgggaattaagcctgaagatcagccttccaaaaaagcaatgccctccccagttcttaaaacaatcacagttgacgcctacttgtttaaatgaacttcagtgtctaagttaactttcagctatacagtaatgtggatctagtctcaccgtgatattctcctaaatcctaaattggaagcctgccatagtctcttagttctcagtaatttacagggcatctgtgttgttgaagtatgaatgatctgcaaatacctgccaagctccctgcctgtcgattccaaatttaattagattctgatcttttgccaaaaagcctaagataaaacctattgtactatccataggtatgagatttttcttaaaaatcgacagccaaacaatttcatacttcttttagaactcaatttaaaaaaatagcataacattttgtttttgccccatcactggcttttctgtagctactcccttaaattcactcttaactcccttcatgcctcctctccacgatatcttagttctttccatgaaatgtgcacctaaataaaatgccttatacattatgtaacacaaaataggtacattagacccaggtaaattagttccttcatcttaaaggatttctttttttttgtaactgagtattcaaatattattgaatatagcaaaacaaaataatatgatttctgatacaccctaacaatgtttttttttaattttattttcccttccttacagtataagcaagtggaacaatacatgtcattccataagttaccagctgatatgcgtcagaagatacatgattactatgaacacagataccaaggcaaaatctttgatgaggaaaatattctcaatgaactcaatgatcctctgagagaggtaagatttattgtcctcagtatgcataatacataatcattgtttattttctctcttcatggagaatcttctagtccacgttactctaaagaaaaacctaaacttattaagatattttgtccttatcttctttagcttctcacctacataagctcttaaatgttgaaaaaagtattggaaaattgttctatttatgatcctcagaactgttctcttgtctgtatttctggctctttaaaattccttcttgtggcctcattgtctatattgtccccatttttctccccctcattcttatcaaactgattcttctttttgattcctattcttcctcccatcttcactttcctggatcatctcatggaccctgataagacaatgacttgctgtgagcagttcatttcctattatctcattcaaacactttgcaacattaataaccacctctttgctttgcatcatctttctgttcctccctagaaatctgccttcttcccactagaatattcagatcactcctggaccaaaataacttgctcttggttattcatatttctttattttattttattattattatactttaagttttagggtacatgtgcacaatgcgcacgttacttacatatgtatacatgtgcgatgctggtgtgctgcacccattaactcgtcatttagcattaggtatatctcctaatgctatccctccccctccccccactgcacaacactccccagagtgtgatgttccccttcctgtgtccatgtgttctcattgttcaattcccacctatgagtgagaacatgcggtgttcgattttttgtccttccgatagtttactgagaatgatgatttccaatttcatccatgtccctacaaaggacatgaactcatcatttttatggctgcatagtattccatggtgtatatgtgccacattttcttaatccagtctatccttgttggacatttgggttggttccaagtctttgctattgggaatagtgccgcaataaacatacgtgtgcatctgtctttatggcagcatgatttatagtcctttgggtattacccagtaatgggatggctgggtcaaatggtatttctagttctagatccctgaggaatcgccacactgactttcacaatgtttgaactagtttacagtcccgccaacagtgtaaaagtgttcctatttctccacatcctctccagtacctgttgtttcctgactttttaatgatcgccattctaactggtgtgagatggtgtctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttataaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgtctaggttttcttctagggtttttatggttttaggtctaacgtttaaatctttaatccatcttgaattgatttttgtataaggtgtaagaaagggatccagtttcagctttctacatatggctagccacttttcccagcaccatttattaaatagggaatcctttccccattgcttgtttttctcaggtttgtcaaagatcagatagttgtagatatgcggcattatttctgaaggctctgttctgttccattgatctatatctctgttttggtatcagtaccatgctgttttggttactgtagacttgtagtatagtttgaagtcaggtagcgtgatgcctccagctttgttcttttggcttaggattgacttggtgatgcgggctcttttttggttccatatgtattttaaagtagttttttccaattctgtgaagacagtcattggtagcttgatggggatggcattgaatctataaattaccttgggcagtatggccattttcacgatattgattcttcctacccatgagcatgaaatgttcttccatttgtttgtatcctcttttacttcattgagcagtggtttgtagttctccttgaagaggtccttcacgtcccttgtaagttggattcccaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtggcagttttcaaagggaatgcttccagtttttgcccactcagtatgatattggctgtgggtttgtcatagatagctcttattattttgagatacgccccatcaatacctaatttattgagagtttttagcatgaagagttgttgaattttgtcaaaggccttttctgcatctattgagataatcatgtagtttttgtctttggttctgtttatttgctggattacatttattgatttgtatatattgaaccagccttgcatcccagggatgaagcccacttgatcgcggtggataaccttttagatgtgctgctggattcggtttgccagtattttattgaggctttttgcatcaatgttcatcaaggatattggtctaaaattcttttttttggttgtgtgtctgcccagctttggtatcaggatgatgctgtcctcacaaaatgaattagggaggattccctctttttctattgattggaatagtttcagaaggaatggtaccagttcctccttgtacctctggtggaattcggctgtgaatccatctggtcctggactctttttggttggtaagctattgattattgccacaatttcagagcctgttactggtctattcagagattcaacttcttcctggtttagtcttgggagggtgtatgtgtcgagaaatctttccatttcttctagattttctagtcagtttgcgtagaggtgtttgtagtattctctgtgggcagtttgtatttctgtgggatcggtggtgatatcccctttatcattttttgttgcatctatttcattcttttctcttttctactttattcgtcttgctagcggtctatcaattttgttgatcctttcaaaaaaccagctcctgcattctttaattttttgaagggttttttgtgtctctatttccttcagttctgctctgattttagttatttcttgccttctgctagattttgaatgtatttgctcttgcttttctagttcttttaattgtgatgttagggtgtcaaatttggatctttcctgctttctcttgtgggcatttagtgctatgaatttccctctacacactactttgaatgtgtcccagagattctgttatgttgtgtctttgttctcattggtttcaaagaacatctttatttctgccttcatttcgttatgtacccagtagtcattcaggagcaggttgttcagtttccatgtagttgagtggctttgagtgagtttcttaatcctgagttctagtttgattgcactgtggtctgagagacagtttgttataatttctgttcttttacatttgctgaggagagctttacttccaagtatgtggtcaattttggaagaggtgtggtgtggtgctgaaaaaaatgtatattctattgatttggggtggagagttctgtagatgtctattaggtccgcttgctgcagagctgagttcaattcctgggtatcattgttaactttctgtctcgttaatctgtctaatgttgacagtggggtgttaaagtttccctttattattgtgtgggagtctaagtctctttgtaggtcactcagaacttgctttatgaatctgggtgctcctgtattggatgcatatatatttaggatagttagctcttcttgttgaattgatccctttaccattatgtaatggccttctttgtctcttttgatctttgttggtttaacgtctgttttatcagagactaggattgcaacccttgccttttttttgttttccatttgcttggtagatcttcctccatccttttattttgagcctatgttatgtgtgtctctgcacatgagatgggtttcctgaatacagcacactgatgggtcttgactctttatccaatatgccagtctgtgtcttttaattggagcatttagtccatttacatttaaagttaatatcgttatgtgtgaatttgatcctgtcattatgatgttagctggttattttgcttgttagttgatgcagtttcttcctagccttgatggcctttgcaatttggtgtgatttttcagtggctggtaccggtcgttcctttccatgtttagtgcttccttcaggagctcttttagggcaggcctgctggtgacaaaatctctcagcatttgcttgtctgtaaagtattttatttctccttcacttatgaagcttagcttggctggatatgaaattctgggttgaaaattcttttctttaagaactttgaatactggccccccactctcttctggcttgtagagtttctgctgagagatctgctgttagtctgatgggcttccctttgtgggtaatccgacctttctctctggctgccctgaacattttttccttcatttcaactttggtgaatctgacaattatgtgtcttggagttgctcttctcaaggagtatctttgtggcgttctctgtatttcctgaatctgaatgttggcctgctttgctagattggggaagttctcctgtataatatcctgcagagtgttttccaacttggttccattctccccgtcactttcaggtacaccaatcagacgtagatttggtcttttcatataatcccatatttcttggaggctttgtttgtttccttttcttcttttttctctaaacttcccttctcacttcatttcattcatttcatcttccatcactgataccctttcttccagttgatcgcatcggctcctgaggcttctgcattcttcacgtagttctcgagccttggctttcagctccatcagctcctttaagcacttctctatattggttattctagttatacattcgtctaaatttttttcaaagttttcaacttctttgcctttggtttgaatttcctcctgtagctcggagtagtttgatcgtctgaagccttcttctctcaactcatcaaagtcattctccatccagctttgttccgttgctggtgaccaactgcgttcctttggaggaggagaggtgctctgctttttagagtttccagtttttctgctgttttttccccatctttgtggttttatcgacttttgttctttgacgatggtgatgtacagatgggtttttggtgtggatgtcctttgtgtttgttagttttccttctaacagacaggaccctcagctgcaggtctgttggagtttgctagaggtccattccagaccttgtttgcctgggtatcagcagcggtggctgcagaacagcagattttcgtgaaccacaaattctgctgtctgatcgttcctctggagtttttgtgtcagagaagtagccagccctgtgaggtgtcagtctgcccctactgggaggtgcctcccagttaggctgttcggggatcaggggtcagggacccacttggggaggcagtctgcctgttctcagatctccagctgcgtgctgggagaaccactgctctcttcaaagcagtcagacagggacatttaagtctgcagaggttactgctgtctttttgtttgtctgtgccctgcccccagaggtggagcctacagaggcaggcaggcctccttgagctgtggtgggctccacccagttcaagcttcccggctgctttgtttacctaagcaagcctgggccatggagggtgcccctcccgcagcctcgctgctgccttgcagtttgatctcagattgctgtgctagcaatcagtgagactccatggatgtaggaccctccaagccaggtgcaggatataatctcctggtgtgccggtttttaagcccatcagaaaagcgcagtattagggtgggagtgacccgattttccaggtgccatctgtcacccctttctttgactaggaaagggaactccctgaccccttgcgcttcctgagtgaggtagtgcctcgccctgcttcagctcgctcatggtgcactgcacctactgtcctgtgcccactgtctggtactccctagtgagatgaacccggtacctcagatggaaatgcagaaatcacccatcttctgtgtcactcacgctgggagctgtagaccagagctgttcctattcagccatcttggctgccaaccattattcatatttcttacacttctttgccctctcctttcttttactgccaatcttctcaaaaggtttctatgtactcaatgaattatggtttggtcttagcttctttaccaaagtttttcatttgaaagttgtcaatgacctgtcatgttgaactgtagcttctacatttcccacatatcatgggagggaccccgtgggaggtaattgaatcatggggatggttaccacatgctctgttcttgctagtgagtaagttctcacgagatctgatgattttaaaaggtgcttttatcccttttggtcgatacttcttctttctgccaccaagcaaagaaggacgtgtttgcttccccttctgccatgcttgtaagtttcttgaggcctccccagccatgctgaactatgagtcaaataaacctctttcctttatgaataactcattttcgagtatgtctttattagcagcatgagaacaggctatttcagtaaactggtacagagtagttgggcactgcttcaaagatacctgaaattgtggaagtgactttggaactgggtaacaggcagagattgaaaccgtttggagggttcagaagaagagagtaaaatgtgggaaagtttggaacttcctagagacttgttgaatggctttgaccaaaatgctgaaagtgctatggtcaataaagcccaggctgagatggtctcagatggagatgaggatcttgttaggaactggagcaaaggtgactcttgttatgctttagcaaagagactggtggcattttgcccctgccatagagatctttgtggaactttgaagttgagagaaataatttagggtatctagtggaaaaaaagttctaagcagcaaagtgttcaaaagttgacagagcataaaactttgaaatattttgcagcgtgaccatgtagtagaaaagaaaaagcccactttctggggagaaattcaagccttctgcagcaatttacatcagtgacaaggcgttggatgttaatcaccaggataatggagaaaatatctccagggcatgtcagagaccttcccattagcccctcccatcacagacctggaggtctagggggaaaaaatagtttcatgagctgggcccacaggctgcctgctgtgtgcagcctagggacttggtgccctgcatcccagttgtttcagccattgataaaaggggccaaggtacagctcaggctgtggcttcagagggtgcaagccccaagccttgggatcttccacatgatgttgagcctgtgggggtcacaaaagtcaagaactgaggtttggtaacctccacctagatttcagaggatgtatggaaatgcgtggatgtccaggcagaagtttgctgcagggacagggccctcatggagaacctctgctagggcagtgtggtagggaaatgtgaggtcagaacccccacagggagtctccactgggtcactgcctagtggagctgtgagaagaggaccaccatcctccagaccccagaatggttgatccaccaacatcttgcaccctgcaactggaaaaactgcagatactcaatgaatccccacccatgaaagcagctggtagatgggctgtaccctgcaaaaccacagggatagagctgcccaaggccatgcgagcccacctcttgcatcagcatgccctggatgtgagacatggagtcaaaggaggtcattttggagctttaagatttgactgccctgcttattttggatttgcatgaggcctttacctcttcattttggccaatttctcccatttagaatagctgtatttacctgatgcctataccctcattgtatctaggaagtaagtaatgtgcttttgagtttgcaggctcatagacagaagagactttccttgattcagatgagactttgcactgttgacttttgagttaatgctgaaatgaattaagactttgggggactgttgggaaggaattattggtttggaaatgtgaggacatgagatttggtagggggcaggggtggaatgatatggtttggctctgttcccacccaaatctcatcttgaattgtagctcccataatccctacatgtcatgggaggtacctggtaggaggtaattgaatcatggggcagttacccgcatgctgctattcttgtgatagtgagtgagttctcccaagatctgatggtattaaaaggagcttcttccccttttgctcatcacttctccttgctgccatcttgtgaagaaggacatgtttgcttccccttttaccataagtgtaagtttcctgaggcctcccctaccatgctgaactgtgagtcaaataaagctcttttgtttataaattactcggtctcagttatgtctttattaacagcattataatatactaatacacctgttaattattgataatttttctaagatgctgggaccactttttatgctgttaacaaaacacagttcctgaatctctcccaatatatatattttttttatttttaatttttttttggcttctttaacactgcaacatttctgagccattggattttcattctgtatctttgaatttattatcttttatttatattatctcacatttcaattctataaactgtagttctaagttcctgccttaaagttcatttcctctaaagctaaatgatatcccctgcacccacacatgtagtagattatataatgaagtcatttttcttccatcattaaaccattttatctcttaaagtctctctgtacattctttagtcattctcacaagttatttggaatgtaaaactttagccctattttgcagcttttctttctgtgctctgtacatccaatcatcaaatgctatcaattaactttagtaatacatcttacattcatgcctttgcttcctttcccactgccattgtcctaaactaaagcatctcacatagactattttcactgttcccttagtttgccttccagcatttggtctgatttctctgactaccatttaaaataccacggtcaaattaatcttttatttacataagttagtcatttctctgctcagaaactttcagtctttgcattataaattgaatcaagtatagactccctaagctcatcttccagtccctctatactctgactacagctaaatctccagctttcctttcccccactgtcatgtctgttgcaaagtggcctacaacaaaattgtgcaacttgctgttttgaaaaaatcagttatgatttctcacctttaccacatgtgttccagaaatgtctctcctctcttgggaaaattgaattcaaataatacctatttatttctatttatcttatttgatcagctatgagactggatcttatatctcctttctctggccctcagtgtacttagtccgtaatataagagtgctacttatccattctacccatgttattattattttttcatatttgttttctccacttttgtcttgaaagtcccctatgtgcaaggaacatttcgtctatgttttcaaattttgttaaaattcctagtatgtttactataagtttaaaaacaagtatttgtattccaactaatatcttcaccatttataaacttatctaaatttctgtacccactaaaagttttttatattttttgaatagccataagataccagttaagagttttaaaaatatgaggctaaatatctgctattggttagtttattttccctacaaatttctcaatcaaattagaatgtataactatttttgcttttggaaatatacttcaattttttatattttgttaaaagaaagaaataagctgggagcagtggctcacacctgcctataatcccagcattttgggtggccgaggcaggtggatcacctgtggtcaggagtttaagaccagtttggccaacatggcaaactccatctctaataaaaaatacaaaaaaaaaaaaaatagccaggtgtagtggcatgcacctgtaatcccagctagttgggaggctaaggcaggggaattgcttgaacctgggagtcagaggttgcagtgagttgagatccactgcactgctgcctcagtgacagagcaaaactccatctcaaaaaaaaaaaaaggaaagaaatatatgaaaagatttcaaaaagatcatagaaaatggaattaaaagataaatgtaaaaatattcacttcatttctccacataagctccataacctctatcaagttcaagacccttttctaagcaatgatacgagccatgttgttcatccctaaagaattgagggtcctgggaatttaaccatgtcaacgcaatctggttcacattattcactgaagaaaaatgggtgccctttacagatttttttaatattaggaaacaaaaataagtcaaacagagccaaattgagatgataaggtagatgcctaatgatctcccatcaaaactctcacaaaattgcccttgtttgatgagcagagtgagtgggagtgttgtagtggtggaagactctgctgaagcttccctgggtgtttctctgctaaagctttagctaactctctgaaaatattctcataataagcagatgttatttttccttgagacaggttctcactgtcatccaggctggagtgcagtggtgaaactatagctcactgcagcctttacctcccaggctcaagtgatcctcccagttcaacctcctgagtaacagagactacaggcatgagccacctttgcgcttaaccagtctgcttttgctttgactggaccacttccatctcttggcagccattatttttatcatgttttgtcttcaagatcatacttgcaaagccatgttttatctccagttaaaattctttgaagaaatgcttcaggatatttatcacatttgtttaaaacttccattgaaagctccactcttatctgcagctgatctggctgcaatggttttggtactaatggagtggaaagtttgcttaagtttaatttttgagtcagaattgtgaaagctgagcaattgtgatgtctacgatgttggttattgtttccgctattaatcattggtctccttcaaataaggcaaaaacaggttgaattttttccttgcaaattgatgcagatgatctgctgttatgggcttcatcttcaacattgtctcattccttcttaaaatgagtgatccatctgtgaacggctgattcatttaggacattgtttccataaagtttctgtgaagcattctttacaaaacagtatcaggaataaagatcaaataaaaagacagaaagataagatagaatgaaggatatattccaagaagttaaggaaatgttatctagttaaaatctcattgagggaatgcaaaaaggattttttactaaaactttatggaaatgatgccccaaatgaattagcagtttatagatggatagctcattcttccatccaagcttcagcatgaattggatgtttgctcctgcttcaattttataattcatatcgctctgagagaggctattttaaaactgatgtctcattcttcttagtgccttaaactagatcctattcagatgtgttgtaagaagtttctacaagtttattttgataaagaaaataggaaattcatatatagctttttcataatatgcaccttccataagctttttgaagaccctggtatcagttgtttaaaaaaaaaaactctatcaacatattttgctttttaaatctaaaacttcttcacaagaaaagcagaatttcaggacactggaaccagattggattctcaggggcctggagaggttcaaagtagagtgagacagatcatagcaaggagacaaaggtaatccaacagacagtatcaggaataaatatcaaatcaaaagacagaaagacaagataaattgaagcatatattctaagaaggcatggagaagttaggattccagaataaaatctcattgaaagactgcagaaagacaacagcacaactgagaataaaaatgaaccctagtaatgtgtacccttaaatgggaagtattcttctaggcagaaaattctcaaggtaatatataatgaagataacaagaacattttctgtgtcatgtgttttattaactattcttcccagccggacatggtggctcatgcctgtaatcccagtactttgggaggttgatgcaggtgggttgcctgaggtcaggagttcgagaccagcctgaccaacatagtgaaacccagtctttactaaaagtacaaaaaaattagctgggagtggtggtgggcacctgtaatcccagctactagggagcctgaggcaggagaatcacttgaacctgggaggcactggttgcagtgggccaagatcatgccattgcactccagcctgggcaacaagagcaaaactctgtctcaaaaaataaataaatacatacataaattaaaaactattcttcctcctgccacaccataatttacactgatcttcactggaaaaaatatccacttttcacttttacgtgcatcctctgacaaaccttttatttcctcaattcctacaatcattcaattgctaaattgtgactaatattttttctttatatatttaaatgccatattcaggttctcaacattacctcaacatctgtcacaacttttctccctggcttgaatgtcaattagctaaaatgcattccattacagagctaccatattgattgatataaaacccaaatttgacaatgtaactttcttcttagaacctgctcatgacctcttattcccttcagggaaaacacccaaactccttcatatgacacagaggctcttcatggcctgccttagtcttcctttcttcacattaatgcttcatctatagagtattattgacaatttcctggaaaataaatgctattgatggcctttttgcctttcttcatgctaccgtatcttcattcctttctactcagcttaccttctactttcctgtaagcatttttaccatttataagttacctaacctcattcataaattttctgtcactactctgtctctctcacagcatttatcatttgttagtttattatctctttaaagactatgagcttcttggggataggagctgtgcttaatatccttgtatttctagtaaccagcatgcagtaggaagtcatgaaatatttactgagtaaaaggtcttctttaacagagtcgtgaatgaaaatcatactaagaatcatgactgcttaataaaatgagagatcctagaagtggaagcatgaaatgctcagccagttaacaccttgtaaaggtgaaaacagggtttctccatgtgcttccctactcttcagcttttgcttttctaatatcagaatcacacaaaggtctaagtttaatgctatacataagttaacagtttatttgaagggaaaaagcatgagtagaataagaaagtaaagaaacgtatggcagaaagataacaagttattactaaaatgacactgagtctaaaaacccagacctgatttttgaagaaaagtttagtaagaacgatgagaaatataacatcaaattggagtattatgtacctactacattcaagtcacagtgatagattacaaaaaatgtctaaaaagcagtaaaatatatcaattcacctttcaaaagctgtgtttcacttgggagaggaggaatcaacttaggcaaaggtgtgtttgggtcactgttatgttcttagtgtctagaaagtgcctggcacatagaagacattgaatgacaaataaatgctaaatgagtgaactaggatatccagaaaggcaaagttcaattatttgatatgtattttgtgacaaaagataaaaatattaaaatgtgtatacacacatctaatatacatgattagaattgctcatcataaattcaattttatgtcaacaacatgttatcttatagtatgatttcaacctaaaatacttcattaaataagaaagcttatgaaagtattgcataatttgaggcattaatatatagttaagagcagtgatttaacacaagtctgggaattcagaaacttataaaagtgaggaataggtcataccttcattgtctcacaaacttatacaaatgacttttgcctaaaagtagagaaagaatgtaaaatgcagtggtaaagaaagttaaaattagtctatattcattatcagttaagtctgtactatgttttatccattttatagttcagactctcctttcaatgtgttttaatactgtgaagcccgaagatgtaaaatggcggtaagaactacatttgtgagaactttgaaacctcttacaaaaacctcataccatgcatataaaattaattcagttagctgatatttcaaaaacactactttattgaaagcattctcctattttcacttttgtggcaaaaattaggtgatttatctttttttgtgtgttagagacaaattgttgaaacacctttagcagataactagcccattcttattgttcaaatctcaatacaaatgttatctcctgaagaggccttccctgagaagctcatccaaattagttccctctcagtcattctccatcaatcacatcagtgtttttgttgtatgcatattattatattgtcttatttgcccttaatatttatttgttcattccctgttctgctatatgaactcaggatctggaaaagcaaggactatctttcttaacttcctctatgactccaaccctcagatagtacatattttgtaattacttcgtggaaaaaattaataagtacacaataaataaggattacctacttggcaaatcatctcagagtgactgagtgttaaagcttagagacagcattttgccaagagaacagtagtgcttgtgcttatatggataagaaaagtgatgctcaaaacaaagtcttctgtccacagaactttcttagtatcactgtcagttatactatggtccatgtatttttaatgtattacaaaagcatgctggcatctttagattcctctgtgattatgtttggtatatgcactgtatgacataacatcctatttttatgtgaaaaaatagtttctttttaactttaagaagaaaaatactttataactttaaaaacttttaaaagttctccgtgtttatgcattagtcattcaatgcagagctcacttggaggatggggtaaagatggtggggcgaagaggaaggtaccattatagagggtatacaaatgttctgtctaatcaatcactataacccaatcacattcatggaatagatagaaaatatgttggtttttcttttatattgctactaaggtgagtatttatgccctctgcccccagttcatatgttgaaatcctaatccccaaggtgatgatattaggaggttaagaggaaggggcctttgggaggtgattaggccatgagggtggagccctcatgaatgggatcagtgcttttataaaagaagtcccagagtgatctctgatcccttctgccatatgaggagaacacagcaaaaagctcactgtctatgaaccaggaagtggcccctcactagacaaagtctgccagcaccttgatcttagatttcccaacctccaaaccagaactgtgagaaataatttttttttattcataagccacccagtctgtgatacttttgtgtagcagcccaaattggataaaaccattgctacaccggttctacctagattatgtcaatgactcatcaaacaattgttcaagttcccctgtccaaacctaaatattgagacacttcaaggtatagaagattcacagtggcagataacagttgtgtgttgttcatcctcaagctaggctgtacgtcctgcacactgagctccactggaattgtcagccttctgggaagtgattgtaaagtcatcttaaaaaattatcattccactgtgcactaaaatacttgggtcagatagtaaaggaacattacagttttctgaggaaaattcttaagatgttaccccaaaacatagcattttaaattaaaactattactgtgtggtatattcattatctctaatctgtactctctggttgcgctctggctgtgtctagtcaaatgtatgagtctgcaaagttggcttcagtaatccctagtatcctcccctccctctcagttgctgcctgacctggctttccctggagagccctcctccttgattctcctcccatccacttaacatgctcttatttgcccctggctgctgagaaatatccaaagcttcattgtttgggatagtttaaatcctttttgtgattttctgtaccaccattaataagtatacgcaatttttcagctatataacacataatggatgagaacctactactgaggggctatttcacatcacgattaccagatggccctccttccacaagcctcatttaaatccagctccgctactaactagatgttcaactctgagctattttcttaacttatgtgtacttcatttttctcatcttgaaatgtgaataatgatcataactgcttcacagagttgtaaagattaagtgagcaaaacacataaaaatgcagaaaagtgcctggcacatagtaagtacacagtagaatttaactcttaatgttactacaatgcagtgaaaaataggatagagctcttacagctgttatattttagggagtgacaaacatttaaataactaattgtatgtagttatttgcaagtgctgaaagggtgattcaaagggtatcaggccagtactcaggagggacaccaaacccagcaatatcatatgccccatttcttttggaatgtattcaaacaatctgctagtaagctttcccttcattttatcagccagtttcctggagacattgccttagcatcaaaatttgatattgaaatgttagaatcataagactcatgtatacttctataaatgctggcagtatatttaaaaataaaaactaattagattcattagtagaacctaatagaactaggtagaaccttctgtttatgagtgcctgttggaatgtgtacaaagcaagaatgtctatttttaacatgagcagacttatactgatttgattagagcaaaatggcaaacttaactgtcaagaaagaggttaatgcccttctgagcctgtctccaaagttcagaactgatctatttttaaacaatggattgtgaagagccatgggcttaaaataggtacagatcatgtgtcccagtagaatatagaatgtcagtatatttcattttcacagagcatgaattaggctgagagtgtaatcccatcctgctgacctttaatttgtcgaatagatagttatgcaagaaaacataatttgtatgtatatttatttagtgtaattctgaatcatcttttctaaactacacacttgttgattttttaaatgccttctaaaaatgtgtttaaagttaactaaaatggccataatcatactgtgaagctataccagcatcttataaattttaagatattcatgtaacaggcataaataacaaaagattagcaaaattatgtaaaggatctgatttggccacagtgccgagcatattgtgtgtcactcttttggcctagagcgttgtccatgcatctctgcattctataaaacaaacaaaaattattgattgcttaatgtgtgtgagacattgatccaggcttgacagggaaagtaaattgtaagatgtgatttttcagtctcaaaggaagtacttactatattcttggagaaacaagacatgaacacatgggaaaaaagtataagaaaaaagtaaaatgaggatactagaaatgtaggaagtcacatatagttaattagcggagaaaagaagactgtacctactaacactgttgagaaaaaaaaaagtgtgttcaccatggcctggaatagactgaaaagtcctcagtggaaagagtttgcactaaatttggaagcacatgtggaatttcagtagacaaagaggatacaagatgtaaagaacacagggaaaacagacagaaaacatgcctgtatttccaaaatctagttgctttttcagcttctcatttggttcaaaaagggaaaataaactagagaataaataactttttcttctacaatggcttaagttatagttttatatatgtgcaaatacaactaaaatataagcttgtttttattgttataataaaccatgccttatttctatagttataataaccatgactattttaagtgatcttggagaaaagaggtaagtaatagaactcaaactaaaattatgaagataattggaaaccgaactcaagaagccctgattattactaagaagtcaatacagtcaatggcatcatgcattaacgtaattaagattagataccatcttgccctacttaaaatggcttttatctaaaagtcaggcaataacaaatgatggcaaggatgtagagaaaagggaacccttgtacacgtttggtgggaatgtaattagtgcaaccactataacaaacactttgaaggttcatgtttgacagagatgtcaagaaaatatactggggaatagatagtctcttcaataaatggtgctggaaaaactgggtatccatatgcagaagaatgaaactagacccctatctctagccatatacaaaaatcaaatcaaaatgtattataggcttaaatccagggcatcaaactataaagctactacaagaaatcattgaggaaactctctcagacattggtctgagaaaaaatttcttgagcaataccctacaagcacaggtaacgaaagcaaaaatggacaaatggaatcacatcaagttaaaaagcttctggacgttaaaagaaacaacaaagtaaaaagacaatccacagaataggagaaaatatttgcaacacacccatctaataagggattaataaccagaatttatatggagctcaaacaactctataggaaaaaagtctaataatccaaataaaaaatactcaaaagatttgaatagacatttctcagaagaagacatacaaatggcaaacgggcatatgaaaagatgttcatcatcattggtcatcagagaaacgcaaatcaaaactacagtgagatatcatctacccaagttaaaatacttatatccaaaagacaggcaataacaaatgcttgcaaggatgtggagaaaagggaacccttgtacactgttggtgggaatgtaaattagtacgaccactatggaaaacagtttggagcttcctcaaaaagctaaaaattgagctaccatatgatccagcaatcccactgctgggtatatacccaaaagaaaggaaatgagatatcagagagatatctgcacttccatgtttgttgcagcactgttcacaacagccaaaatttggaaacaactgaagtgtccatcaacatatgaatggaaaaggaaaatgtgatacttatacaaaatgaattacttttcagccataaaaaaaaatgagatcctgttatttgcaacaacgtggatggaacaggaggtcactctgctaagtgaaataagccagacacaaaaagacaaacctcacatattctcacttttttgtggaatctaaaaatgaaaacaattgaactcattgaaggtagggagtagaaaaatggttaccagaggctgggaaagatagtgggagggtaatggggaggtggggatgcttactgggtacaaaaatgatagttagaaaaaaatgttttcacttatttctggcatctgaaaatcaaaacaattgaactcatggagatagagagtagaaggatggttaccagaggctgagaagtttagttgggggaaggtgaggatggttaatgggtacgaaaaaaaaaaatagaaagaatgaataagatctagtatttaacagcacagcaaggtgactatagtgaacaataacttcaccgtacatttaaaaataactaaaagagtataattggattgtttgtaacatgaaggataaatccttgaggatggatacccaactttccatgatgtgattactactcatacaaaagtatctgcattactgtaccaaaatatctcatgtaccccataaatatatacaactactatgtacccacaaaaaaattttaagaaaagattagaaagatgcctgtgctaggtaaagcttctatttagcatccaggctctacactgagctaaatagaaattttaaaaagacaatactgttttccagagtttaaaatcagaaccattaaagaacatatgtatactacatttgtctagcttatataaaccaattttctgttgtttaaaatatccccccagttgacttatatagctagagcttcacattgttaaattatggaaattattaagatatctaatatcatttgattttgaagcttgccttggcagaatatagagtaagataatgtatgtcaactcaatgaattactgatgatgatggtggtgacagtgctgatggtggtggtagtgattttgatgatgataatgatgatattgatttttaaaaatcgactttatgtagaacagcatatcacgtgtttgggtagtttggttttgctgtcattgcaatcatcaaataaattacttagtgcgattatgagcaggtgtgttgagatacataggcatataaacaatataacctttgtgttcaagagtgacagaaaactacaaatattagaaagatctgagctcttgagttgaattcagagtgatgatttaatatatacatgttgattacgtgaagtaaaatattaataagtctaaaatgaaataaacaatattagataaagccactgaaatatttgatgacttaaatttgatattttaaaactacttctcctgttacggttatacacaggatttatatacctataatgtttatttataattgtaaattagggaaaataagtgtattttatagagaagtgactagcctagtgtctgttccctaggaagctgtgttggtgtattaaattatgctttatgataagtaaaacacttaagaacccagtgtgaaataactgttcaataatattatttttacaatgattactgccctaagaactcttaatactgatattaatatatttaaatgttgtcatctcctaagttgaattctacactttacctgatgtaaatgtgagccatgtctacctgttcaatgccaaagataatatgcaggaaaatctagagaaggctaagaattatatctcaaaaactaatgaagaaaagtagaaatatttgacatatatcttaaactgaaattctatcatctaaattatatatttcaaggaaaacaaaaagtggttaaagtaagacagatacaaaggcatataaaataacatttttaaagtttttgcaagtggcttcctggtaaattttacccattagaaattatctcaatattaagcaacccatacttttgagaaagataaaatttccaatatatacattatttgaggtaaaaatatatttgaaaatttttttaaatgaatgagtatgcattagtaggacaagaaacatcaataccaaagaagcatatttgatacttatgaaacaatctataaaacattgtattgagtaataagaatttcttgcaaagctatctcactgaaaaagaaaaggaaacaagtgacatgatacattattgtttgtctattaaaaattattgatgagtcatttaaacttagtttccttttttctaatgctgcatttttaattttttctaggaatggcaagatgattttacatatatatacacatatacatgaaatgttttctgtaactacagaaaacatatatatgtaaaatcatcttgccattatatatatatgtatatatgtacatcatatgtatatatatgatggtgtcttgtgcgtttatttagttaagttttatttgtcatacaaaaataaggtttaatgttccaacaaactgttgatatatccacaatttccttccttgtatttgaccaagctcaatttcttaaagcacaacagtgtaaactccagtatttaataactccccaaatatttatgtatgccaaatgcagcatggcatcatggtttggatcttggaacatacaaaagcacaagtggaaaactaatcaaatacaaagtctggagtttaatagtaattcagcaatgttgatttcttagtgtgaaaaatgtctcatagtaatataagaattaaacctttgagaaaattgtgtaaggggcacatggacacactctatattattgtgcatttttttcgtaaacctaaaatttttccaaagtaaaatctctaattgaaaatctatatatgtaattggaaagaagatggtctttgctctcctatctggaatctccttgactgccccaacttattctgtaaaattaaaataataataccagtctttcatggttgtaaggttaaataaaatgatttgtgtataagaaccttctaagccataagtcacagtacctctttgttattatttcaatcccaattcttgctggatgacaggtatctctgaattttagattctggtggaaatatgaaaatttaaataattttccctaaggttctacagtgggacataaatagtgttaatttaaaaaagattccaaaatacctattccccatatctataaatgtatatgagtcattgcaaaaataatttattctatgatcatttgtttcataaacttctcaggcaccatctcttatgtacaatatgttcattaaaagttttcttacttccactgaatcaaggagacagaaaggggagtggagcagattgtattattgtaataagagagatccagactcctgtgccttttccttgatttttcctaatattatcccccactccctacaccaccactctttctctgagtgacattgtttatctctaagacttcaaaaattgactctatgctaatattgtgtaattccatttataagaggtccctaggatatgcaaattgacagacacagaaagtagaacagaggttaccaggggctggggaaggggaggaaagtggcagttctttaatggttacaaagtttttgttggggatgatgaaaaaggcttaggtatagatagtgaggatattacatagtgaatgtactgacaaattgtatacttatgaatggtcaaactattaatattgttacatatatttaaacagttttttgaaaatagtcttagaaaatggcacccaatcttgaatctattttcctaatctccaaaaccactcctatctgcctcccacttttatctcaatgtcaaagatgcttcacatacaatacatttaaaacaaaatatccttcctccacaacactaaatattgtttaaattaattgtttcccaaactgaaaaactcagaaggtcttgaagtgtgtagactgtgttccacatctatgcaaagtagatgctaatatcgcttattaactaaattgtgtatagtgcttctgccacagttcactttcagagcagtggtagagtagtcctgcctttatctgtggtttccctttccacagtttcagttcgttactagagaataactctggtctgaaaatattaaatggaaaaatccagaaatacacaactcataagtttgaaattgtgcaccattctaaatagtgggatgaaatctcctttgggacgtgaatcctcttttgcccagtggagccacaatgcttgagtcacttcatagtcatcttggttatcaggtaaactgttgctgtatcattatgcttgttttcaagccaccttatctgacttctccaaataaatgttgaagccccactacctcagcttgtatttagatacaggatatttgaagaggtaattaagtttccccaaagcacatcagtagtgatgctggtcattcgtatatgccagagagccataaaatgcttcaagtgaaaaggtgaaagttctctatgtaatatgagagaaaaaaattatatgctgagattgctaagatcttctgtaagaactaatcttctattcatgaaattgtgaagaaaaaaaaaaatgctagttttgctgtggcaccgcaaactgcgacagttacagccacaatcatgataagtgcttagttaagatgaaaaaggcattcaatttgtgtgtggaatacatgaacagaaatgtgttctgattgacagcaaatgggttcagcactgtctgagatttcaggcatcgacatactccccacagaggacaggggactactgtactgatacatcttggcagatcttcagaaggggcaacttcattcttcttgtcacattttgaccagcctaacttgctgtattagttttttagggacgccatgacaaaataccacaaactgggtggcttaaacaaaagaaatgtattttttcacagttctggagactggaagtctgagatcgaggtattggcaggtctagtttcttctgaggcttctctccttgatttgcagagggcttccttttctctgtgcttgttcaccccagatgtcttttctgtgtgtccaaatttcctcttcttataaaaggacgccagtcagccagtcagattggattatggcccaccctagttaattaattttaacttaattacctcttcaaataccctctatctaaatacattctcaggtacagttgcttcaacatataaatttttttgggagacacaactcaacccataacaaatgctaacacatgtaatgtcccataaaaatctaactaaagtgagagataaaagaatgtttaatttatcttagtactcttgcctgattttaggacctgacttgatttccttaggtcctcatgtgcatatacatatattgttatgtttgaattgtgtctgttgctgatttgttaataatgaaaattaatttatgtggattctataataaaattttgaaaaaagtttttaccaaattctccaagtcattttctcacagaattaagtcttcagatgtactctactatcggtgatattctcttaataatattttttagttcagcatacttctggacatttgtttagtttcagcatacttctggacattgtttatgccacttaaaaatcaatcgcttttttatcacctcaaatagacttaactcctattgggcaaatcattcttacaccttgctacagatggacgactggagctaaattgtgctggaccttacaaaaatcaaatgactgctttgagcacctgataccacatagtaaagcagagatacaaattctctaatgaacactcttcctgtcaatatacaattccttaattttagtatttttaattttaatttttgtctgcttctatatttttccctttataatcaaatggaagtgaacactaagagagttttgcattatctgctgtcattctgcatggtaccttaacagaacagtatgtccctatgttctagtaaggcaaagcagtgggactatgctaagacaaaattaatttcaaacttcatttgcatgtgtattgtaaagtttctatgtgattaaatacctcagggccaaattaaatgcataccagaactgtaactacagaaaacattaaaatcttttaatttgtacatctcaaaattcatcttgctctgatcttttacaagatataatttaagccacttagtaataattttttattttaggctaattacctttgacttataacttgaaatctattaatttagcagttaaagaaataacttggtttgtaagcaagtaatagtgaaaaatgctaaagtttgccattatttaagaggctattgcagtctatttctcttcctgcctatttttcttaatataactataattaacataagatgaaacattttgtggccactaaaaagaatggcaatgtgggttatgtcacaatttgggaaatattttgtggtacaagtgtagaaaaaggaaacaaatattgaatatacattatggttacaactacgttaaggtgaactggagattatttgaagggaatacatatataaatttctttcatgaagatgatgacaataaagatatacattttcagttgtttattttttaaaaatttatgtgggtatgtagtaggtgtatgtatttatggggtacatgagatgttttagtacaggcatgcaatgtgatatataaatgtatatgtaatttttttaaggaaaatgcgtggtccttttgttttcaaatactttaaaaatacagtttggtaatttagaaaatgcttgattaatcttaatgaaaggggagttaaataaaacttaaattaaggcatcttatgtcaattcatcagccctcctttttttttacatgtaacttcaactcccaaaatataaataataaaaataagtattttttacccctgtaatttaatacatcatttttgacactcttattattcaggagttgcaccataagatctctttaaaaaataagacagattatagtgcaaatataaatctgtgtaaatccttcctactagagacagagaaatcatgggaaatcctttaaaattaagacattgaagcaggtgctgaacttactagtcaacccttgaatgaatgttcaaaagattttttaattcattaagatctgctagtatgggctgattttctcatatatgcagtgaaccatcttgcaatttagaagacaaaccaccagattaatataagtccattggaaatgctgacggaaaagaatatattttttaaattgccctcatgtgttttcttttttaataatggaatgtatgtgtaatttataatttgccctccaaatttatcatatcaatagagtagctttattatgagttatatgttttatttgttgactttgatcaaaacccacatttattttattatttacaatcatcatgtattgaatatatacatatgtagctttctttctcaattagatgtaggtttccagatacttgttaatctaggagacttggtttccacacctgactgcttatgacttggagtgttttattaatgacagagattttgagttatattccctaaagagttatgtgaatctgaattggaacctggctaatttagaaaaaataccataaatgagtccgcagaggtgctgtcttcctctaaataataacagagatgcaaatgtcatctttggcaggtcagtgaagcaatttttttctccttgtctacctcagagccataatgggggcaacggccttgtaataatcctgagtacattctgttcctgctccagattggtcctacattgtacctacaaacttcttcccacctgggcaccttctatgcaccaagttctgtgttaaacacttcatttctgagctgtcatttccttgggcactaaggactgctccaaaggagtagaagcttggggcactgtatcacaagataatgatgttttattttgtttatttattttaattttccttgattcttattttaactttaaaaaattttttttcacaaatttcgtgtagtcagcgtagagattataattgcagataactttcccagagcttttcagtgacatttctcaaaattaactttggctagctagccatttccagatattgatttattcttcttggaagtcttagcattcaaatcttatttttccaagtgtcaaaccaagccatgttttattagtctgtggaatttcatcttctttttcacctgtctcttcaagttataaataaatattgaaaaatcttactttaggttgaactagtttacagtcccaccaacagtgtaaaagtgttcctatttctccacatcctctccagcagctgttgtttcctgacttttaatgatcgtcattctaactggtgtgagatggtatctcattgtggttttgatttgcatttctctgatggccagtgatgatgagcattttttcatgtgttttttggctgcataaatgtcttcttttgagaagtgtctcttcatatctttcacccactttttgatggggttgtttttttcttgtaaatttgtttgagttcattgtagattctggatattagccctttgtcagatgagtagattgcaaaaattttctcccattctgtaggttgcctcttcactcagattgtggtttcttttgctgtgcagaagctctttagtttaattagatcccaaccatcatggaagttggtgtggcgattcctcagggatctagaactagaaataccatttgacccagccatcccattactgggtatatacccaaaggattataaatcatgcagctataaagacacatgcacacgtatgtttattgcggcactattcacaatagcaaagacttggaaccaacccaaatgtccaacaatgatagactggattaagaaaatgtagcacatatacaccatggaatactatgcagctataaaaatgatgagttcatgtcctttgtagggacatggatgaagctggaaaccattctcagcaatctatcacaaggacaaaaaaccaaacaccacatgttctcactcataggtaggaactgaacaatgagaacacagagacacaggaaggggaacatcacacaccgggcctgtcgtggggttgggggatgggggagggatagcattaggagatatacctaatgctaaatgacgagttaatgggtgcagcacagcaacatggcacatgtatacataagtaacaaacctgcacgttgtgcatatgtactgtaaaacttaaagtataataatgataaaaaatgaaaaaaaagaaaaattttactctatgtttgtcttgttgaattctttctaaattaataaaggtttttaaaaaatctagaaaggcattctaccattttatttttcattcccttctatatgatatcatgattgttctacagcagtgcttactgtccagtgaagatgtaataggaattatataatttaaattgtctagtagttatactaagaaataaaaaagtaaaattaagtgtaataaatttgttaactaaatatatccaaaatgttatgatttcaacacacaatcaatataagaacatcattcgtgagatagtttatattcatttttttatcaagtcttcacaatctggtgtatattttaatacttgcatcacatcttgatttggatgctgaatttttctcagaaatgcttaacctgtatgtagatttcatacagtttacaattgaagaagtatatccacctgtccaagtgtcttcaagcataatttaccattttctaaaaacggaactgtatcagtttttaactttaagcttaaatgggttaacgttaaataaattaaaaactcagttcctccctcacactagccgtgtttcaagtgcctgaaaaccccatgcaattaggaactattatatcagacaaggttgctcaaggaacagactgcatacctcttagtagtagtaggtttcacttcctacatgctgtgatttttgtcaaatgacaaccattttgagactcatttggtttatctataaaattgggttaataatgtaactgcaggttgagcattcctaatctgaaaatccaaacttctaaatactctaatatctgaaactttttgagcactgacaggatgccacaagtgaaaaattccacacttgacttcgtgggacaggttgcaatcaaaagtttatttcatctacaaattattttaaaatattgtgtaaaattaccttcaggctgtatgtttgaagtatatatgaaacataaatgaatctcatgttcagagttgaatcccatccccaagatttctcatttgggatatgcaaatattctaaaatgagaaaaatcaagaatctgccacatttctggtctcaagcatttcacataagacattctcaacctgtgtttcattgggttgttgttataattacatgagaaagcacaaagcatttaataaatattagtgaatatcatcattgtggtcattatactacatttagaccagtggaccctttaaaaaatctaagaaaagctgccatctgtttcacataacacacaaacacagtattcacctatttgcatataatttcaatgggtttaggacagccacccaaagcccattaacacctttattaagtgtccttaggctccatgtttacattttttaaattaattgttgtatagctccagctaccaagactccagttgtctcttaaaacatttgtgactatgtcacggaattattagaggaaataagttcatattaaccaggatgcttatttaccaatataatgctgaatcatttagttatgcctcaagatctcatttgttttcttccatatttaccttttacactaattttctggtgaggcacagaggaaatgcttcttatttacctgacatataaatgaatgtatataattgaagataaagttatttttgtatgcaaaataaacattgcttttcttagttttcaaaaaatatttgaccatcattaaagcagttatctttgcacagcaaaaattgaatcatatgcaataaaatgcaagatttttaaaatataccttaactagaaccatgtatgtttaaataatcccacaacagtaaacgtattgctattaaatgatctgccataaaaatacgtatgtgtgtaaaatatggcattcaagctggtttaaaatgtaaattgtctaagaaatacatttaagcaaaaaaaataggtattagtctccaatgggcaaaattttagattaaagaagctgtaaaatgctaaaagtgactcttttttttcattttgaaatatacactattgcaaaatataaagctgtggtttaattctacgtgctaagctttcatgacttttatccagataacagggaggccccactgtggggtgaaatgagcacagttagttttctctacacatattctagctctgtagccttggcaatacttttcctctctctaagcaccactttcttcttctgcatatgttgaagaaataaaacaaaatttaagtttattgttacgttgtttttcccccaggaataaataagtgagatataatatgcgaactacctagctcaaaatgggggcttaataaatcaggttcccatcctctttctacatccctaatttgtaatcaaaataaattacaaatgttattttgggggctgtgtagggagatccagagataccgttgaggaaacaaatagaaacatttctttgaaaggaaggtataaagggcagtcattgacaagccacaaagaaaattttcattttgttgacactgtcccctgtgatgtaagacatgaatcccccagtagacaagaacaaataccggtctccctttcttttcttgcagttccttggtttagtgtccaaagatctcaaattctattgctttaagaagccagtcagcctaattgtagaaagtagagatgttaaatacagacggtgttttaaaaactgtgacgaatagaaatgtacatgctatgtataaagggattcagattcagatttttaaaaaccattcggatttttaaaagccaatgtatagccttcagttgccacctgacaatcaacaaatgtccatgtctgtctttgcaaacatatataactcaaaaaaacaaattgttggttaatatctaaaccttcaagatttgtggtgattctagatttgtgcaaaggttaaggtggcttctcagaatccatcaaaatcccaaagtagcaagccaggctgccctgggataccatagttcctcctcttgcaagcatgtggttactggcagactatataacatctacaaaatggggcagtaatactacctaagacataggattattgtgagggtaaaataaattaatatttgtaaaacatttagacaatacctaaaacccagcaagaactcaatagatgttgactcttctttttattacattcattcttagaattatctttacctcaaaaaaactccctaaacataccaactgctgttttgattataaagaacccaagctactgaattggaaagaaaaaatgggatatttggagcactttttaataggatgttctctaggagatgaggtgtcatgtggtatagatttgcttccatatatttatttgtttctaaagtcaatatagaaatctccaggtagggatgtcttttgaatgtctaagttcttagaaggaagatcttatatgctctgtatagtctaaaaatatagggtgtgttggagtgtagaaatttagcaatgtaacagcagctctattttgttaagattactctatgattcatttgtgtaatggtggaaattatatgtatagctaccatgcttaaaacttttcagaaatatactgtttagaataatcataatgtaaaatggagctgaattagaggtttcacgaaattggactttatacagtgatatttaagttatcaatataaagttacagtgctaaaggaaccttaaagttttgctattcttttttataataactaaatgagatattgcttaaaatttcttaaagtttcagagtatttagaattccaaaatacagatttgtgattaacataaatccttctagaagcaatctgaatatatcaaactcattttttttctggaagttctaaagctaaaaaaaaaaccaggaaacaaattaccaacaaaacaattacaataaaagatactacttagagtgaaaaggcaagccacagatggcgagaaggtatttgcagtgcatatccccaaaaaaagaactcatgtcaagagtataagaagaactcttaacatagaaaaagggggaaactctttactgggcacctcacaaaacaggctattcatctgatcaaaaagcttaggaaaatgtgcataatgaggatactcatgggaaaatgcatattaaaactacaataagaaaaaacacaagtgcaaaaagcaaaacagtcagatatgtcgacttacccaccaatggctaaatgataaaatcaaattttgccaaagatgtgggacaactgaaacatcacctgttgatggaatgagagaataataatagaagcatccaggaaaacttttggcagcaactgtagtgaagtatgtgcttattctattacccagaaattccaatatatggtgtacactcaagccaaatcagtgcataagatgcttcaagaatgttcctcccagcttttaatttttagctgacatttattttattagcctaaaactggtaacaacccaaatgtcatgaagagtagaatggataaataaattgtagtataaccataaaatgaaatatagcctgaaatttaaaaagaatcaactcccacttacaacacttagcaatcacattaacagaatggtgagtaaaagaaccaagacacaaaagactacacagtatgcaacctcatttatgtgactttcaagaacaagaagacctgctctgtagtgatagaaatcagaatagctagaacctctgggttgactaagatgaggcaaaaggagccttctgagaaattgtctatatttgaatccggctggttatacgggtgcatatatattttttaaaaaatgacttaaaatttgtgtacacttaggatttgtccacttcaagttatgttgtaactttaaaagaaactccctacactgtgactaaataatgaacatgaataatcctgtcatattttagcaaaataatgggaaggactgctgtaagcaaatactttttttttctttttttattatacttttctttttattttattaaataatattttttctttttattatacaagttctagggtacatgtgcacaacgtgcaggtttgttacatatgtatacatgtgccatgttggtgtgctgcacccattaactcatcatttacattaggtatatcttccaatgctatccttcctccctcccccaccccacgacaggccctggtgtgtgatgttcccctttctgtgaccaagtattctcattgttcaattcccacctatgagtgagaacatgtggtgtttgtttttttgtccttgcgatagttttctaagaaagatggtttccagcttcatccatgtccctacaaaggacatgaattcatcttttttatggctgcatagtattccatggtgtatatgtgccacattttcttaatccagtctatcattgatggacgtttgggttgtttccaagtctttgctattgtgaatagtgacacaataaacataagtgtgcgtgtgtttttatagctgcatgatttataatcctttgagtatatacccaataatgggatggctggctcaaatgttatttctaattctagatgcttgaggaatcaccacactgtcttccacaatggttgaactagtttacagtcccaccaacagtgtaaaagtgttcctatttctccacatactctccagcacctgttgtttcctgactttttaatgatcgccattctaagtggtgtgagatggtatctcattgtggttttgatttgcatttctctgatggccagtgatgatgagcattttttcatgtgtctgttggctgcataaatgtcttcttttgagaagtgtctgttcatatccttcgcccactttttgatggggttgtttgtttttttcttgtaaatttgtttgagctctttgtagattctggatattagccctttgtcagatgagtaggttgcaaaaattttctcccattctgtaggttgcctgttcactctgatggtagtttcttttgctgtgcagaagctctttagtttaattagatcccatttgtcaattgtggcttttgttgccattgcttttggtgttttagtcatgaagtccttgcccattcctatatcctgaatggtattgcctaggtcttcttctagggtttttatggttttaggtctaacatttaagtctttagtctatcttataatttttgtataaggtgtaaggaagggatccagtttcagctttctacatatgactagccagttttcctagcaccgtttattaaatagggaatcctttccccaattcttgtttttgtcaagtttgtcaaagatcagatggttgtagatgtgtggtattatttctgagggctctgttctgttccattggtctatatctctgttttggtgccagtatcatgctgttttggttactgtagctttgtagtgtagtttgaagtcaggtaacgtgatgcctccagctttgttctttcggcttaggcttgacttggcaatgcaggctcttttttggccccatatgaactttaaagtagtttttttcccaattttttgaagaaagtcattggtagcttgatggggatggcattgaatcaataagttaccttgggcagtatggccatttacacaatattgattcttcctatccatgagcatggaatgttcttccatttgtttgtatcctcttttatttcgttgagcagtggtttttaattctccttgaagaggtccttcacagcccttgtaaattggattcctaggtattttattctctttgaagcaattgtgaatgggagttcactcatgatttggctctctgtttgtctgttattggtgtataagaatgcttgtgatttttgcacattgattttgcatcctgagactttgctgaagttgcttatcagcttaagaagattttgggctgagacgatgggtttttctaaatatacagtcatgtcatctaccaacagggacaatttgacttcctctttttgtaattgaataccctttatttctttctcctgcctgattgccctggccagaacttccaacactatgttgaataggagtggtgagagagggcatccctgtcttgtgccagttttcaaagggaatgcttccagtttttgcccattcagtatgatattgactgtgggtttgtcttaagtagctcttattattttgaaatacgtcccatcagtacttaatttattgagagtttttagcatgaaggggtgttgaattttgtcaaaggccttttctgcatctattgagataatcatgtgatttttgcctttggttctgtttatattctggattacatttattgatttgcatatgttgaaccagccttgcatcccagggatgaagcccacttgatcatggtggataaccttttagatgtgctgctgcattcggtttgccagtattttattgaagatttttgcatcgatgttcatcagggatattggtctaaaattctctttttgttgtgtctctgccagactttggtatcaggatgatgctggcctcataaaatgagttaggtaggattccctctttatctattgattggaatagtttcagaaggaatggtaccagctcctccttctacctctggtagaattcagttgtggaatccatctggtcctgtactttttttggttggtaagctattaattattgcctcaacttcagagcctgttattggtctattcagggattcagcttcctcctggtttattcttgggagggtgtatgtgtccaggaatttatccatttcttctacattttctagtttatttgcatagaggtgtttatagtattctctgatggtagtctgtatttctgtgggatcggtggtgatatcccctttaccattttttattgtgtctatttcattcttctctcttttcttctttatcagtcttgctagtgctctatcaattttcttgatcttttcaaaaaccagctcctggattcatggtttttctgaagggttttttgtgtctctatctccttcagttctgctctgatcttagttatttcttgccttctgctagcttttgaatgtgtttgctcttgcttttctagttcttttaattgtgatgttagggtgtcaattttagaactttcctgctttctcttgtgggcatttagtgctataaatttccctctacacactgctttaaatgtgtcccagaggttttggcatgttgtgtctttgttctcattggttttaaaggacatctttatttctgccttcatttcgctgtgtacccagtagtcattcaggagcaggttgttccatttccatgtagttgagcggttttgaatgagtttcttaatcctgagttctagtttgattgcactgtggtccgagagacagtttgttataatttctgttcttttacatttgctgaggagagctttacttccaactatgttgtcaattttggaataagtgtgatgtggtgctgagaagaatgtatattctgttgatttgggttggagagttctgtagatgtctattaggtccgcttggtgcagagctgagttcaattcctggatatcatggttaactttctgtctcgttgatctgtctaatgttgacagtgggatgttaaagtctcccattattattgtttgggagtctaggtctctttgtaggtctctaaggacttgctttatgaatctggatgctcctgtattgggtgcatatatatttaggatagttagctcttcttgttgaattgatccctttaccattatgtaatggccttctttgtctcttttgatctttgttggtttaaagtctgttttatcagagactaggattgcaactcctgcctttttttgttttctatttgcttggtagatcttcctctatccctttattttgagcctgtgtgtctctgcatgtgagatgggtctcctgaatacagcacactgatgggtcttgaatggaacacagcacattaatgggtcctgaatatagcacactgatgggtcttgactttttatccaatttgccagtctgtgtcttttaattggagcatttagcccatttacatttaaggttaatattgttatatgtgaatttcgtcctgtcattatgatgttagctggttattttgctcattagttgatgcagtttcttcctagccttgacggtctttacaatgtggcatgtttttgcaatggctggtaccggtcgttcctttccatgtttagtgcttctttcaggatctcttgtagggcaggcctggtggtgacataatctctcagcatttgcttgtctgtaaagtattttatttctccttcacttatgaagcttagtttggctggatatgaaattctgggttgaaaattctttctttaagaatgttgaatatgggccttcactgtcttctggcttgtagagtttctgccgagagattcgctgttagtctggtgggcttctctttgtgggtaacccgacctttctctctggctgcccttaccatttttttccttcatttcaactttggtgaatctgacaattatttgtcttggagttgctcttctcgtatctttgtggcattctctgtatttcctgaatttgaatgttggcctgccttgctaggttggggaagttctcctggataatatcctgcagagtgttttccaacttggttgtattctctccgtcactttcaggtacaccaatcagatgtagatttggtcttttcacatagtcccatatttcttggaggctttgttcatttctttttacttttctttctctaaacttctcttctcacttcatttcattaatttgatcttcagtcacagataccctttcttccagttgatcgaattggctactgaagcttgtgcattcgtcccttagttctcgtgccatggttttcagctccatcaggtcatttaaggacttctctacactggttgttctagttagccattcgtctaatatttcttcaaggtttttagcttctttgcggtggatttgcacttcctcctttagcttggagaagttttatcgtctgaagccttcttctctcaactcatcgaagtcattctccatccagctttgttctggtgctggcgaggagctgcattcctttggaggaggagaggtgctctgatttttagaatttttagcttttctgctctgtttttttccccacctttgtggttttatctacctttggtctttgatgatggtgacgtacagatggggttttggtgtgaatgtcctttctgtttgttagttttccttctaacagtcaggaccctcagctgcatgtctgttggagtttgctggaggttcactccagaccctgtttgcctgggtatcagcaatgaaggctgcagaacatcgaatattggtgaacagcaaatgttgctgcctgatcattcctctggaagcttcatctcagaggggtactctgccgtgtgaggtgtcagtctgcccctactggggggtgcctcccaattgggctacttgggggtcaaggacccacttgaggaggcagtctgtctgttctcagatctcaaactccatgctgggagaaccactactgtcttcaaagctgtcagacagggacatttaagtctgcagaggtttctgctgccttttgttcagctatgccctgcccccagaggtggagtctacagaggcaggcaggcctccttgagctgcgaggggctccatgcaggtcgagcctccaggctgctttgtttacctactcaagcctcagcaatggtgggcgcccctcccccagcctcactgccaccttgcgattctatctcagactgctgtgctagcaatgagcaaggctctgtgggcgtgggaccccctgagccaggtgcgggatataatctcctggtgtgccgtttgctaagaccattggaaaagtgcagtattagggtgggagtgacccgattttccaggtgctgtctgtcacagcttcccttggctaggaaagggaattccctgactccttgcacttgccgggtgaggctatgcctcgccctgcttcagttcatgctcagtgggctgcacccactgtcctgcacccactgtctgacaagtgctagtgagatgaacccggtacctcagttggaaatgcagaaatcatccgtcttctgcgtcgctcacactgggagctgtagactggagccgttcctctttggccatcttggaaccgcccccagcaaatacttttatatctaaaataaatagacatcgtgtcaaccaaagaacaaataacaagattctttattgctgtttcattcttgtattatgctgtttcattcttgtatataatatataaaattcaatttaaaatcttagcactaccctttagcagggttaccgtttgccaaatgagaagcatcctcaagagggcattgcataagaaaaatcttcacccaagtgtgtgcttgaatgttttagaagactgaaacaaccattccatttggttgaaaggtggatcccagaaacatctgacataaacatttctatctcatgtcatcttttaagacaccttcttaatgaatacaaatatatgtacaccttgggttccaacgtggactcttcttgacaacaaagattttttcttacttgaaatatttgaggaaatagtttgcagcatttcccatagcatctgagcttatttacttggcttcccagtgtttagcccacagctagaaatttgagaaagctgttgatgaactttgagggtgaaaattccctccaggttccaaggcgaccagtgtactcttcctctgcaattactgctctgtctgaagttttcctcagaggaataaataaagctgcaggtctcatgcattttcaatgagaaaccttatgcaaagaatattactgaaatcacattcttggcatttcttcagtcaacacttttatatcgaactgttccttttatgggcaacatatcctccatggatcataacacttatgccataattatcaacactaaagcaacaagtccactccagagaacttaatatcatttaacttaaaaattatgtcatttctgcatgggtgtttatgccaaatatttcttatgacttattttaacaaaataaaatattagcaaaaattatcaattcccttctaagatgtttaaacaaattttctaatataagctgattgcaaaagtaagaagaaattgaaccagtgtattttaaatagtaacatttgaaatccacccttttgctagtgggcaacttgagatcttttaaaataaaaaccatattgatgctatataaattatgtaataatattccttggagagagaatttctttggaacaacatttttgtttctccctcacttttggtgtgtttaataaatgaatatatatttctaactttgaaataattatagattttttaactttcattttaagttcaagggtgcatgtgcaggatgtgcacgtttgttaaatagatgaacatggagataatgggggtttgttgtacagattatttcatcactcaggcattaaacctagtatccattagctacttttcttggttctatccctccttccaccctccgataggccccagtatgtgttgttcctctctgtatgtccatgtgttctcatcagttagcaaccacttgtaagtgagaacatgaggcttttggttttctattcctgaattaatttgctagggatgatagcctccagttccatccatgtccctgcaaaagacatgatctcattcttttttatggctgcatagtattccatgctatatatttaccacatgttctttatccagtcattcattgatgagcatttgggttgattccatgtctttactcttttgaattgtgctgcaatgaacatatgcatgcatgtctttataatagaacaatttatattcctttgggtttatacctggtaatgggattgctgggttgaatggtatttctgtctctaggtctttaaggaatcactacactgtcttccacaatgtctgaactaatttatgctcccatcaagggtgtataaacgttcctttttatccacaacatcaccagcatctgttattttttgactttttaataataaccattgtgactgatgtgagatggtatatcattgtggttttgatttacatgtctttaatgatcagtgatgttgatctctttatcatatgcttgttggccacatgtatgtcttcttttgagaagtgtctgttcatgtcctttgcccactttttaatggggttgtttgtatttttttttgtaaatttgtttaagttactatagatgctggatattaggcatttgtcagatacacagtttacaaaattttctgccattccacaggttgtctgtttactctgttgatagtttattttggtgtgtagaagctctttagtttaattagttcccgtttgtcaatttctgatttgttgcagttgcttttggggtcttcattataaaatctttgctcgtgtttatgtcctgaatggtattggttatcttccagggtttttatagttttaggttttacatttagtcttgaggcagtaataaatagcctaccaaccaaaaaaagcccaagaccagatggattcacagctgaattctaccagatatacaaagaagagccagtagcattcctactgaaaattttccaaaaagtcgaaaaggagggagtcctccctaacttattctatgagggaagcatcatcctgataccaaacctggcaaagaaacaacaaaaaaagaaaacttcagcccaatatccttgatgaacattgatgcaaatatcctcaacaaaatgctggcaaacagaatccagcagcacatcaaaaagcttatccaccaaaactcaagtaggcttcatcccctggatgtaaggtcggttcaacatacacaaatcaataaatgtgattcatcacataaacagaactaaagacaaaacctcatgattatctcaatagatgcaggaaaggcttttgataaaattcaacatcacttcatgttcaaaactgttaataaattaggtattgaaggaacatacctcaaaataataagagccatatatgacaaacccacggctaacatcatactgaataggcaaaagctgaagtattcccttttaaaaccagcaccagactagggtatcttctctcaccactcttattcaacatagtattggaagttctggccatagcaattaggaaagagaagtaaataaagggcatccaaataagaaaagaggaagtcaagctatccctgtttgcgaatgacaggatcccatgtctagaaaaccccattatgacagcctaaagcttcctcagctgataagcaacttcagtaaagtctcaggatacaaaatcaatgtacaaaaattgtgtcagcattcctgtacaccaacaacagtcaagctgagggataaatctcagaagacattccattcacaattgccacaaaaggaatcaaataactaggaatacagctgacaagaaaagtgaaggatctctaaaaggatagtacaaaccactactcaaagaaatcagagatgatacaaacaaatggaaaaacattccatactcatggataagaagaatcaatattgttaaaatggccatactgcccaaagcaatttatagattcaatgctattcccattaaactaccgctgacattcttcacagaactagaaaaaactgttttaaaattcatatggaaccaaaaactagcccaaatagccaagacaatcctaagaaaaaagaacaaagctggaggcatcatgctacacaacttcaaactctactgcagggctacagtaaccaaaacagcatggtactggtacaagaacagactcatagaacaatggaacagaatacagaaataattatagatttttatttgtaaataaaaacttgatagaaacatatatctgaaattgaaaatgcatgatatatatacaatttgtcttcttatgacagaccacagttattaactccacaacaatataaacagacacattccaggcctgctgcttaaccccagactgtactatgatataattgttttcaagcatttactaggagatctttttaaaagtaacttttaaaagagttaacttaaagaaaatatgctttacatgctatgacaaaatcatatttattttcttaactatgaagagcagtaattacatctttaataagctttttcagaataattttatatttgcagatttcttaattcatttttcattgctataaaggaatacctgagactgagttatttataaagaaatttatttgtctcacgattcagcagcctgtacaagatgcatggcaccagcatctgtttctagtgaggacctcaggaaatattcaatcatggtggaaggggaaggggagcctgcatgtcacatgatgagagaggacatgagagagaaagtaggtgccagacaccttttagcaatcagatctcatgaaaactaatagagtgagaactcactcattaactcaaggacagcaccaaatcattcatgtgggttcttctcccccatgactgaaacacctcctcccatgcaccacctccaacattgggtcaaattccagcatgagacatgaagtgccaagcatccaaactatatcagcaaaaaagtttcagaaatagtatggagaattcccatgtacatcacatccaatttcccccgtttttaataccttacattagtatgctacatttgtaataactacagttatgactcaatattgatacattattattaagtccgaacattactcagattcccttagttttctttaaagttctttttctatcctaggatcccatccaggataccacattatggtcacttgtcatgtctccttagtctccccttgtctgggacagtttcttccaaatttccttgtttttgattaccttgatcatctttagaactggccaaatattttgcagaactttcctgaatttgggtttgctgatggttttgtcatgattaaaatgggattatgggtttggtgtaggaatgccacaaaagtaaaatgctcttctgattacatcaaaccaagagtacatgctaccaacatgatttagcactgttgatgttaacattgattgcctgacttgaggtggagtttttcatgtttctctattggaaagttactacttttcccctcttttccttattgtattctttgaaggaagtccccatgctcaatgctcagcccatccttaagggtttggtaattattctccaactttttgaggcaggagtgcttatatgaattatttgaaattatttggaatttaaacagaaagcttatgtattatccctcactttttagtagtttaaccaatcatttagatttgtatgtgatcttggttatttattttatactttgggtttaatccaatactttttattgttgttactcaagtttttccagctttgtttgaccgttggtaactctttcagttggcccctgtgtccctttgaaataccttcattactgtggggttcttgttctgtttcattttggggattggtctttctgtttgttttttcatttgtttttaccatgtacatactttcttgtactacaaaatgttccaggaaagaaataattgcattttttaaagtgccaacataaacttaataatctggagcaacttattactaaggtcaggaccatgtgtttgccttccttagcaagcaacctttcctcaatttaatgcacatagataatactcctaactcaatcctgatattttgataaaaagagctaattataacaagtgccataagtaatttgaattgacattagagatagtaacagtgtgttttatttgcctcaatgtgccctaaggaaaggtgattgattaaaaatatttttttaaagttttgcttcattctatacttacatgattgtttctactatactagacatcctcagaacaagcagttttcatgggagaatgaaaggtttttagaatccaagaagattctgtctcattaccattttttctatcatatctgttagaatttacagttttaatcaggtaatactcctgggaagtaaaagttgcatgaaggaagaaaacattaatagatttcttcaaacaataatatgaaattattccagtagtgttataataaagggagttctaacagaaacacctggatatgcaatgtatcattaacaagttattcatatgactaaagatcaggttaattgcttatcaaatataattccaactattttctaaaataaaaaatgagagatccatgaagtgaaacatttgcatagttcaaatcaaggtacaaagatgaagggattctctattatttttatatgaaaactcttattttctctacaatctgacttattttcaatttcctacacagtattattctgtcattttacatgtgaaataattaactctcaatcaactcatctagctattttcatgacataactctgtcttcttttaactccacgtcaccttttatcttcctgttgtttttgtatagaaatatttgaaatagtaaaaacaaattttttaatacagaagacttgtctctcaagccatttgcttgagaaagctaagagttttaagtaaccatctcccaacgagaaaattagtctttatgagtacttttttacaactgagactccaccttccttccttccttcctccctccctccttcccttccttccttcctccctccctcctttccttctttccttgcttccttcattccttctttccctccttccttccttccttcctttcttcctccctcccttcttctgtttcttcttttatcccttccttctttccttcccacctgctccctcccttcctcccttctttctttccttcctcccctccttcatttcttccttcgaatggcttcctttatatgcatgcatattgattcagtacttactacttgctgaacattgttatagacccacactccatgcatcagctaaaattatcacaaatttccctagatacagccaatcgtggactcaagtgtgtattttgatttgaataatgatgcaccaagtaccacatgtaatatctttctcttgtctttgctgctaggttcactttctgattattgttgcttatttgtaaatattttctcatcttccatgaagctccactattacagacattgttgtgctttgctaaactcataaaatattgttcaggatgaaacaccttctcttccaagatagattcaaaatgttgtgccttctgttatcacctggaattctttatctatcctggatggcattaggttattttatgaagtaagatcatagaaaccttctttctcagtcttggaattgatgggtcggtatagcacatttccccaaggcagaagatagagttctcagactctgttaatacctatgattccttctgccttcttttcacctcttagcagacatgaccaatttctgtgactcttacacaaaatcacaaatgcagtcccaaccttttttggggtaactaattggtaaggaaatttctgagaattggctttgtggcaaaaatgtaaatttccactgtctcttctgtgtcacataagtgatttgcatgattaaaaatgtttggttccatatttctattttcatccagagggataaaaatatgtctaaccttgatcagaatccacagaatgaaatcaaacatacagatctcctatttgagaattggcctgatcctggaataaaacaaacaagtcaggaaaaggcaaatatgtcctctctctagcccatcacttgcaggggaatcccaggagtctttagaaagaatgatttctgattctagcccagacaccagttgaatttataattttatttttttaatctttttgagacagagtctcactgtgttgtccaagatggagtgcagtggtatgatcttggctcactgcaatctccgcctcctgggttcaagcaattctctgcctcagcctcccgagtagctgggattacaggcacccaccagcacacccagctaatttttgtatttttagtagagacagggtttcactatcttgaccaggctggtcttgaactcctgacctcgtgatccacccgccttggcctcccaaagtgctggaattacagccatgagccactgcacctgatgaatttatacttttagattagagtttcctttgtgtaacctttttctgtactatccattgtcctcactctaatgtgaatgacactaacaaaaaaaaaaaacatcaaaatgtttttgtctggtagctgggcccagacaaaaaggagcacagaagcaggaatggcatagctaataggaagtgatatggctttctttcttcgtaaataaaagataaaaggaagaatagaatgtattcacattttagaagttttagtttcatatacacagtagtaaagaaatgggaagttaaaaaagttgagactttcatatattgaattaacatttatcgaatatttaatacattcctatactacactaggtgctgggaatacaaaaatttcaacataaaaataaaacataatcctgactgtaatatgatgcgcattactagaatttatgaatttttgtatctaaatttaaattacaatgttatgctgtatatattttaaatttcagcatgtttttcttccagatatgattaatatctctcttaatatttgtttactcttgacatctttaggagatagtcaacttcaactgtcggaaactggtggctacaatgcctttatttgctaatgcggatcctaattttgtgactgccatgctgagcaagttgagatttgaggtgtttcaacctggagattatatcatacgagaaggagccgtgggtaaaaaaatgtatttcattcaacacggtgttgctggtgtcattacaaaatccagtaaagaaatgaagctgacagatggctcttactttggaggttagtaaaaaagatgcaactaagatgaaatctaaactgcttgagatttgtatctttaagaattttggagatgtcagcatgtcagttttttggttttgaatgtaaacctgtatgtgaattctgataaaagtgtctataacagtgttttcatatttcagagtcacaggctcaatgtgtgtgcatttactactacattggttgagatattatttcaacctctttatctggaaccaaataataggggcttaagtcaaatggaaagtataatttggtgacctagattccatccatccactaacatgttttgtttcgtttttgtcatctccacaagaggagctgattcctctccaccatgttttgatacggcccatataatggggcagaaataatagaagaaatgaaaaactaacagcttctgtttgatattcctactgcccagaaattgcaaaaatcattgctattcacatatgattgcccagaattggtataggatcaccttcaggcctaaggaaggctgcaaaatgtagcctgtagttagatggcaatttaccttgctaaaaatttacagaaatttgtattgtttctatattagttcattttcacactgatgataaagacatacctgaaactgggaaaaaaagaggtttaattggacttagagttctatatggctggggaggcctcagaatcatggcagaaggcaaaaggtacttcttacatgatggcagcaagagataatgaggaaaaagcaaaagcagaaacccctgatgaacccatcagatcttgtgagacttattccctatcataagaatagcatgggaaagaccagcccccatgattcaattacctccccctgggtccctcccataaatgtgggaattctgggaggtacaattcaagttgagatttgaatggggacacagccaaaccatatttatctccaatttttattaaaattatatatataaaatatatatatatgtttctacacatgtacaaaaaatgcctagaaattgatttactgggtcaaagactatttgatcttatttttagacttaggcaaataacaccaaattgcttctttgataaggctgcctgtttgctttgccaattcagttttagttttgtcttgtgtattagtccattttcacactactgtaaatacctgagaccgtgtaatttataaagaatagagacttaattatctcacagttccacatagctgggaaggcctcaggaaacttacaatcacagcagaaggtgaaggagagacaagcaacttcttcacaggcagcaggagagagaaagcacaggggaaacttaaaccatcagaactcctgagaactccctcaccaccatgagaacaacatgggggcacccattaccatgatccacgtcccaccgcccttaacacatggtgattacaatttgagatgaaatttgttggggggacatagagccaaaccatattatcttgttaataaacaaaaggacataccctaattatttgtatttctgtttgcatttttgttatttctgggaggctgagaaatttcttcttagagttactaattgcttggatttatttttttgttcctattctttgcacatttttctactctgttgtttgccttcgtaaatctaatttataggaatgttccagatatatattttatatgatgcaactattttctcctaatttgttgcttgtttcttaattgcatttacaatatctgtcattattttgatcctcattattgttgatttaaatctgcctattttttcttagggcattaaagattttatgttctgtaagcgggttttacacactgggaaataatggaaatgcttttctttcttttttttttttttttttaaatgacagggtatctctctgtcacctaggctgaagtgcactggcatgattatggctcactgcaaccttgctctgcaggctcaagtgattctcccacctcagcctccctagtagctgggaccacaggcatgtgtccccatgccctgctttcctattttttaattttttgtagagacgggatgtcaccatttgcccaggctggtctctaactcctgggctcaaacaatcctcctcccttgacttcccaaatttctggaatttctggaatgagccaccgcacctgactggaattgcttttcacatttttatctattttatttagttttactacattttatcatgactactctgttattataatttattatattttattattatacatattctaaatacattttttagtattaacccaaccaaagtatatttgtgagtataatatgaaatattctatattatcccccttttttaccccaaagagacaatttttccaaaataattaatgaaggatttcatcctttctgctaacttttgaaatgattccttaataatatgctgactttaagaaatgttcctcatttacagctaagatatatttattaggaaatatttgaattttggtaagtgaatttttttaactttatcaaaataaccatgaggttataacccattaatctattatggctgagtgaaacatattaactcaaattaattaacttctttaacttcctgctcaccaattaaggaaaattttgaagttccattttgaagctttccatttcttccactattctttcttgttaaaatgattctgtgttgtctcattggccccttagccttttgtatgggttattctaagaaaaaagcagattaggaaaagctatgaatctaacagggcctgctttagaaagtgcagagaattaatgtttgaatgaaggggaaaaagaaagagagtattgaagttagatgggataagaaatgaaagtatacagttgatcttgaacaatgtggagattaggggtaccaacccctgctctgtcaaaaatctgcatataatttttgactctgcagaatcttgacaatagtagcctactgttggctggaagccttaacaataatacaaatagttgattaaaacatattttgtatgctgtatatattagatactgtattcttacaattaagttagctaaagaatataaaatatttaaaaattaataaggaagagaaaatatatttactattcatcataataaatagatcatcataataaatggatcatcatcaaggtcttcatcctcatcatttttatgttgagtaggatgaagaggagaaggaagagaaggggttacttttactatcttgggtggcagaggcagaagaaaatccacctataaatgggcttgcctagctcaaacctgtgttaagtagtgaactgtatatgtataggccaggtttggggataaatttgtaggaggaaaagtctttgagtcagtttctggagatttgatgaatatgtagaagaaacatttaaaaagaattttttgaagtgttattatgcacaaagatgggatttgtgaagtcgacatatgttttgtgaattcagaggaggttttaaataccttacagttaatttggtaatatgactaaggttttatacaaagactggaatatgttcctccctggacttatgtgggttaaactattagtacagtgaatcacatcactgaatatccttgtgttaaaccataagatcatttctgagataaaaactattttttcttgatgtaatatttctttaacatagtgtgtcatctctgtccatgagtgagattggtctataatgttgttgttattggagtcatttttgtgatcccctagatgactttggatatcaggttatgctcacttcttagaaagaataataaaactttttcaaaaagtattcgctgttttagagaagtttaaacaatctaggcattacctgttatttgaatatttgttaggcttcacaaataaagccacttgtgtttgattccctgtattttgtggttattaaaatactcaggttttctatttctttaggagtaatcattcagttcatctaattcaattgttcataatactgagtacacattactatctcctggaaagctttaaaaaaatttgatgccaatgccaaaaacctacactatattttctcatataattgagtggagttgaaatccaatcaccagtatgttgaaaaaaatccccagatgattcaaaataatttttaaattaaaaatagttatagagacagagagcgagagatgaagatattgatgtagatatatggttccctttttacggttaaacttttacttcctttttattacaggggctttatatttacataattattgcaaagatcatacagataattccaatgtaaacatctttcattgctatggtatgttggtcaaaactaatgaaccaactgttaaagtacttaataaagtgcatttttcattgagatttttccagtctttacccaatgtcctttttctgttcagaatctgatacataataccacctgacattcagtagtaatgtcttctttggctacttttaatcattaaagtttcttggaatttccttcttcttgattaatttgacagttttaaggagcactggttaaggtatcttgtagaacgtccctcaattgggatttgtctgatgcttttctcaagattagatcggagtaattgttttgggaagaaaaacgagacttaaagtaccattctcatcacatcatattgagagtgcatgctatgaatatatcttattgctgttgatgttgaccttaatcatctaacttgagttagggtttgtcagacatctccattgtaaagttaatttttctttccctcccattccatactgtactctttggaaggtagtcaccatgcacagcccacaagtaaggagcggggagtattgttccacttccttaaaggccacgtatgacataaataatttgaaatcatcctgaacaggaaatttacctattctctttcattatttattgatttatacaatcctttttgtatcagtatggacacttggatatatttattttataatttgggttataatccagtactactttattaattctgttgctcagattgtttcatctttggctattgggatctcttccaattagcccctctgtccctttgtcctcattattgtgggtaaattttttcttatttcctgttaccacaatatgctcctggctcatcttgaatagttcctatcagtctaaaattattcatttcttcaaggaggcttggattctgtaattggagaatggtaattgaaataaagatctggaaagccctgaggtggtgcagggtatcacatggtgagggagctgaacatgctcatgtggaagaccaagttcttctttctctgtttataaagctaccagttctctccgattataaatcatttatacatcaaccaattaatccatgaatggataaatcagttcataaaggcagagccctcatgagccagtcaactcataaagtcttcacctctcagtactgccatattgggtattaaatttcaaggagttttgaaggtgacacatattcaaaccatagcaacatctttcccctaatcttgattttgggagaaagcatccacctatcaccattaagtatgatgctaattgaacagtttttttttcagatgttcttaatcatattgagaaagttatccttcattacagcttttctaaaagtttttctttaatcatgaatgagtgttggatattgtcaaatgtatgtttttctatgccaagtctgtgatcctatgttttttcttctctagtctgtcaatgtggtgaattgttttgattgattttaattttaaatgttgaaccagccttgcatgcctaaaataacttttattgcatcaaaatgtgaaaatgtattggattggatttgctaatattttggtcatgattttgtctctatctttatgagatatattattctatgcatttttattcatgtaatgtgctttctgatttttgtatgaggctgattctcacttcatagaatggatttgaaagtgctccttctgcttccattttctggaaaagatggtggagaattgatatcatttattccttaaatatttggtagaatttactggtgacaacttttgggcctggtgatttattttttgcaagatcatagaataattgatgttgggagcaagccccccaaaatctggccataaactggccccaaaattggccataaacgaaatctctgcagcactgtaacatgttcataatggccctaatgcccaagctggaagtgtgtgggtttatgggaatgaggacaaggaacacctggcccgcccagggtggaaaccgcctaaaggcattcttaagccacaaacaatagcatgagcgatctgtgtcttaagggtgtgtccctgctgcagttaactagcccaacgtattcctttaattcagcccatctcttcgtttcccataagagatacttttagttaatttaatatctatagaaacaatgctaatgacaggtttgctgttaataaatatgtgggtaaatctctgtttggggctctcagctctgaaggctgtgagacctctgatttcccacatcacacctctatatttctgtgtgtgtgtctttaattcttctagctccactgggttagggtttccctgaccgagctggtctcagcaaattgatccaatttccttgtggatataaagttatttaggttagatagttctcattatgtgaattttattagtttgtactttccaggaattgctccactgcatctaaattaaatttatggacactgagttctctgtagtttgcttgaatcattctcttttagggtccccaggatcaatagtgatgacccctctttcatttttgatgttgataatgtttacgttcttttttcttggtcagtcttcctagagaatcttaaaaaatatattttccaagagctacagttgcatttcattgtttcctgttttcatttttattgatttctatcataatttttatggtattcttagtcgttgtgctttgagcttaaattgctttctttagtctattttgctaagatggaagcttagaatactgatttttcaatctttcttctattctaatatatttatctaatactatgtagtataaattcctctctaagaacttcattttctgcctcatacaaatttggtgtcatattttaattttctttcatttttttaatattatctgagactttttccttgtcccatatggtttttcagtgtgataaatatatagggattttctatctgtctttctattgttggtttctagtttagttcattgtgatctgaaattttaccttgtatgattctcattattttctatttgctgaggtgtgttttatagccctaactcttgataaatgttccatgtaaaaatgagaaaaataatattcttccattgttatttgtttaacccaactcacttgagtaagaaagtatgtaaaatactattttgtttccattcagagcttttaatctcattcatattttcactatgatgacatggggtggctactggtggacctcaagggtaccagaagcacaagccttttatgggcagtttacagaaaaaataagtttacattactttgaatatcaacatgcagttttagacatcaaagaagataatgtaaggcagttaaaatctaataacatgtacttatttaataagctatacatattatacaatccctgcctatttcattatctaatatgaaatcttgacatcaataacaccaaattttatactatactagttttgtatttgtataagttgagcatgacaagttcatagtattgttaagcagaagaaccagacattagctgaggaatgctcttttcactcttctaatatatctaactaaataaacataatcagttcaccaaacattaaaccccaacaaaatggagggcagaatagtaagctaaggagacttatttaaagaaagatcaaactcaaaagttttgaattctgtgcataacttgatttatatctacaataatgcaggagtatgtttctagatcagtataattttttaacttcagatattttgttttactttttggtgaggcatgtgactcatgcaccacctcatccagtcttcttagcagaggtcttacgtagtgttgtagcagaaagagtatgaggaaatgaaccaaatataagtgtgagacacattcataaggcctggggatagagcagtgagcaaaaagtaccatgccactcatacttatggaacttatattttagtgggtggttatattttataaagaagaatttaataaagaaacctggaaattactaaaaatattaagccacgttacaaaaaggtgacaaccatattggagttagaatccaggcatgtggattacctgggagttctaggcttcccattgagagtgatggtgaatgggcataaagagcttaaggagatttgtctacatagcttaggccagttgggtggtgagtgagtgttggggttgtggtgagtgttggggtgctcaaggagtgatggttttgattgtagcaaaaggagtgtctggactcctgcttaactcctcctttgagttagattttataatctcatcatcctcttttaaatatgaggaaaatgagtctcaaagcagttaaacaagctggccaaggccatggacttgagaagggagaaacccaggtttcaaactcagtttgtttctgaacttgaagcctgtgttctttccagaatacctcactgcctcttaagaggggcatgattattctccaatatatcacttcaaatctatccatggcccttttatttaatttccatggaattcactaaactgttttgtaatctattcatatgttttatatgaccatgctattaaggtaatcatactgtaaatatattatccactaagtaaaatgccattaacaaaccatattaaaatgtcaaataatatacctttgtaccaatactttgattttaaagaaaagtttgtttttctaatataatttatttgattattattaatatctcctttactcattcacctcttaacaatcatttatctttccacgccaaagtgttctaattgattcagtctcttaactttctttctttcaaaatgtctgtcccataagttctttttatggaatgataatgtgaaacaaacccatgagaaaggaaatatttttcatgactgttgttaaatgctgctttaataatggacatttcgcaagctgtgaagggactggcagatactttacagagttaatgtatgtatttaggatttttatgaccaaaatacatttgggcagataatgattatttgacatttttaaatttagagacaccgattcgaaaaaaccacaggcaatcatggtcaccgtgactattcgttaactctaagaggactgaaacatctgccaatctgcagttggcaatttactctacttctatattatatttgtttaacctcatgctggttttctagaaggcataaggaaactgttgatagttaatcaaattaacaatttgattagctcaattttttctattacatttatgaggagcaggaagaagaggcagccgtaggaaagaacgattaatctccttatggagttttttttaatttttcttttccttcctcattcgttatcctcttaggtgagggtaaatgaagtaattttgtccatgctggtaagacaactctgtcagatcttttcttttcttgtcaggtcttggctgacttagaaatgtcaaataatacacaatcacaagctgaagctttgctaactcattgtgtgagagagatgctagtcactttatcctcacctcagagttctgtgtctttataaagtcatttataaatgaatcaatgccaaatatctgacatacttaggaaaattaggatgaacattaagaagacattttattttgaagtcaaaatgtctttctctttttaataaaatagaaaaagagaaggaggggaagaaggagaaacctaaaaagttcatattacaatcctgggtcctcctatattcctgtgctagttcacaaaggaccacatttaaagaggtttttgctttgttttgttttgttttgttttgttttgtttttgtagaccatgtcttgctctgtcacccaggctcacctcagccttgaccttctaggcttaagtgatcttcccgcctaagcctcacaagtagctgggactacaggtgtataccaccatgcctggctaatatcactgatcattaaagaaaggcaaatcaaaaccacaatgagataacatctcaaaccagtcagaatggctattattaaaatatcaaaaaattatagatactggtgaggttgtggagaagaaggaacagttttacactgttgatgtcagtgtatggtagttcaatcactgtggaagacagtgttgtaattcctcaaagacctaaagacagaaataccgtttaacccagcaatcccattactgggtatatactcaaaggaatgtaaattgttctgttataaagacacatacattcaaatgtgttttcatctctttgtgctggtgttaggtaaactgattttctctttatgctttcatagcatttagcctattattgaattatttcaattattatttcatatgtaaatttaaaatattactttatcaattgtctgagtttaaacactatgatttcttcaaatttaaacatgtaaaaccagagcacagtgtgtgaacaacactcagtaagaacatttataaagaatgagtagatgggtagaagaatgatggatgaatggatagatatattttctttgtcactgctcttaatctttatttcttcttctttgtcaccagctctaaacttagaaaagtagtgaagcatcccattcactttaatattattctcattctttgagaataatattattttgttagtctcattctttatttgaagataggaaatttatacatatgataatgataaagtacaatctaaacttaatgaaacataccagatgatttctgagaaattcagagtttatgccttttaaattgttttctaatttcaaattaatctcactttattagggatcagataatatagtcctagaatctaaaacaatagaatctgtaggaatgatgtctagcagaactttctgttgtgatgaaaatgttgtaaatttaacacggttaaaaaagctagccactgtcaatatatagcagttgagcatttaaaatgtggctagtgtgactgaggaactgggtatttggttttatttattataatcattttaaattgaattaaatgttaatagccatatttgactagtgcccagcatattgtacaaaatagttatcaattgtaagattaagataatggagatttgcaaggaaattgtatctagaatggtataaatgaaaattgttattccatgttaagcccaatatatccctaagagtgttcatttatttcaggaatggggcaaataaattacattcctttcttctttccttttttttcttcaacaaatggatattgaaaatacactgtattccacatagtattctaaatttgtgtcatgcaatagtgaataaaataaaattctagcattcatggatattatgcactattgaaaggacataaaataaacaataaacaaatgtatacataaaataatttcaaataatatttgatgccataaaaaataataaagcaagttaataaaagaatattttgggcagaaagcttaatgaaaagggacagcactggatgtggtggcttgtgcctgtattcccggcactttggggtacaaaggctaaaggatcacttgatcccaggagttcaagacaagcctgagcaacatagtgagaccctgtctctacaaaaaatcagaaagtagctggatgtggtagcacatacaactacttggggggcctgaagtgggaggatcccttgaggagatggaggttgcaacgagccaagattgtaccattgcactccagcctgggcaacagagtgcaactctgtctcaaaaaataaataaaataaaaaagagagaaagctagtcatgtaacaatctgagggagaaacgttatcagcatggggaataacaagtgcaaatctcctgaagtgaaaacagaggtggtcagttccaagagcaaaaggatgccagctttgctaaaccagagagataggttgaaagatttataaaagatgagctcggtgtggtgtccagaaaacagaacgagtgggcatacacagaacatgatatatttataaggtgatcatcttagtgatagaccaagaactcttcatgtgggaaggtagtgaacagtgaataaagagtagagttaatgaactacaggtccatatgagagagaaaagttattggaggtagagaagtagaataaagtaagctggaaatagaagaaatgatctgtatagaggttttggaattagttaagctattggtgataacaaagtctaagatatgacctcggtggctgaataaaaattaaaatatgaaagatggtgatagtgagaaaatcaaataatacttaggccattgtgttttatgaagcattttcaagctttctgatggacacaatgagtatatgcctacattattatgacaagaataacctatatttcagtgaaagacatttgaaaccaaattaaagctgtacttttaagattcttttttcctttcatatattatttatagtcttttccttattttctcatcatctcttttgtttcttcatgattatttgcagcatttatataaaagatatatggaaactatgagactataacattcccattatactgtagacttgtaaaagatcatgttatgtttctgtttgtatctgcaccctcagcatcatgactaacacatgatttttactgagtaaatattggtagcattggatctacttttggagccacctttaattgaataagttttataaaattaaattaactaatcccaaacttttcttctaataaatggtgtcttttttttacaatttttaaacacaaaagtgtcttatttattttgttttccctacaaattcttaacagaagtcataaatgtaaaccaaataattagacttagtgtttcagtaatatcttacttagtactttttaaggactgaatgtttatgtcccctacaattcatatgttgaaactgtagtctcaaatgtgatgacattggaggtggggcctctggaaggtaattaggtcatgagggtggaaccctgatgaataggattagtgccctgtatttgtccattctcacattgctaattaagacatacccaagactaggtaatttataaagaaagagaggtttaatggactcacagctccacatggctggggagtcctcacagtcatggtagaaggcaaaggagaagtgggggaatgtcttacatggtggcaggcaagacagcatgtgcaggggaactgccctttataaaaccatcagatctcgtgacagttattcactgtcacaagaacagtgcaggaaaaactgcctccatgatttctcccaccaggtccctcccacaggacatgggaattatgggagctacaattcaagatgagatttgggtggggacacagccaaaccatatcatgccccaatataaacaggcagagaaccagccagcttcttttctaccatgagagaatacaaagaaggcagtatgtaacctagaagagggccctcatcagaacctgaccatgctggcaccctgatcttgaactttgaggctccagaactgtaagaatacatttctgttgtccataaaccacctactctatagtaatttgttaccgcattttaaatgaactaatacagtgctgaatagaataagaagattcctttgacatcatttctttttctgtgcctgtatatttgctctccagcctcccatttgacttttgagtctcactacaactttgctgagtaagatgctcttgccctgtttcagcagatgtattcatcctttgccacactctggtgtgattaatgagctaacattaataaagtactttgagttccttggataaagttgtgcaaactattattctgttgtgttactttctttagggattattataatgctccattgtatctgtggagtctaggagacaaaagtgacataaatgtctctgagaaggcacacttcaacaaagtatgcaagtacaactgcatgaaagcaaccagggtacaaaattttatttttaatatactttcattctccactcaccttttttattctctgttctcagcccaaagtaaagtaaggtgaagtaataccatctttctgtatgaataataagtgttacattgtgaggcattaagtatacatttggaagcaatttaaaaatctttcagtttctaagtcatatttttatactaaagaatagttaatatgtccataggaaagataatgggctttttatcattgtgaggtatttaggtttaaaatgttcttaaggttatattgtataatgccccccaaaaacacagcttatgagtaaaggactgatcttaggaatctgctacatgaataggttcatttggaaggcaatgatgtcctgcggttactttgtgtgcttcattgctggtggacagatggctggtttctcactgtgttctcatttcaactctgtctctagcttgctcctttcccatgtggccttccccctgtgctaataacagaagctttttattctatgcccaggttttacttactcttaaatttagaccctcccttcaagtccaaaggtccaaattgctagaactgtgcaatggtaccaggattctccctactaaactatgcaccacatgcaacttacaagttatgtctagggaacctaagcacgatttaatgcctgattctttctttctataatattgcaaattaatttactaaattatatatttacaatcaaaactataaaaggattaggaggcagcatgatgtggcagtgtgctcagcatccacagagccaggttctagttttctttccgtagataggacctaacatgtgtaacacccaggggctcagaatcatcatgtgtaaaatgagattattaagacagacgctttctacagcccctttcagaccaatgattccgttagaatgggactcttgaagggtgtattcttttttgccaggttgtttggcatgaaacatccaaaatgtcttcttgcctattctagttcacagtatttttaaagaagggctgcatttcatttgtagtattatcactgtgagtgttttcaaggccaagcacttagcaatttaaaaagaaatggaggtaggtgagatttgtgatgattcatgctccggtggttaaaaaataactgccactttttttcgtggatagtgaaataaagtagaaattgtcagaccttggactgtgaagctccttgaaatgtggtgggagatgagaggatactggttaagagtgtaggtgatgcagctgcaccctgagatgctatttgaccttgggaaagccacagatcttccccaagaatatctccaaacctgtaaaactggaataatgttaattcctacctcactagggtttgcttagaggatgaaatgatccaatatttctaaaatacttagagcagtacctggcacagtctgtgccatgatgttaggcattagcataagcgaaagggccagtgtagtataaagcagtagatgcgtgtaaaagacagtactggggcattattgattcagggctcgtgtcaagtgaatcaacactggagatctaattgtcaatttgtatttctcctgactatgtgttagtcttaatcctatagcaatgaaaatgactctatatcaatgtgtgtgtgtgtctgatggtggggaagtaagggtggaataaataatcatgacagctttttaaaactagagataacctcaactttgaaaattctaatttcctcactataaacaaaattgaattgtgagcacacacataagaaatcatactctaggatttagtaaaatccaaactcttcaaacaactagttcttaatgtgccaggcattgtgctaagtaattccatatgtattacataactcagctatattaaaataactacaagaatatataatctttatcatttttggtatgtttctcatatgctttagaagtaaaatggaaggcatatatttatcatacactaaattattcataaacatttttgtaaatttagaattagagggagcttattcattatctaatcctcttatacgaatgaggagcctgagaaatgtatgagcctagaggttggtggtgacagggctgggactttcactcacaggtaaccgctcttcctacagtaacaggtaaattttctgaacattgttaccaataatgttactctataacatttcagaaaataagaattcttcccacttctattgaattataaaacacatcacatacacacacacacacagacacacacacacacacacgcataccttctagcctattgctaaataatatgaatttaataattctaagcatacttcaattaagtatgactgttctgacctatctattatccatggagacacttctccatggctgaatttacttacatgggaagaataaaattgtcagtcagaacagttcagcaaaaaataataaagtagaaaacatttagtcactttaaattgcgtttcatcaccaatttttcagtgtatattaaacttacattattgggatgtcctttgaaaatttaaaatgccagaagtaattttaaaattgtctttgtacctcataccatatgttacaagagaaacacatcaacaacaacatcttaatgttttaatggtatgcactaagtagttccctttgcttggatatgtggttgtaccccaaagaaatgaatagaatctcaaaagatgtgtctaatattttcaatactaacaagtcagttgatagtcgctgacaataatacagtcagattggacatgagtgagaaagatgaagactaaaacacatcagacacttcttagaaatagcctttaaaatcttaattgcattcattttacaatgcagtggtggacttattaattcagtacacatttatcctcttattgtaaagatttgaaatatgttaaaagttcttattttcttgaagtttacaggatacttgttactacagagcaatctccaatgcttccagcctcaagaaactggaaatttttggtctagtacttcttaaatactgaaatcatttttacataataatattcatagttgtgcatgtactattataacttggagaacagaaaggatataatgtttgcacttataatttctaataaggtatatatttttaaaccatataagtaggtaaagataacattattatcattatcgatttgccactgagagaagacacaaaataatactcccatgtcttgtctcctatatctgtcaactttttcctatataatgagaaacagaattatctaaataaaagttaatttccagtttctgagaatcttagaaacttagtttttttttagttccttaactctgaagttctttaaaaacaaattttccgtgtgtgtttgtctccccaaactataaagaaagtttatcagagaagatgaggaactgatggcaaacatctgatgatttgtttataagataatcataaggtgctgcagaacaaatcctgggtcattctgaatcattcatggtcacagttaccatgtttttgtgtaaatgtagacctctacttcctccagttctgcaagggggtatggatggtcctagaaaataaaacaaaattcaacattcctgccatcattagtcaattaggaacatctttaaatcaagatcttttttcactgaaatcgtgaagaggacagaaactggtggtgattgatcttggctacatttttcagataacaatcttgaaatttttctcagggaccatgaaaatgaataagatgccaaaatataaatacctttaataactcagggctgaatacagtaaaaaatgtttaagcgaaatacccttaataaatccaaatgagatttattgcttcgaaagtgtctaagtctataggacctcagaaatacctaagaatacacctagttcccaccagcttccaagtgagacgtctataataatataagaagagtgaaaatgagaaaaggccgcagaggatgtgaaattgtatttccagcacagagaataacattttagaaagatattttggatttattgttcaattctttgcattagccatgtgcattggcccacttgtgcctaaacaaaatcttcaaggccctaagagtacccacctcacttctgagctgagttgtaaaaattgaatagtagtgtgtcaaagaaaagttgagatggagatggcaaattgaaggaaaatgtgacctgttttaaagaaaaaaattatatggagctacttctgctccttcacctcaggaaactcatttctgatgatctggaatctctccagctcattccaaagtgaagcatgaccctaatatggacttagaaaattgattttaaagtagcatttcccccaccattatgaaatagaaacttgtggaagttccacttagagtttaatagaattgacctacattgttttttccactttaaatagacccatctctcttatggtgcataggaaggaggaagaaacacatagaaaagagaaataaatctcttgtccatatctccaaattaatgactgtgacttcaaatggttctcagacttaacagtttgatttgaaggtctctcttcttctgtaaagagaaactgccatatggcctacattgtgatcttaacatttacacaacaattaaatatgcctggttcatgctgaaataccagctcccggctgggaaattaaagcagcattcagctcctctcagcaagaaggctgaagtttgatatattctataaactggattctgcactagccaagggaaagaggattgacatagttagaaaacacagttggacttgttaaaacaagcatttcagtgcacagatgctaagtctccttggagttatgcattggatcactttgctcctacttagctattaactaaatatatttttgttttatttcctcttatttttcatctttactgcaatttatataaatgcaatcatttacctctaagatatttcaaaaatgtttgttaggaaagaaaggggttacagggttacagattaaaatcttctccattttcaatgagcgccaatttttttaacttttattttcatttcaggggcacctgtgcaggtttgttacataagtaaattcatgtcatggggattggttgtgcagattatttcatcacccaggtaccaagcctaatacccaattgttatcctttctgttcctctctcctaccctctatcctcaaataggccccagtatctgttcccttctttgtgttcatgagttctcatcatttagcttccatttataagtgataacatgccgtatttggttttcagttcctgcattagtttgctaagggaaatggcctccagctccatctgtgttcccacaaaagacaggatctcattcttttctgtggctgcatagtattctatgatgtctatatactgcattttctttatccaatctgtcattgataggcatttaagttgactccacatttttgctattgtgcatagtgctgcaatcaacatacgcatgcatgtgtctttatagtagaatgatttatattcctcttggtgtatatgcggtaatgggatagctggttccaatggtagttctgtttttagctctttgaggaatcactgtactgctttccacaatggttgaactaatttacactccaaccaacagtgtataagtgtttccttttctctgcaacctcacctgcatctgttatttttttactttttaatggtagacattctgactagtgtgagatggtatctcattatggttttgatttgtatttctctaatgatcaatgatattgagcttttttcatatgattgttggccgcatgtatgtcttctttggaaaagtgtctgttcatgtcctttgcccacattttaatggtgttgtttgtttttctcttgtaaatttgtttaagttccttataggtgctggatattagacttatcagctacatagtttgcaaaaattttctcccattctgtaggttgtctgtttactctgttgatagtttattttgctgtgcagaaactcctaagtttaattagatcccatttgtcaatttttgcttttgttgtaattgcttttggcatctttgtcatgaaatatttggccgttcctatatcaagaatagtatttcataggttggtttcccaagtataataaagattaaagatagaaaatacttgtgcattttatactattctctttaataatttcgaacatgctatcaaagtatattttcatcttcatccatggcaatgttcatcataaagtcacattcatttggggaaagtaggaactttcttagacccagttcagatatggaggatgcagtacaagtttgtaattacctttacaaagcttaattttatttttattactgatgatttaaaagattacacattaagtgaagagattaaaaaatagacaaacatgtcaactcaactaatattttatttaaatcaataaatgatgatatttaggtatgtagaggaccttaagaatagggtttctgtaaagagaaatacacactacacactgaagaaaagaatgaccaagagcattactggagctgattgaaagaattactagttagtcctacggggtatatttcccataacacagaatgaagcacgtagctggaactaagtagatgcttgctgaattgaaatggagcatttgagattgtaattagagacagtactagttggaaacatgaaatcggaccagattatggatggttttgaaagccagattaaggaatttgaaatttattccactgacagtagcatccaaatgtgaatggtcatgagatactaattcaagtttggggaagaattgtctttaccttggctaggaaaactcttgtactatatctagctagacagcaaattacagaatgattgtttttatgacccaaactttctttaccctaaatccactcactacacataatttgaattaatacttttcaatgtattttcaagatattgtgtggcaacattctactcaagataacatataagaaagccagtaacaacaacatgttttacattgatattgggaaaacaatttttaaagcccatttcttttacacatggagcacaaatgaaacaatattgtcaatgtaactacaaagtagttttcaatgctttactaagtggtgttctaaagaaatattgaaggaatttccattaaacttatatacatatcattatatggtggaaaacatattgcaaaatttattaatgatatttgatagtcctatgtgacagtattgggcatattttattcagttttctctaccaaaataaataatctatgtgcttttgtaccagtgtaaaagtcaataaaatttaaacgtgtggctcaatatgaaagaatatctttgtatgtgaatcttttaacattccactaaacatatactatagctagccaaaaagaagagctcttggcagggctcagtggctcacacctgtaatcccaacactgggaggctgaggcaggcagatcatgaggtcaggagatcaagaccatcctggcaaatatggtgaaaccccatctctactaaaatacaaaaaaaaattagcccccgggcgtggtggcgggcacctgtagtcccagctgctcaggaggctgaggcaggataattgcttgaacccaggaagcggaggttacagtgagccgagatcatgccactgcactccagcccggcaacagagtgagactccgtctcaaaaaaaaaaaaaaaaaaaaaaaaaaagaagagaagagctcttgtatattttttgtctgcatgctctcaaatacttttttgtctgcacatatgtattagtctgttcttgcattgctataagaaacttcctgagactgggtaatttatgaagaaaagaaatttaattgattcaaagttctgatggctatacaggaagcatggctggggaggcctcagaaaacttacaacatagtgaaaggtgaagaggaaataggcacatactatacatggtggagcaggagagagagagagagaagggggaagtaatacacacgtttaaacaagcagaagtcttgagtactcactcattaccatgacaacagcaagggggaaatccacccccatgatccaattacctcccaccaggcccctcttcaacactgaggattacatttctacatgagatttgggtggggacacagagccaaaccatatcaacatactaacaaaaacctccaaccgaatcaaactttgtctgtcataaacaatttgcacatgatactatttattaacagtaatgtaaattttatttttctgtattttttttttttgcctctgaatctaaatgccacagattctttagcagaaatctattttatcctggttaattaaactggtaaaccaactggagttacctgacacttgaatggaaaagaaaaatagacggaatttttgaaaagcatttttaatgtgtttaaatagctatctctcatgaacaaagtgattagcatttgctttacaacgttccaagaagagtatccaaaaaagattgcataattaaagcaaatgtcccaaaaagtttatttatagatgctttgatatctaaaacataattttaagcttctgttgtaaatatgatccaaaagttgtacaaagacacaaagcatgagcatgtttggcaccttggattattagagcagagtttatgaagataggaggccaaaaatatgtcctcatgagcactcctgtcagtccttattgtggtactttcagtgtgaggagtttgctattggcttccagtagattgaggccagggagatgaagctaaacattttacaatgcacaggacaactccagacaccaaaaaattatctggcccaaaatgtcagtagggctgaggttgagaaaccctagtctagaaagtctcattcagttttatatattggaacacaagtggagaagttaatattagtcaaatagcattcagatgatttctctttgcatttattttgtttttcttctgagattctttcaagtcttccttcattctcacttgacctccgaaattccagttgtctttcatctttctgtctaggagtttctgctatgatagtgatgatgatgcaaaatagtaagtaaatatacagcttgataaatcaatattctaggactagagtattttagttatattttgctagtgctcaacaacagcaaaattcttttttgtttttagttgatgctgtaaaaattggctagtatcctttcttgaaatacatgagtagaattttcttgtcctgatatggtattataataaattatatatctttcatgtttcaaagcttatttttaattattttaagtgttatagttctagaggatgtttttgtttagactcctcaggaaagtgagggagttgggacatgacctgcaaataacttctttacaaaatatgtgcctgcttaaaaaatgttaataccagctaagtatttgataattttaagaaattactattaattttgggggtgttatggtgatattatggacatttttattttaagaatatttatattttagtgatgcatactgaaattttatctttgaaataatatgtctgcaatttttctcaaaataattaggtggaaatgtatgaggtaccagtgaaacaagctatcagttgatgattgtttaatctgagcaaggaacatatgagattttattatggtattttgttacactattctactaattcgttagatttatactcttctactagtattctagtaatatagtatattgttacttttatgtgtttacaattttctgcaataaaacattaacaaaatataggaaaaatctgcttttttgtaacttttatctttttggaaagtcatttctcatccttatccttctcaaatatggaaataaaatactggtttattgagtttctggttatatgaggcttctttgaacacggtttcaacaggatgtatcacacctcagttaagctttgaaacaatgagtgtgtgtcttttctcctggatgaaaggcagaccccttggtgggaggatttcctggtgtcctttttatcatgttgaccaaatgagtcagagagaatttcttttttaaatataaaagataatatgtagtttggataacctgttggactgtttgacctaattcctcacttcactttgcttaaagtcacaagctaaatagtggcttatacatctttagtctgctgatttctgttctttccagattttatttgcctaagttaagattcaataaaggacatctatttgtaaggaaaaaaatgtatgtaaccaaggagtaggcaaatgtttttctgtaaaagttcagatagttaatatttaggctttgtaagccatatatgattgtatatccatctttcatttttgcttttattttaacaaacctttaaaaatgtaaatccatttcttaatttaaaaaaagcagttcaataagccaatggttggatttggttataggactcctgatctaacccgtctgttcaaaacaagcctcttttccaaatttaactcattctgaataagatatataaggaaaaaacattctataaaatatattttcttatcattatcattgctttaatgtatatgcattctacctctatcaattaacacatactactaactaaagtaactaattattcatgtggattagtatttcttatcaacccatacttaagcttacatacaaactttttaaactcaaaacctcagtggcatttttatgattgtaattattactttcaatttgctcattagtggtcatatagaattatgtttcttggagtgggaaaaaaatcaacagatatttacctctgttaggattgatttgtaagtgtgaatgttttcttgattgggcagtggtaataggatttctttatttgcctaataaattttttctgttatcttgcacaaagattgattcccagtcgtcctctatgaatacttcaaattactgaaaagtagaaaatgaaaactttataggtaggatattagttttctacttacctcaagacctctctgtggctactcacatactgaacttgaagaactcattgtaatctatcgagtgaaggaaataaaagaaaaggtagaggctcttaacaaaatggactggtatgaacttctggacctgaaagaggtcacgagtagagatgtgtatgagtcaggcactcagggggatgacacaaagtaaagatcagattaactgatgatagagtgcattgtaagggatcacaggaagaaaagaagcactgtaagggatcacaggaagaaaagaagcaagggaaattatctcaggagtattagaggcagactttatggcaagtgagattgtccatcaggaaaccacagtgatgccagtggcccaacaccactttggggatttatcattctcacaactcatgcactctgattattctagctattcattctttactttaaatctccccaacaatgggtatgattaattctattagtcacagtctgattgaagcatccccatcgaaagagttctccagccagatcgttgtatgggctgctacctgagttatagatgaccatctttggagtaagcatcaatcctggttgaaccagttatcagagatttttaaagtcacatgagaaaagctttccaatttgtacaaaacacacacacacaaatactgctttcattttttaataaaagaataactggtttaatgtgagaaagagtttcatgaaattagtttttttatgcaaaagttttgctttatttgttcccaaaacaatcttttatcttatattcactcctaggacagacacagcctagcattgtttttttgttttgttttgtttatgtttaggttcaaaatcatggatgcctcatcccctttcaagctctgttgaagtttcattttacagtgattatttagagagactacttctgttgtcagtgctacagctttagatcaatcaattccccaaaattattatcaaaacttctttacaattctttactaaaaacttcccttccagctcatttggcaaactgactatagataaatatgcctgtattatgaagcaaaagatttgagagaacaaatttacctgttggagaaagagaggctaactatctttcccataaatggcaagatatgtagagagctagaactctccactctattccatgtaagttaatttcttaaaataatattttgcacacgaagtttttcctgaagagccctaaaataatagtgtagaccaggactaactttcttacccatggagaaatattctctatgcctaatcaaatacttatgatcctgtcaagctgctcttccaaaatttcataaaaattagcttccaaacctttctttgaacctgtatcatgatactatttcattctaatgtctcctctcccctcctgttccttttctcttgtcctcttcatccccatagtttgtgtaatgtagtttctacacttttttgaagtctaaccaagacccttcatgtcaccaatgatgtacagaattactctatgatgaatgatatattatttgaatttacataaagtctctagtaggttatttagccttggaattatgctcaaatcttttttcatattatgcttgaatttataattctcgactctttcagtcaggataaggatacaaaatatacttattttgtattctccacaattgcctaaggtacaggttgcagggaaaatggtggttaacttgaattcatgttatctttaatttccattccttttgtttactttttccaacttcttctaaatgaggaactctttttaaattataaatctgacagctatatgaactcattacccaaaagaagcttatcagtggtaatacttatcccttgctagaattgcagattctttcatcccactccagacttactaaatcctaacctgctttgcagtaagacaacccaggtgattcccatacatattaaagtgtgacactgcactaatgaatccattctgaatgaatgaatgaatttttgcattaaacaaatagaggaaatgcatgtttaaatgttgattttatcatgtgtgcatgtggtgtgtgtgtgtgtgagaaagagagagcatcaagggaaatattttggagacaaataaccttttaggctgtagtagacttgcctcataaatatctggtgaatatattgcctatggagactattgtttctgccacgtgtttttttcattttttagaagcatattaagccacataggaaaacagagctgtcaggatattacttcaaaaaacacattggaggtacctaagagccaaaaatcatttgatgaatttttaaaagctggctgcattttaaaggcatttataattcaaggtgtttgattaacttttgacgacttgagtgctgctagatttaaagattgaaagggacaatttggaatggtctggtgaatttttaaagacagatagaagcagaaaaattgtggttttacccttcttagctttgatatttttatgttatttttgttacaatcacaaaacagaacccctttaatctgtttatgtcacatgggctaacacgcggctacctgagattgtttcctacctacgtaacatatctgtaatatcagtaatatccattaggtattttaacttgccaaagacaagtagtacaaatatatattctatataagtttaccaacagtattatgtaaagctgattttatgcaagctgaaggagttacaatggaaatgaaagacacagataaagaagaggaaagggagagaagttaaggagtagaaagtgtaaaccttaatttcaaaaattcacatatacaacaaaatcaaacaatcatgttacaaacatgtttatgattagtaggaaccagatgagagctttgtattataacttctgtcaattggagccaaagcttcacaaaaagatttgcctatttggtatattgtattcaaatgtgagcaccttgttttatgaagaatatttttaatctgatgtaagccattttcagttattgattgattcacttatttccttttttttttttttctgagacagagtctcactccatcaccgaggctgtagtgcagtggcacgatctcagctcactgcaacctccatatcttggtttcaaatgattctcctgcctcagcctcccaagtagctggagtttcaggcgcctgccaacatacccactaattttttgtatttttagtagagacagggtttcaccatgttggccaggctggtcttaaactcctgacctcaagtgatctgcccccctcggcctcccaacattccatatttcttgaaacaaataatatatgacaatgtttggtaagtgatgacattgcaaaagcaatcattgcacttcctttaaagaccttatagtttagtataaagattataaacaagtaagtccaataatgtaggaactaagatgcaagatgatcaagatacagaggaagcacaaagataaattttccctgggacaattaagaaagagtattagtggatgtgaaaccatcttcctcaagacacagtctaaggaatttgtatgattagtttatgaacaaattgtttatgagatggtgaaagatgatagttatatatcacaaatttggagagctacttgatgtgtgaagcattacttttatttgcttctagcaggtaccatcaaaatcataaggaaaaattagaatacaaggaaatggggaaaaaggaaggaaattaatgttttacgagtacccacaatgtgccaggcttgtggtggcactctttataggcactgttttataggcactcttttacaggcactgttttagttaaccacataacagctttgtcaatgaataactttgctaacacatagcttgtctgaagagttgctactaggtcaacattcagaggcccacgtgatcactctaatttatatgttttaagagagatgatttgattgaacttggagctaagatttgtttgataaaacaataactttatttgatctaaataaccataaataacagggcatgagtagtagaagaggacacaaataattgtgcaattaggaatgtatctatgtgagttgaaatgactagttatacccttagtaaaatgaaaaattgggtattctggttattagaatattataatatgtaatctatacatgaataataccttctttatatctatatttagaaatttgttgtattcaatctctttttcagaagattgtacaaaatgtgaaatgcattaaagtactgtactaagaaatcaatcaaatactaaaaaatttgcacctatttaatgttctttcctagtctaaacttctttcgatttctattcaaatctatttgatacccagagtacttctaccagccaaacatgatacgcaaaatgatttaagccagatgttatcatttcctgtgccatacagaggcagtgttttactagttcactaatataaatacagaaagtctacaaagacaaaaagaaagcaaaaaagtgatattttctgttacatgttattataacacagtgaattagaaatctaaataatttataggaaattagtattttgatgcacagcagagaattacttttatttcatggtatcagttactaaagaaggaagcagcttttgtttaggttactatgagaagctaagtacagttttgcccaaaattctagaagctcaggttaagcacattactttagaaatttctgtcatgagttcctgattagctctgtgtcacagcaatgtcaagttcagttttagaggtcaggaaaatatttctgagttgcaaaacgtttgaagccatttgccctaccttataaaaatgactgtttatgtaggtgacagtaatgtcaggtggacttaaatgtttataatcagggttaactaatgccagcaaaaatagcattgagaagttgatatatctcataccttaaggattattaaaggtatacaaataatgtgctaggccaaatctagtctcccaggccacactctttctgacactgaaattggaaacagagttgtctatgttcctatacaggatgcattaccaatagttttcatcttaactaggtgaaataactacttagccattcataaacgccctataaagaaaaccaggaaaattctaccgaattaaaattaatacgctaagtccccattacttttacaatttattataatatgtaaatacgcatccagatgaagggacctattacccaagtaaatttgcactaagattcttaaaacagttattacaccactgggaagttcttagttgagctctcagagagtatacaaacaagaaaaaagcagaaaggctggaacagacagattctagaaagtatgccaagacaatctttaaaaagcttgcatctgtaaactgcactgaatctgttctttgggagtccaattttattttattttgtatttaactttatttgctttatgaaatcaacatgcatatctataagcaggttaattttcttcctgatgagtaaaggcatgtctacattgaaaaaaaaatgaccaaatcttccagatagttttctttattataaacattgcacaaaacctcagagatatgttatgttcctcaaagaaagtacgtaaaacatttggcaagttctatgaccaagggaagatgcctaacaggtgaaccaatattatccaaaacttaagaagataacttagtgtgggttttatgtttattcactgtaattggggtatgcataagcatttttaaatcattttgcctgggctggaaactcaatgtagcaggcactataagggatattataaggtaactatatggtttctgtctttaaaatgtcttaaaccagctaggttgataaagccattatttaggaaacagaaattcagtagaataaaataaaatgaaatagtgataaactaatacatacataatttctaaggtacctaaaggatagtatgagctacagatgactaatttttttctatatatatcctttatttaaacaccccccatccccgccaaagacacatatacacacagatatggcaaatacaccaaaactctgtaacacctaacaaagggctgtgtttactcaataagtagattttcaaaatagcttaatattgtatcaagagaaaattaatctggacattcaattcatgaaatctaagcctctttgatcagaaagtttactcttttttcgttgctaagggtgtgccatttcttaattctgttattcatactagaaacagagtatggaggctttaaaagaagagattattttaagtgtttttcatacttcttaatgactatttctcctctcatgaataaccttcagttgttctttttctcactaagaaattattgaggacatgcagcaaggtaatggctgatgagttttgagttggtaatgaacaaagtcctttatataacttttgaagggactttgttgtgcaagtctatatttagcccttagttgctccgtaggggaatatgtcacattaaatacaaagggaatttttgtaggtgattaaataatttatttcattaagcatgttgctatttgattcaattattcaagtcagctaacattaagcccctactatctgtcatgtaggcactggagatataaagattaatgagactttacagataaaatgttgaatgaagtctaagttagttacagagttaaggacaataaaactctagagacataattgagttttacttttcactgataaataaactccacagaatataaatgggtgtctaattctcacaaacaagagcaagttgactgagactaacacaggactctaaatccccaggccaatactataccaaaaaaagaatccctaaaatagcccaagcaactgtgtctgtgtgtgtgtgtgtgtgtgtgtgtgtgtgtgtgtgtgtgtgtacctgaatcagcaggaaaccagacattactgctgtagacaatgccccaaacagcactctacctcattaactggcaagaaagaccaaattagaatatcagtgttgatcccacaaactacaaaaggtaaaataagtacattatctttttaaacaaaatgtaatgaagaggtaagatttgctgaacagtaacatctaagttttactgagatggcaacatagaaaacctttgggttaagagctcataacacacgtacacatttcttcatgtaggctttaaacagtattttaaaagcatcctccttgaagattttcttaccaatggtaatatttaactgattcaagccatgattacttagtaatgtgtacctatactatgtaacatatgctacatatgttatatattcattatatgagatcatcagatgacagaggccagaaaatcatttgtaaataatggtttagaaaaaatttgactaaacttatatctatgctccagtaaatctgtttttaacatatctgtaaaatgactgtgcatactgagaatagctatattcttatttctaatttttaaacttgtttttaaaaattaaaaataatatataaacacatgctctttgtaaaaataattccaagtaatttctaagcataagacaaatacatttcttatttaagatgattcccaggacatgcctttatctcatccctctacagagacccaattaataatagtaaaagaataaaatataaactcaaccacaaagtaacctgatgcatgaatttgtatttgggagcaaccaggagacgagacaaagggacatgtttctagaagacagaaaatacttttgatatgagtgaagtgccagataacattggttccatagccagcaaccatggccctttcttgttaataaaatcttgtatggctggcatcatatactacttcagggattaaaccagtatttacctaactcaatcactaacagtagttaccttattccgatttaccaaatattccgttttaaatcctttcttgcagctaaggctggccacatgatgcagttctgataataaaatgccagagaaagtaagttagggacctgtagtacaacttttgccttcacaataaaaagaaagaaatataggaagaaagtcttttgctgtctccccaaactttggatgctgttgtgtgagtatatgaatgtgtgtagttgttgctatcaacttgtgatcatgagaagaaggccaaggaaaacaaaagtattatgggcacagtgccttggcatcattgaagtgctgaacaaatgctggccttgcctactcccaaattttgttttgtaatataatgacattaatgtattggataaaccagtgctattcaggtattctgtagcctgcatttaaatgtatgctggtggttactgatgaaccttgaagggaaagtagagggaacatggaatatacgtacaaagaacgggagccaaggagacagcaggtatcctggaagaatactaaacaggctcttagttaagagacaacaggaccacagaagacagaacagaaagcgggtgacttatgctgatggtaggtatgagacatccctccctccatgttgcggaatagtctgtagccaaccatgtacctgaggatagtggggggaaatgtcagtggttcgttcataaagcaattgaatgagagggagaactaggacagttaagagagatgtcagtggcctagagtaaagccctcctcattctggtatttagagaaatatgaggacaagctccccgcctatttaccctaatgaaaaactttaaattaacaaattctgcaacattaccagagttttttatctttaaatgtgattggacatcaatagattaccaaaagaaaacattcaacacacaagagaaagacctagaaaaagagacaaaacaatgtttccagagtaaagagaaagagttcagaaaaaataaattcaaatgaaaatataataagtataaagataaaaaataaaaacaaaactaattttcttttcactttgtatagctttaatgcaacgtattttacacatataattcattaaagtgtagaattcaaatatctttaagtaaatttaccaagtgatgaaaccatcaccacaaatcaggttttagaacattttcatcacccaaataagattcctgtgcccacttactgttaattcccttttccatcttttgcctcaggcaaccactaatctgttatctgtctctgcagatttgtattttctgaatattttacataaatggaatcacacagtatgtggcttctcatgtctgtcttctttcatttagcattccacacaagatttgaaaccaacacttagctttgtttgccataatgtggcaatcataaattataattatatggcattagtactttagtgacacaggaatttaattttggagtagtattcaaaatgcttcttttaattaccttgtttatattacagtagcaggtaaattccatggtatggtaatttgctttaaaattgaccaaaatagatttattttcctacacagacacacacacatattcaggcacaaaaacattcagacaaacacacagaccccacaatattatttagcaggtttacaacattacttttcaatcttgacaagaacaacagcataattgatggtttaggtgacatttcctaaaatcctctctatcttcccagactggttcacgtgtccttctctagtattctcagagtttgcatatatgtgacattgttcttaccagattgtattcaaatgaacgtacatgtgtctacagcgtgatttattcacagtgtttgtcaacataaatagaacttctttaaattagctcgagtgtgaatttagacatttaatattatatttatttccttttgttaggtgactaaattttagaaatacttctatcatttctcttttcaaatttgttattttgaagctaaatgtttaaattatttccaaattaaaaataatcaaagcctacagtagttcaaatcataatttttggaaaacaaaatggaaaattatctcttaatagctatatagcttcagctggccaataatgaaatccaaatttgcaaatgtttgtttaccatattttggaaatctaaatttcagtaaggaattacccttaaaagtcatttaaatagagagtccctctgtacatgtggaatatcactttcttcatactgatctcattgggaatatacaaactacattagacatgcctatatctaaacctctggtctagctttgtttgatcataggactttctaagccaatgtttggactcattttggcttctgcctagattataccatctgctttctgccttccagaattcataaaatcgtctttctaatcatcacccctttcttttttcaactcctttgtggacattttattccattttctgcatctcttttgtttttgttttttttctttatttcttatttcagaggattggagtgggaaggataaggtatactgtgtttcagccttgcatttaaaccaaaagtctcaaccatgtttttttgttgttgttgttgtcttttttgagacggagtctcactctgtcgccaggctggagtgcagtggcacaatctcggctcactgcaacctctgcctcccaggttcaagtgattctcctgcctcagcctcccgagtagctgggactacaggcgcctgccaccaagcccagctaatttttgtatttttagtagagacggggtttcaccatgttagccaggatggtctcgatctcttgacctcgtgattcacccacctcggcctcccaaagtgctgggattacaggcgtgagccactgcgcctggccttctcaactgttttttttttttttaaaacaaaacaaaacaaaaaaacattattttaagattgagtattggcagtcggatatttttgtcagaaggaatttgctgatataatagaaaatgctgctaataattgttttttcacaccatgagacttgttttaagttgtgggaagccttaatggcttttaaaagaaaatgatcaaacaagtcattcttctttgttgtttgtttttatagagatttgcctgctgaccaaaggacgtcgtactgccagtgttcgagctgatacatattgtcgtctttactcactttccgtggacaatttcaacgaggtcctggaggaatatccaatgatgaggagagcctttgagacagttgccattgaccgactagatcgaataggtactctagttttctaccttctttatataaaatttaatctcctggcataatacaggtttgcaattataagtcccaaatgcagtggggagtggtgactcatgcctgtaatcccatcactttgggaggccaaggcaggtggatcatttgaggtcaggagttcgagaccagcctggccaacatggtgaaaccctgtctctactaaaaatacaaaaattagccgggtgtggtggcgtgcacctgtaatcccagccactcagaaggctgaggcaggagaatctcttgagcctgggaggtggaggttgccctgaaccaagatggtaccactgcactcccgtctgggagagagagtgaaaccttgtctcagagaaaaaaaaaaaaaaaaaatcccacatgccagtttatagcttgcttgttaatttgtgtagaaatagcaattagctgtagccgtatttcttgagagatctgggtccctatctatctcttctaagtattctgggtttatttattaatgtctatttttgctagctaaacaaactgatttcccgactgatgccaaaacaatttgaatcttcaggtaaaaagcaatgataaaaattctagatagcattgaaatagaactaaaaatatgatatatgagtctatattacaaactaagttttatcactttttttgtatttttggatcaactttacattttatctttatattaggaattgaaaatttgcacatttaaattaatctcagcagagacataataaaatgtttgtaatatagactcaagcagaaaaaaaaagccttgatagtaatgccctacatagatgctttacctcgcaaacatcaacatattttaaagtcttttctgctaccaaataaaaaaatatatatatacaaccattaggccttattagttatgctagtttgaagatttgcataattgccatagtaaagttagcttggattggcttgctgttaacattcctagatatcctggaacattatgttgtaaggtagtatgcattcattttccacacctaaaccctctttgccaccctccccttctctacttttttttggtcagctcgactctgctcaaccttcctctctctgtttagatatcacctccctctagaaaccttctctgacctcccactccctactaagcccagttccttggatgcattctcctatagcctctgaagctcccccatcacagcactgcttttattactggctctagagatgctaaatttgtcaatgtagagctcatgtttaattcaccattacattcacagtacctagtatacaatgaatatttgttgaagagaggtaggaagggaggaaggaataaatgaactcaaaaaagatggggctgggatcacttgtgataaacaaggaggtacctcaactgcttcattcttattaaaggtaaggacttcagattgataaattgttatgttggctttttttctgcacttcacattcacatcttcctttctctctatattagtaggacagcagactgcatagagatctgaaaatagattagaagtaaaggcagtatttggacatcatcattagatataacaaacgtattagaaattcatattgaaatcttagagatttaacaagacctactcattcagggagacaatacccacaaaagaagtaggcactcctgaaggcatccttacttaattggaaaataacttccctctttgtagtgtgtgagtgtttatgttagagacagagactaatttctaagcaatgagtttcttcctaaaccagctagacatccttagagaaaacattaaaatcaggatatttcactagataatttctgttaatctgatacagcttcactttcatctaacttattgcagttaatttttttttttttttaagacagaatcttgctctgttgcccaggctggagtgcagtggtgtgatctcggctcactgcagcctccgcctcccaggttcaagcaattctcctgcctcagcctcctgagtagctgggactgcaggtgtgcactgccacgccctgctaatattttgtatttttagtagagacggggtttcaccatgttggccaggacggtcttgacctcctaacctcatgatccacccatctcagcctcccacagtgctggaattacaggcatgagccaccgcgcccagcctgcagttaatttttataacaatatttacatgaaatggttcgtaatcaatacaggcaatgcaatttctaataggcactaagcaattgaatttttgatctttataacatagtaagagtgtattaaaagttacattatttttcccaaggttaaagatacttagattaagatattttgactgttcacataatcagaaagaaacattatgcttctcggttttgtggccattgcatatagatgtatgctgcagttagttaagcaaatatgctaaataagcatttatatttattactaatgtaggagtttttgttctttgggaaattaggacagtctgtaagtagggagaggtaactattttggcagtcatttaaaatgattgcattcctagcagtcaatgaaattacaatacatatttatcttcaaaaatatattttgttacctttaatgtgttagtttatttagcaatatcgcaaattgattcacttttcagttaccatattcacttggagattagtgtatcaatgatgccatagaaaagtcactactttccccttctttcaccaatccactattcattctaataattattatgccagagactgtctagtattgcaaaccactcagaagatgatggcaggaaaagctgtattgcaaaccactcagaagatgatggcaggaaaaggtaaaatttattgaggtcttagagggagctgagagcctgcaatgcactatgcccttggtcctcacaacaaccattcagaagaggaaagatcataaagtcagtctcagtcttggctgcatttaagaattccctggggaagctgggcgtggtggctcacgcctgtaatcccagcactttgggaggccgaggcgggtggatcacaaggtcatgagatggagaccatcctggctaacatggtgaaaccccatctctactaaaaatacaaaaaattaaccgggcacggtggcgggcacctgtagtcccagctactcaggaggctaaggcaggagaatggcatgaacccgggaggcagagcttgcagtgagctgggatggtgccactgcaactccagcctgggcatcagagcgagactccgtctcaaaaaaataaataaataaaataaaataaataaataataaattttaaaaaaagaatttcctggggaaatttgcttttaaactactgaaattcagagcccatgtatgattatttagatttaattggtagggaacaagtggatgttagtattttttaaagctccagagataagaaaaatatccaactaggactgagaatgactggtgtaagacactgggtcaaaagcaaaacctgatacagtcctcctcagatttgcatttgggaatcacctggggatcttagtaaaatgcaacatctgattcagcaagtggggtcaggcccaggaggctgagtttctagcaagcacacagatgagacaggggcagttggttcattttccatagcaaggatgtgcaatcacttttttgtgtatatggtctttctcagccctgttacctgccaaccatgttttttttttgttttcctgggcactgttcttagtcttctcatgtcctgatctcctttcaggtaaaatgagattatgaacacacctatctgacagggtcgcgggttacataaaatcatctacctaaggtcttttgtagagtgcttatcacatagtacgtgttcaaatgttctcgcttatgtctccatggtcctttcttgaaaaagtaactttaaaatcaaatgttgattccaagcccatcctattccaaaagccctttcttcccccattcttcaaggtggccctcatgttaaatatctccatttcttctgtaaagtggctctttgccatattacaggccgttcaacttgagtagaaggtaagagttcccagagaaatacaggaagtgtgaaaggtaggagccacattggtatttggtgtgtaaaggtgagtgactggctttttaagcctctcctgtgaagcacagctatacttctgtttgcaggagccactctcacttggcgttgtcatcagtcattggtaggctttctaagtgcctatctttcttttgctgacaggaaagaaaaattcaattcttctgcaaaagttccagaaggatctgaacactggtgttttcaacaatcaggagaacgaaatcctcaagcagattgtgaaacatgacagggagatggtgcaggcaatcgctcccatcaattatcctcaaatgacaaccctgaattccacatcgtctactacgaccccgacctcccgcatgaggacacaatctccaccggtgtacacagcgaccagcctgtctcacagcaacctgcactcccccagtcccagcacacagaccccccagccatcagccatcctgtcaccctgctcctacaccaccgcggtctgcagccctcctgtacagagccctctggccgctcgaactttccactatgcctcccccaccgcctcccagctgtcactcatgcaacagcagccgcagcagcaggtacagcagtcccagccgccgcagactcagccacagcagccgtccccgcagccacagacacctggcagctccacgccgaaaaatgaagtgcacaagagcacgcaggcgcttcacaacaccaacctgacccgggaagtcaggccactctccgcctcgcagccctcgctgccccatgaggtgtccactctgatttccagacctcatcccactgtgggcgagtccctggcctccatccctcaacccgtgacggcggtccccggaacgggccttcaggcagggggcaggagcactgtcccgcagcgcgtcaccctcttccgacagatgtcgtcgggagccatccccccgaaccgaggagtccctccagcaccccctccaccagcagctgctcttccaagagaatcttcctcagtcttaaacacagacccagacgcagaaaagccacgatttgcttcaaatttatgatccctgctgattgtcaaagcagaaagaaatactctcataaactgagactatactcagatcttattttattctatctcctgatagatccctctagcctactatgaagagatattttagacagctgtggcctacacgtgaaatgtaaaaatatatatacatatactataaaatatatatctaaattcccaagagagggtcaaaagacctgtttagcattcagtgttatatgtcttcctttctttaaatcattaaaggatttaaaatgtcgttgtaagattatttatttctaacctacttttacttaagtcctttgatatgtatatttctctattttatgaagagttcttggattcaatggaaacaaaactgattttaaaaaggcaactcaaatgaactagtaaatagcaccaatcaaaactttctttcattagctgtgtctctgcatctaaattgttaatcattaatggtggagaattaaataacaaatcccattttatagatctaaattgtatttcggtgctttcaatttcaaattaggttaaagaatgcactacttgcttggccaccgtaggagactagcattgccactgtttgttaagaatatcactaacctcaaacatgttcattgatctttcagaaagctgagggaaaattaatatttgtcttcatgtgttatcggacttttaccaagactcgatcaatgttagttgtaaataactttttcaacccaaataaaaatagctattctgtgttgtatgaaggtaaaagtcattgtttaagaatttagttttattgcttcacttcaaaacttagagttttaaattttacaaaacctgattgtgagaattattcaattgtaatgcaatggcttgaaacctacaatattattttaacctgcaatgttttatgcaaaattgtatgctcgaatctacaaattgcttgtattacaccaaaaatcgttacttttctttcttcttgccataatcaagcatctgaaaatagtccctgcatgcttctggggaaaaaaaaataggttcaaatcagtcattgtagagaaaggcttacagtatttctcgtttctagaaaagcataacaattcattaattgcctatcttataattcctataaggctgacttggatctctgacttaagtctagaagtgaggttttcacttttatttaatattattgctattattatttaaataattatttgtaaaccacagcttgatttggagttaagtgttgtctgtgtcttcactgtagctggtaatttactatggtattaatttaaagaaataaattcaatacagcatcacgtctgtttgggaacacacattttgctctatgtatattgtaactaaatggttagtaaactttaaggcatgtggtgactaacgtagcccttagataggaggtttgtcatttttaatgtgttgaaaatagtacagacatggtgacagaaagcaggggtaaagttgaacgtctatgagcattgtctgtctgttttcttaactctttacatgatctgtgagcacctgcttcttctcaaagaactcccttagtaatcatttgtgcctaatgcatcccacacatgtggagtatgactggaacacaattgaaagattcctaacaactggctgcggtaaataacccaagttaagagcatgacttaaagtggaggtcttcagtatctctggcactggcaatacatttaagaacatacagagatcacacattatgtgggacagggcctgcagatagacttgaggacagaaaacaaaaacaaaagcagaaactctaaagtggatccttgctgcctgttatgccttttgtggatataatacctataataccaaaatgagttgttatgtttaatttcaaacaaatcccaactggtgtggaagtaattaactgctagtcgatgtaatgtaatcatcaatatgctggtgacatatgatggcatgtcaggaatactgttgtaagaaagggattgttcagtctacctagaacctatgggaaagctgcaagaccatttacatatcagtacaaaactcctttattttattaaaatatgagaattaacttcaatttattaagattacgtattggtcctttaaattattaaaggtttacatttgataggattaatggatttggtagtgaaatatttttatatatataaatttttggttttttattttgagcactattgggaaacataagcaaaattgaaatgcatggtctttcagtgcaaccatacaatttttattcactttgtaatagaatggacaaaaaaactaaggtttatatattaaactaataaaaaggtacagggtaaattatatacatatatgtatgaatgtatatatacttagattaagaaaaaaaaatgactcacattcctgtaatataaaggtccattgctagttgaaaagtgacctcttttctctgtacatagtgaagcccgtatgtatggagttttaatctgtacagaaagaaatgtattattcattggtctttctgctgctggaaagataatagaatagctgattcttacaacaactgtatgatcagggatgagttagagtatttcttttgtctttgctcaaagccatacatatataaatatatataaagattattaataaattcaacaaaaaataaactacaa

SEQ ID NO: 54 - DNA, 384529 bp, Homo sapiens
aggaaaagacaatttctctctgattcagaatcctgaaaatgtgatctcccttaaaaaggtaggtgtatgtgctttttaatttgtgactaaaaaaattttatcttgaataaattacaatccagatgatttaatcgagaagcaattttttatgccactaacacgtgccattgtgaattgaattaaaacctcagattcatctttctaaattcaatatttaactttgccagtctttttaaagaatgactattttgagacaaaagttgatgtctacagcagtcaatgtatgtgatgtataataagtgaatgcttctcagcagatccatttttttattgcaatacatttatttcagctcatcttgatgaaatgtgttcctgtctttttcagtgggtgacatctttctaggaaaccaagacagtgtggaaatgtaaaatggtctgtggccagtaaaaaatgtgatatctttcattttgtggtgtgagatttctttttcagtgtgtggattgtgatttgctgcatactttgtcagctgtaataaggttgggggcattcttgggtgtacggtatctttttgtaatccatacagagcctgcaagaggtttccaaatttcatggagtgaactcatactagcttaggagccactttggctttcttttttttttcttttctgaggcagagtctcgctctgtcacccaggctggaatgcagtggcgtgatcttggctcactgcaacctctgtctcctgtgttcaagggattctcttgccttagcctctgaagtaggtgggtctataggtgcccgccaccacacccagctaatttttgtatctctagtagtgatgggatttcaccatgttggccaggctgatctcgaactcctcatctcaagtgagctgcctaccccggcctccgaaagtgctgggattatgggtgtgagccacagcctggcctttttttttttttttttttttggtttttatctcatactttttattctgaaatatggactggctctcctgttctgaaaggtgtagttggggacttggttctgactagagccatgcgttcagggagtgcctgtggagactgggaaaccgctaggcatgagtggtatggtgggtcccatggggctgtcaccccaaaccacaggactgcctcagagatttggggggtgttttaaggtcacagtggtcaaatctgaccttgtgccattatcctttcatgttatcctctagttggctctcagactgtaagattttaccttttagatcatttctgggctgagaagttagggtatagaaacaatttgtcctgatttaattacaataacaaattcgtgatgctgatggcgtctttcctcattcttctgcaacctcacaagaatgaccattcacctccagcttttaattacccatccagctagctcccagccatctctgccctgggaatggcttggttctctctgacagagctcaccaagcagttgctcacatgttacttataaagcacccacctctagatagcaaaaagtgaagactatggtccatactatatcattggaaatctagtgtggagaacgaacatacattgatttccaaattggaaatagaggagttgaagctgagttgtaatgttcggcccatttaagataaatagagccacccgtgtaaatttggcatttggacataaataaaccctatgagagtatgctagcagagtgaacttacagagaccagagagattgttgcgaatttgcttcaaaattggagttcaaaaacctgctgtatgcaattattgcagtgaattgactgcataatagttaaataaatgttttcttttttttctcagattatttatttaaatgttggcttcaaagacgatatagagaaacatgagttaatcaaagacagagagtgaggataatctttgatagaatgatgactgcaaaagagctgttaagtgtgatataaatgctgagttataaaaatacacttttaggaaatccaaattattaaaccttgatcatcttgaataataattggacttaactgcagcataaatcatctgcatcacgtatctgctagcagatatgtatagaaaaaattcgactttcaactactaggaaagttgctttttcgcatttatccaacattaatctaaaatccctcttgggaataaaaactcacatatctgcaaggtcgccagacagttaggagcacattctggaaaaggctcctcagctgcatgggtgacagagcccaggaggctgtggagtattgtaaaagtcctggagtatgtggcaattaattcgaaggatgtctcatgtgttaaatagtctcatatatatatacacatatatatacgtatatatgttagtctcatatatatgtatatatacatatgtacgtatatatgtacatatatacatatatacgtgtgtgtgtatatatatacatatatgtgtgtgtgtgtgtgtgtgtgtatatatatatgagactatttaatacatgagacatccttggaattaattgccacatactccaggtcttttacaatactccacagcctcctgggctctgtcacccacgcagttgaggagccttttcaagactgtgctcctaactgtctggcgacgtatatatatatatgtatgtatatatacgtatatatatatgactattttaaaactctgtatcattcctgctataaggaaatatatatgaatatgaagtgttactgaattaagaggtgcttttttattataatgtattttcttaatcaatagaaattaaatctactttatactactaccatttatactactattataaatggctaacaattcattttgacattaaacatggttctcataatcaaagaagctcataatcaaagaagttgaaagttgttgctctagaacatggggaaggtatctgaatcatgttaagattggatccatgattcgagcaagacagggccagaatgtttttaaatagtcagaagaaagaaatactcagatgtttattttattagatattagattaggttactaggggcaatagaggaactttcttctataaacttttaaacagtccattttcttgtatggtagcttggttagatgtattcttcagtacgaaagctagcagccacatgtggtcatttaaatttaaccacatatagttattttaattaagaaaattaaaaattgagttcatcatttacaccagtcacaattcacatgctcattagctacatgtggctagagggcagcacatagaacattatcatcatcatagaaagttttttttttttacagtgctggggacaattgtcatcactaggactgctccatgccacaagtagtaccaacaccacaaagctattcctaggggctttgcccctggggtcctggcatggaatggagaagacaaagcctggtttaccctataaatcgtgggagatttttatggacaggagtccttagtgaatgcgtggaaaagaaaattgtttccccataatcttccagctcccctccctttcattatggcccatatcccctgacaagcggcaggggtccatgtgccagtttgaattaacattttattgtgtgtacagtagacatttatccccatttgggctacctggtatctgaatccttttcctgaatttgggggcattcgtcattgtgtgaagctgggtggataaaagtgtcatttcttttaacttcccaagcagaaatgcccacttttgtgtttttcttgatgtctgccagcaagtaggcacactcatgggacttcaggtttgtcacatctgggactggggctctggcgagatgacttagagaggcaatggtttggaattctgcccatcactggtgcgggcaggaggaccatggtggcaggtccagagccacctgtggtgaccagcaccaacagtgcagtaggtgaaacagagttagttactgggaacaaaagcaatactaatggaaacagccttcccatgagtataaggagctggactagtctcccttgttctaatggacatcctccttacgtggaataataacaggacaatttaattttatttgttattgttaattttttttagagacagggtcttgctctgttgcccaggctggagtgcagtggcatgactgcagctcactgtaacctcaaacttcataacaggaaaattaaagaaaaatcaaaagaaaccacttagctgtaacacaaggaagatatgctgacttgtttaatggaaaggaatatactttaatggaagaatacatatatcagaatttcaaacatcccccatggatttagtaatggagcaactccattttttgtttttgatagagaattgtgtttataattctgtttcttacatgcaccatgtaatcaaaactgttgcctgtgaataatcactctttttctgattcctacttggctaggctggtatgcctgttttattgcttttccagaacagatagactcacatattgtttcacgttatgttttgagttcttaagcatattgtctcttcctcctgtgcgctgattcccactttcgtgcacacagcagctgtgtgaccatctgcatcatctcgacagtgccacagcttcctccgtagaatgctacggtgtgtcgcccgtggagggattcctcatcccaagcatgatttttatgtgggtaggctgcccgcctgtgaggtgaagtttctggtggcccatttcttcatatttcatgataattggtcagaggcttgcctggcagtggaaccatcaccccagggacagaggttgcctgctgtccatcatcacttatgctcagccctcaatagaaaagaagtatggtgtgaagcagccgcccaaccagagagactggtggaacagcctccatttgtatgtaggtgagctacatgatttgtcctcaccaacacaatgtgaacagtcctgtagggcaaatctgggacaaggcgtcgaaaccccaggctctatcgtcctctttcctgtggttagattcagatgactgggaggcctgaggggatggtgagagacaggatcaagtgaacctgagtctaaatcattgcgttatggatggctcctcactattcctattcaggaatccacatgttcctgaacagaaaatctttaatagtcatatttgccgtctttcccagtaacaaactctatacaatgaaagatggagcataaattatgcgagcaagaaagagaaatgaggttctattatgttaactctttatgtattttcagatttattcattgcagaggctgacattacccttgtacaccctcattcagccacataaatctcattatttctttttatcaggtattagctgacattttttcatttttcagttgcccattatgtggaatcatcttcttgcactgagtagtagcatggcttatacaagagtatgattatggcctacatacatttccctacatattgcctagtgttgcttacagataggtctaagagttagaggaaagcttagtgcctcattgtaaaaacaatttgccagttttgtaaatcagcttttttttttttttttgagatggagttttgctctgtcacccgggttggagtgaagtggcatgatctcggctcactgcaacctctgctccctaggttcaagtgattctcttgcctcagcctcctgtgtagctgggattatcggtgcctgccaccatgcccagataatttttgtatttttagtagagacagggtttcaccatgtttgccaggctggtctcgaactcctgacctcaggtcatctgcctgcctcagcctcccaaattgctaggattacaggcatgagccaccgcacctggctgtaaatcagagttctgagtgagtttttaatcctcttggatcactacaaagattgcggtaactgagaatgcaagttcagtgactaattttgcttcataaatgtatagaaaatggttgatggtcttattagaaaacatttcccaggcttaatagttctgtatagatgatagaggtagccaatgaagatggaaagagggaaacaattatacaaaatcatcttagattacaacagaaggagaaagtatttgatactcatttaaaagcagcaaatgcggtggttcgagatatacattttgcttttggcatgacatgtaaatgattgcttggcagagatgaagaattagggatttaatgtttttgctttttagtttactgtgtattaactaataacattttcttcttctacaatatggaaatagcaactgtatacctgtaaggttattaatggaggttttatgcatgctgatatatttgaaatgtttttagttctttaggagaaaagtgcttaataaacagaaataactacttatgttaacagtttatttctgttgacttaatatacctactttttcctcttaataatgccagagcatatttgggggggggctatagcttgaacaaaaataagacattattaatatcagcactttgtaacctgagacagatgatttaatctctcctgccatgttctctggggtttaaaggtgctattcagcaagattattatgaacaccaaaaaaagtctgcataaaatagctgcttggctgtcacttccatataagctatgaaggcaatgatgacaattaagtctaggacttgtaggaaccacatatactcactcctactgcctttgttcttcttcatgtctgctctgccattgtacttttttttttttttttgagacggagtcttgctttgtctcccaggctggagtgcagtggcgggatctcggctcactgcaagctccacctcccgggttcatgccattccattgtactttttaacacattggcatatactctgtgctgactactccagtatggagtgcttctcaaactttttggtctaagacccttctatactcttaagaattgttcagagttctaaacagctttttaacatgcagcttatatcataactatttgctatattaaaaagtaaaatgggaacatttacaaatacttattttaaataacagtgataaacccattacatgttaacgtaagtaagaattttttaaatgaagaattactgtatttttccaaacaatatatgtttggtgagaagaatggcaccatttaatatttttgcaaatctcttaaagtcttgcttaataaaagatacgtgaattcccttatttgcttctgcagtttattgagatattgaacatgatgaaggctctggaaaactctttcagagagtgagaataataaaaggaaaataatttcttagtatcattatgaaaataattttgacctttcagaaccctgaacttgtcttgagcacaaaatttgagagtgattggtctacgttaaatccccgaaggttgtctttagagtatttccagttttgccacatttactactttgtactagaaaatccctttcccatccaaaatattagtaaataactatttctatctagttaattcttattcagagaaataactaagaggctaaattataattgtttaattttaggctgcaattttcccatttattaattgcatcttcagaatatgctggcatcttaacccatttcccccattctcacagctgcttttaagtcatttttctcattgataagcactattatgagagcctctaaattggtctctgttccagttgctattgctgtgcaacaaaccaccgtgaaactaagtgcttgaaacagtaacaaccacaaatctgcagttagggcagggtttagcagagaaagctcatctctgccccttatggcatcagctggggatattttgactgcatgccagaggatccacttttgagatgattcacctacatgcctggcaagttgatgccagcagttggctgggagctaagaactagggatttccgtcatcaccatgtgggctctcaatggactgcttggtcttcctcatagcatggtggctgagttacaagagtaagttttccaagagatagaagtaaaagttgtcactttcttaaggtctggacatgggaactggtctagtgtcacttctgctggattatagtcaagcagccacaaagcctaagttcaaggagtgggaatacagactcctacctctcaactggagaagtgtcaaagaatttggggaccatgttttaaaattaccatactctctctgcctcagtccttctcacccgcaaattgcccagtatttgcatcttgtcctcagattcaatttcctagaacatagctctgtttgtcctgtagctccccattttctacctaagaacaaaattagtcttgcattcagaacagtccatttattagtttaccctattccttctttagtataccctgcgttttagcccaaatttatctggatttttcttcttttgcctttgattatactttttttctctcttcccagaatattatccctttaatctcttcacatcctaacattctgtcctcataataaatgctaccactcacatgaagacttccttaagctctccatccttctgtagtatgtctttctgttacctctcatcatacagtttaactgtaccattttaaagacctcccaatttctgtcttgtacaataatatatgtatattttatatgctctactagattttatgttccttggaggagatccatatttttaaatataatattaatctttagttgctctgatatcttgagatatatgtaacaagtgcttgatttttaaaaaaatgagtgaatgaagatatgaatgaaattaacagagtatgtttagactcacctaaaaagctattagaagtactatgattgttgattaaaattgctggttagccgcaaactaaataagtaaaaattgatgatttaattaccaagcataaatattagacaatattattaaaaagagatcacatccaaaataacagtacaaccatacaaaagtttggaatgactttcctagaaatgtatggtaggaactaagtaaggaaagctacaaaactgaattgtaggacataaaatgagtttcatattagtggagagagattctttgttcttggaaagccagattcagtgtagtaatacaaaaatatcagatttgttcatttgaagtgtacactcagtacaatttctatcaaaactagggaacttgacaaaataattccaaagtgcatctggaagtatgaacctattaatactctcagaattacaagaaatacttatgaggggcacttggcatcttagatattaaagaatattttaagtcaatgatgattgaacaatggtattgatacagggatacatcaatgagtaaaatattaaagaaccttgttttacatacacatgtatggtaatttagtatatgataagattggtgtttcagattggtaggaaaaagattaattactcaataaaaggtattgggacacctgcaaagtcttctggaaaaataaagcagggtctctaccacactgctaatatagaaataattctagggatcaaaattatacatataacaagataaactgtaaatttatgataaaaatctatggataaatatttttacaatttatgtgtatgtggggaagtcatctctaactagaaaccatgaaggaaaggatttaaaaatgtgactacatatacatatgttttacatctttatttttcaaaatgtcagcaaccatctcaacttgtttgaaggacagagcatataccgggaaaacatttacaaacaatatgatcaacaaaggctgatatttccaaagtataaagagcttttaaaataaactctgacaaccttatcagcaagatgaacatttaataaagttgtggagttaaaataatgaatatggggccgtcaaacatataaaaagatggtcaaatctgtcagcaatcaaaagtgcaaattaaaccaacagtggtatattattaggttggtacaaaagtaattgtggttttttgcatcaaaagtcatggcaaaaaccgcaattacttttgcaccaacctatatttctcggtaactaaaatgacaaataaaaacaagcaaaaagttcataattgatgatgctgtgggcaaacagtgtagttttttttcaaactgcactgaagggccatattttcccagtctgtttttgacagatatgattgtaacatacagtaaaaataagtagccagaaatcaaaaatcacagatattcggaataaaatatcaaatatgacacacatgcacacacacacacacacacacaaaatgttcatcagacataaaattaactctctcaaagtgcgttaaatatttctaaatgtttactctcaatttctggacctatctcagtggaccagtcaggaacattttgcagtctagcaccattctatggaccactcttagaatagcactcctttaatgtgccaatgggaacataaactgggtcagactttgtgaagggaagattggcagtatgtataagattttaaatgtgcaaacccttctatttctaggaatttgttgtaaggcaaattggatagttgtgtaagattatttatcctaacatctttggtgatagagaaaaagatgaaacctaaatatcctccagtagggttattggttaaatagttatggtagtcagactgtggaatactatgcggtcattaaataattaagcaaatgtatattcatttttcattatagaaaatttcaaatatacacaaaagtagaatgaatgcctaaaccatctccatatgaccatcacccagcttcaactgttacccagtcatggccaatcttgtccctgtcccttcgattagttgtgtgtttatttgtgtgggaagattatcttgaccttttgtaaagaaaaaccaggttatagtggagcatttatttactcgttcaacaattatggattatactcttatgtctgttgtggtactattctaggagctggggcttcagaagtgcattaaagaagtaaaaatctcagcttgcagcttaaattctagtggggaagatggaacaaccaacagtcaaaattttagcatattgttactgattatcattacagagaaaagggggaatagggagcagagggtgtgttgtcattttagaaaagattaacagggaagcctacccaccccggcctgagatggtggtctttgagtcaaggccctaagttgctaaggaaggattacatgtcatctgtggggggcgacctcctcaggcttttgggggtgggaggtagcaaatgccaatgccataaggcagaggtgagcctgctgtttctgaagaagagcaaggaagccccggattgaacatgaggagagtgctgggagattgggcaggagggtggcgtagggaggagggtcttatagtcttctgtgtggacttcgactcctgctgtaaatggaatagggagcctttggagaattgggacccaagagtgctgggatgttacttttgagaagactcacgttggctgctgagttcagagtacactgtgagggagcacgtccagaagaaggagaatcaggaggttatgttcctgtgtaatcaagggagattgggggatattgattttaacgaggtttggagggatggaggtggtttgaagaggtgagattctcgatctcttttgaagatagagtcagtaggatttgatcatggattccacgtaaggtatgaggaaggaagaggtggtgaaggggattccaaggttttgtgcctgggcaattgaaaagatggaagtgctatttgctagaatggggaagactgcattatgagaggtttgaatggagaagatcaggagttggttttggatatgtaaaatcatgattcccattaggtgtccaaaatgaagacagaaccaggagttagttggatattaagagtctggaattcagatgggactaggctgaagatgtgtaaatgtgggagttgtgagtctggatgaagtcactagaaaagtgaatgtggacaagaagcaaagacaagactcagaggactgagtctaagggcacttagagggtggggagatagggaagaatcagtgttagagatcagggataaagtgagctaatgaagtaggaggaaaaccaagggcatatggcgtcttagaatccacctgctgagtgtttcaaggagggaggattaatcagaggggctgtcaaagaagatgaggactgaaatttgactgaacaggaggctggtgcaaaagttggatcagcacaacatgtcagcttgaattccttgctgaggtatgaattgtgaagcatggaaatgatgatgatgataatactaattattattaagaattcaaaaggaacaagatcttctttttttttttcaagaatgccaaatatattccctaccattaaaattggatatagcagccaaaaaagaaagaaaaatgaattaaaattactgaaagacaattttacatgtcctgtcagatagtttaatttaaatataagctggttgatccaggtgcagctgcccaaacttggaataacatgggggaaaagcctagtgagaaagcaaagccaattgcaggagagagatacagagtgatgagagagagaggaagagagaaaacaagagagagagagagagagagagagagaaagagagagaggagaaaggggtagttgaagtaggttgcataggaaaaaccaggtgcctggtaaactttattgagtcccagaaatgtaaggtgccccccaccaaaaaaaagtgttagctgctcttaacactaactttagcctgaatagacttgaaaatgtatacatttttcatagatgaatactttccctgatacttaaacaatatagcacgatcttcagagcagagatgtgaatttgtatccctgggtctaaagtattgaacatttataaaatggtgtggctataagagtaccagaattgtgctggagtttcagtttcttctttaggcagttgatttgattaaaacaaaagaaaacaaaaataaacaaccaactcacacttctggtcctttctctggaaattatgaataaaaatatcaataaaactttaaaatagaattttagcagtctccctatttgagaaggagaatctcacaattttcactggtaggcaattcatgtgggattgtaatgcatgagtgtgggaaataaataaaatgattgcttttttttttttcgtaatggcctaaaatgatagcttcttgatttaataaacctttcccctactccctaccaccacccctctgcaacttacctacaatacacatattctagtgcttatcaaattataaaagctgggctcatgaaataacaggaggatttttgttttctgatatcagtcaaaaattgtttggaagacaggcagaacaagttaaagtgaaagcctaatatagtgaagggaaagatttgtgtgccagccacagatggactaagttcgttctcacataaatattatcctttttttcttgccaggactgaactgcagtcattgtcttaattaactcagggagttttcagttacagcttcaaaatctcagtcttctggaaattgtcatctggctttgtgttgtccctaagtagctgtgtgacctggagggaggcacttaaccaattcaggcctcagtattgggagtcaagggtatggaggcccagtttagctttcttctagccctgatgttctgtgaatctgttattcaagtttatggacaagttcccacagagaaggttagtagagttttttaaaattattattattaagcaatgggtattttactaaacagtactcaactattttttgcaaagtgttaatttgtagaacgttttgaaactccgcatagaaaatgaatgcacaggtcaaggctaacatagcctttcagccatattgtctggaattgttttttttttaaaacatataataaaaattaaagttgaagaagaaatgccaaaaatatatttttgatggaaaataacaacttacactgattagcatttatttcaatgaaatatgaatctttaaaacataggatttaaacatctttcaatggacatatacattattgtctcagattcataaaaatgtcttgtaagctatcatttctcctctatttacactgtcttttgtgggggaaataaaaagactaaacagtgtttagattatctctacacattttacatttctcccaaaggctgctgtgtaatggttggcatctgagagaataaacaggaaattagtgaggctgaggttctccttcatcttttgccagggctggactccttgcttcatttattttcataggacaccagaaatctgagaacagtatttaagctgactacgtttcttttatagctggccttttatagatggtctacatgtggcaatctacagattgccagatctttctccttttctccaacttagtgtgttggcatttgaagtaccaaatgtcctcttcaccaatgaatagtttagaggaagatgaacagtgtagccctttaggcatcgtaaaatactgtattttttttcataatcatgaaggtaatatgtttgttatagaaaatttggaaaattaatataatccaaaatcctacaacccacaaatcaccacttttgatattgtactgttgttctttttggtctttcatcaatttttttgactacttgtattcattaagcaggtattcaatttattattcaaactgtttccaaggtgagctgctaagaatgttaataggtgttctgggtcactggggacattgggaaactttccatgtcatatacgtttgggaaaatgccagattgaacgatgttagacttagatttgtcacagacacccccctcagggatgagcttcctgaaagggctctatgactcttctctacttgggaaggtacattgggcaaagcctggaagttattggacagagaactggctttggccctgcacccactaatgttgtaatgtggtgttcttcagatggcagtgtggatcttatttggtttttgtttgttttacgaaattgagatctcatgcttttgtaacctccttttcctacttaatatattatgaatgttttctactttaaatctgtttttcaaagagttgctttctctcattgttatttttgaaaatattccatttatgaaagttccatttatgaagctggggcctagcccaggtgacagatcatttcagtctgtggggatactcttgaaaggttctgtctgggttataaaatgtttatactcatttgaaatgtttccatcttccacccacccattctgacaaacctttaattttggacaactgctgttgaggctgtggattcacagttcccaaagccactgctaatttgtttgctttggaaagacctgacaaaaatagacttcttttaacacaaatggataattttctcccattgatgggcagttcatttaagaatattttatttattgtattataaaaatagcctctttgagacgaatggcctgctccaagtaactctcataaaacatagggattttcttccatacagaaataattactttgatttaaaatgggatattgccttctcaaagtattttttccactatgaagtatatagaagtatgtatttaatgtgtcttaaagtccactagtggaagtattactatcaccttttttcaaggctcattacctaaaatttttctaaaattaaaagcaaagacaaatatgccttacatttagaccaaattaaaaaaatggatctttattttggatagtccctttacctgtgctttactttcattatcacaaaaatatccttaactcttagcatttcataacaactgtgaccaatttttattatgtagttggaagtgttaagaatctgaagagaaggccttttacagtgattatctttgtgaacagtgtttagatacgttttggagacctgttgaaacaaataccctactctttttttttttttttttgagatagagtcttgctctgttgcccaggccgcagtacagtggatgatctcagctcactgcaacctctgcctcctgggttcaagtggttctcctgcctcagcctcccaagtagctgggattacaggcacgggccaccatgcctggctaatttttgtatttttgtagagatggggtttcaccatgttggccaggcaggtctcaaactcctgacctcaagtgatctgcccacttcgacctcccaaagtgctgggattacaggtatgagccactgtgcctggcccaaataccctactctttattgattgtctcacactgattgataatggtcagttcctcaggcataccatatgtctttaaaatattataaaaaactttgtaaagtcttttgttttataaacagcttatctgggctaggcctggagcatattcatagactgtccctttatgcaattcctgggcaagtgcatggctttgaaaaagactggagctgaaaagcataatgtgtacttttggcctggggattctttatagagagtatgcagatttccccaaggaaaactgattttgcatgcaaaagctgtctctataattataacaatttcctcttgccctttttaaaaaaaaattcagcttctcaaattggtacgtataaaattttaccctttccacaaaagcaggccttgctgaaggaactgactgctgaaaaatctcatgccaagtccctaaagcagctaaagggagacattataagttttgaaatgcagcagtctaggaggtgaaggaatggcggtcctgtgagccttgacatcaatttatgtgagtgtgtgtgcaaggtgccatcccacagcttatacttagaagaaaaatggactctttaaagtaaagcttgttaattgagtttttctttttctgagggttgtgcttacatggtttaaattgtaataaaaattaaaatgcttgaaatgttttagagtcggagccctttgctgctttagctcatgggcacctccaagaatgcttcctcagatagcagcacaaaacactggcagttctccaagagaacattctttgagaacctcactgtgattgggaaagggaacttcacattctgattgtgcagaagtgcccgcgggatgtgtagtctacattctaaggttgcttgttgtcttccatggaaagtgttattttattatatctttcagatatgttataggtgggaaaatccgaataactgcttttatcttggtcaggaaatacagggaattggtgtactggggaagatcacatattacgagacacactttaattacctttgtggagtattacttttctaataaccaaacttgttaaaatgctaaattttatttgtgttttaataacccagattgctaaattgctaaataatctaatatactaaattgctaaaataatgccaaacataattaaactttcatttggttctgaacaattttcagtgtccccaagtcattatcaatattgcattaatgtagaaatctagtcatttggcgtccctattaatagaatgccaaacaaattgagtcagacatatatacctagtgttgtgttgcatgcagcagggtagaaagggagtgcctaatcaagctcacaatgtgatttttgctcaagttgtgatgtctggccaggcgcagtggctcacgcctgtaatcccagcactttgggaggctgaggggggcggatcacttgagatcagaagtttgagaccaacctggccaacatggtgaaaccctgtctctattaaaaatacaaaaattagctgggtgtggtggtgcacgcctgtaatcccagctactcgggaggctgatgcaggagaattgcttgaacccgggaggcagaggttgtagtgagctgagatcatgccattgcattctagcctggggaacagagagagactttgtcttaaaaacctagagggacttactcctgttggaggcacacatttctaacgagataatttgggattgacataggactgtgcttaataaggtgttcagaggggtggtgctgatgctaggaacggagaagacaaagtaagatgatggcaatgttgagttaagctgggcagtgacctgatttgtttatcatttggaggagaagtcagaaaaaaaaagaaacagcctaggtagaggattagagatgagtatgaatattgagtgtgtcagggagggtaatgatagtctgagctcactgcattaagatgaagtgttaaacactaataatgttgaagcttattccaaacccctagcttttcccctttttccttctaattactactcagcaaggtaatgagtgatggctcaaatgtgggattaatcaggggaggaagactatcaagttctgttctgtttgtgcatccaggggagaagctgcttagagcagtagccagttgttgtcagcactcttcccccaaccccaaattaaaggcagctttctggaatcatattatggcacctggggaggattaacatggcttcctaagatgcctgagtaacgacatttcttcctgtcaaagcacactgctgtaaaagaacacacttcctgatgatggccttgaccgacctcacgtttaagggcctgtgcacagttctgttacctggagtaggtgatctgtgacaccggcctttggttgctgtgtttggccatgaatccaccctgatgactatgaacttcacagagtaattggccaggatatcccttcccttactgtcatacttgctgaggtgttagttctgcaaatagtatcctttgtggatctttgtgtttgtttgagtaggtgaaggactttattttatattctttttctctagttacttccttattttaataagtaaaccttattctaagggttagtttctatgctgagaacagtgggtctctagactacttaaaattttccataaatcttacgttattcattttgtaaatcctgaataaattgaaacgagaacagtgctgatggtcctcatagaaactgaggtggaatgtgtacacattttaaaatttatttaaatgaggtgcttctaggtataacacatatataaccctccctatatattatttaataataaaaatacctctacactatagtgctttatgaatagatttttaaaacttcttcttctttttttttaatactttaagttttagggtacatgtgcacaatgtgcaggtttgttacatatgtatacatgtgccatgttgttgtgctgcacccattaactcgtcatttaacattaggtatatctcctaatgctatccctcccccctccccccaccccacaacaggccctggtgtgtgatgttccccttcctgtgtccgtgtgttctcattgttcaattccctcctatgagtgagaacatgcggtaaaacttcttatagtataattgaaatgtaaatttagtgtaattaatatgaatttattcatttaatttggattattgatgggcttgattcttcttaatcctaatgaatacttgcaggccacaggtagttgtttagcattagcaaagtttatcttaaattatttcatataattatattttaagtatgattttaggctctagatttggcctttttcaaatttgtaatatgctttatcaaacattaaacaccattttaaagtaatgtaacaggaatttgggaaacagaaaaacatacctcttttataattttagtactttaacataagagccaatatcgttttttgtacattttgaatcctccacatggaccacacatatttatagctagaaatgtgaatatatatatataattttgtattattcttcacttataaaattagcatttctgatattgtatccgtgtgtgtgtgcgcgtgtgtgtgtgtgtgtatggcttcaaatcttttatgaaacaaaatttaaagttatgaaaatattagtgcccagttcaattcccctcactccactccatttcacattccccagaagtaacttttcagaattctatttttcttttctgtttatgtttttatactcttgtctcatgtatgtgtcccttatatgtacgtataagatatatatgtgtgcacatatatatacattgtgcatgtacatagatacacacatgcagagtattgttgtgtattctaaaaatgtacatatctgcaaccattttgtctgcccagttctattccattagttttgcctcacctatccttatatcagtatcacagagctaagactaggatgaggcaagcaaggtgcgctggacatagaattggtgcagacatctgcccttaggctgtaggagcctcggttgccttccctaatctcagccatgacaatagctttatagaaacttttggtatgtggtaggttgaagtcttggctatttttggcccctttacccttcaaataaattttaaaaaacagcttgtcaagttccatgaaaaaaaatcccagtggaaatttgacttgaatatatgaaatttatagattaaatgagggtggggaatggacatctttaacatatcgagtctacccacctatgtatatgctggctctaactattgatttaggtcatttttaatgtctctcaaaaattactttttctataacatcctgcatgttttttattcaacttatttctgcatgccttagagtttttgttgttgtgaatgtgaatttttaaaactgaattttctaattcattgtggttggtgtatacgaaagcgttggtttttgaatgtccctgctttttctgcagccttgcttaacactccaatttgtccgaatttgtctacagattcatttggatttcttctgtagagaattctattatctgtagttacttggttttcatacttgtaacttaatgactatataatacttcattcatcatttactttgctgttgaacacatgggaagttcctgatagcttctattttaaatacaattatagtgtacaccttcatacattttttcacctttccagttattttattgggattcaattttgtaatttctgtcaaagggtgtgaacatatttttacagctcaggatatgtgttgccaaattgctttgtagaaagctttaaatccttttacactgccaccagtagcatgtgagagcatcagttcaaccacattgatttgaatgatggaaatcgcacctggaatgctgtgagtcttctgactgatttcctgtgtccattcctatccgtgcttaatcagtcctccacacagcagccagaattatcttcaaaaatttaaataagattgtgtgattcccctgctgaaaaatcctccaatggctttcctttagatgtagaatttagcctaaacttccaaccaagattcctatattctgacccttttctttcttctaacctgctctgcttttgttctcctgtgcctcggctacactggccttcttgctgttgctgaaacttgcttaccttattcctaccccagggcctttgcattggcagctccccctgcctagaacattctccagctcattatactactacctctacctatcgtgcatttttcttgctcagctgtcacttccctagaacagacttccgtggcttccctttctaaaataaccctttttggtcacattcttttctcttactttattttctttacatattttttattatctgaaattatataagcttgcttattatttatttctttgtttaccattggcttcttcaagtagaatataaagtcctcaaaaaaaaaagctttgtctaaagtgttgactatcattatatatcaaattttctagtggcatcctacaaacattaaaagaaaaaggttacatgtgcacattgtgcaggttagttacatatgtatacatgtgccgtgctggtgcgctgcacccactaactcgtcatctagcattaggtatatctcccaatgctatccctcccccctccccccaccccaccacagtccccagagtgtgatattccccttcctgtgtccatgtgtaccctaaaacttaaagtataataataaaaaaaaaacaacaaagtgcttataaaatatgagaacagagcaacggtaagtgcaatcttctataaacaaagaatttaataaaagagacggaaataaaaataactttaaaaagttaaaaaaaaagaaaaaggacaaattaatattaacttttaaagcatgacatatctaaaatattattttcatgcataatcaatataaaaattatcaagacattttacattctttttttaattaagtcttcaagatctggtgtgtaatttacacacagcacatctcagtttgaatgagccacatttcaagtgctcagtagccacatgtgattggttccttccatatgtgacagtggagggctagaacagaacaatgcctgagacacagggaaaaatcattagagactcgctgaatgggtgaacaagtgaatgaatgaatgaattttatttagcatgtgtaagtaatgaaaatccaagtcaaattaggagtaaaatcaagatcccataaaaagtgatttattgttagagaaaagtgaggcattagcacatatcctttactggaacactattgtggtatctgaatgggctcagttaactgtcacctttattaaggctctcatgtgctctgagcatcttgctaggatgagaaaaataagatgaaattcttaagatatcggaagtctggtgagttgataagaacttgatgcctaactgtgttgtacattgtacgtgttactgaaacagctgtgggcatcatgaattaatttttcccaggcttttattcatattcaaaagcttagactaatagtcacattttattaagtacattttatgggcccttagcattttgctaaatgctaagggagcaagtatttgccctcacactattttaatgtgtatttctctaggttacattcttaacttacctgcactatcctccaagcataattcttcaaattttcagctgtattgagattctaaatggacttccaatgtggacttttcttcgttttcagcttataattggcaagttcccataggaaaaaatcattattggtgctataaaagtacttcttatctgtcacatttgggaaatgaaagttttgtaaaggtcaaaagaaagtgtgcccccaattatgatgaagacttgtacatcatcacaaatagtttaatagcttggaacttatcttagtctctcttacagtgtataaagagaaaggagaaaaaaaaaaaaaacaaagtagtcactccatagcaattttaccatacagttttaggagagatgaaaaggatcccatcgaaatcatttgatcaacatctatctatatcttctttgtggtttggaactgtttaagttatataagcctacaagtttattagttcacctttattaatttgtcaaggttaatgactgcataatgagttgaagataattaaagatttgttggcaaccatctgctagtgtttacgcagtacggtaagttttataactcatcttgtaatgtttcctaaggagattctttgccaccttactaattttaaaaacacaaaccacgctgttgccttaggcagtgtaagaattcttttccttaatcttttagcatatgacagcctattaggaagatcagatgatacacctctaagaagccgggagtgtgtttgcagacactgttgagagtggagtgataccagccggtcggacacatgacctggcagttcccctttctttcagcaatctgctttggcagccagtctgcctcgggcatctgtgctaattattctgccccagcagcagagctgtgggcactgctctaagaaggatccctccttgctctccttatgtgaaggcccatctgcgttacggaagtgaacaaactgactgagtgcagtcttctcctgagtgcctactgtgtgcagcctcattattaatagataatgaagatagccatgtcagattaaaaggagggattgggaacagttcaaggccctctctgaatgtcttattcaaattcccatttcatctgttctcccttgacacgctccttttctcaaactcctgaactcaagtgatccacccaccttggcctcccaaaagtgctgggattacaggagtgagccaccgtacccagccgacctgctccttttctaaacctctctcttcttcctttctctctcttagcaacatcttgccatctccccttctctctctttatagtgagtaattactagttgctctgtattctagttccaaaatctctcccatgttcatcctcttggatccattgtctgggtcaatactacttctcatctgcagagtgtcatttgcttcctaatgggtttccccatatgttcctgcactcccttgacccaagctcacctccactcaccttctggaagcaccattctgatcccaaggtgccctgctgcagtcttccatgggtttccacggccaggtgaataatgtcaaaattccttaactagaccgtcaggagcctcctcctccatgctatgaggtctccacctcactcccagccttatctgccttccctgaactgaatggtccctaaacaaaatgagctgctctcttttggtgtttccacctgctcttgaggtccccacctgagctgtcctttgccccacatgtgttgttgtgccatcacagctctcagccccagtgccatctccctgaagccctcctcacactggaacctcaccacacccctcaccgggatgatctacccgtcttgaccatctcctggctctttagatctctctggaaggtctcaaagcttttccctttgttggattttatccacacaccattggaggccctacctgtcaatttccagaaggcagtgcgccattgacccacttttgtggccaccacagtacccagagagcacttggaattcacctaacacctggatgaatgtttcttgaatttcttagtccctgatatggaatattccttgctctctattttttttaactagtttttttgtttagtaaccatcacccacaatgaccagaattttctctccttgcttctggcttctccacagggctctgaacgccgcttacgtgtcgtcccacctgttctctatttttgccctaatttctcaccattttctgtttcttctgagttgtccattctccaccctttaatttcaattagtcagtcgtaaatatttgtccctatggcaggaccagcttttgtctggtctaaatgtaggaagtggcttgtttataatttcctagcacaagtaggccagttactgaacacaccgatataaaatgtactactagaatattcagaaatcctttagggagaattgctggttttcctgtgaaagggaaagacaagtcttcagtggaaacagcactttaatatcaagttttgaatgaactgtattcatttcattcaaaactcagctctgacaaatatgggtaaaggacatcagtttcagaaatgcaatgcaatgcttgcaattatggaaattatttcatgttttccaattgcttatattaggttgattatatttaatgtttattcctgacaccaaatttatgtattttagttataaaatttgtgaattatagctgcaaaatattatagttttcaagtcgaattattaccagcggcattcctgtcaactttgctttcctcaggactttcaaatagaaatgttattaaatatttcctttttgtcagtgtttgcacttgaaggtaaatttaaacatgagtgtgttgtttggtttctctcattgtggatggactagctagtttaatatttaatggcaagttttgatgtatactgataagaagagagacaaagaaacattattgtatttaaatattatctttctgattgtaaaagtggtgcttgtcgtagataactctgtaaattcaggaaaacataaaaataaagatcactgttgttttaccacacacaaaaattactataactataactcgatgttatatacattacctattatatactgtattttaaaataaaattgggattatattggacatacaatcctgtttttttttctgttaacattatattgtgattacgtcctacgtgattttgttttaaacatggtttttaatggttgcatacctttaaaacaggaagaattataagttatcccaggaatcttctgttactggatacttaggtgttttgtttcattgctttaaaatcatttctactcctcttcacaatgtggatacttgggaattgtcacatcatagtcaatttcacaagacaatatagattaactagccatgcactcttaatgtacatatgcagtatttcagacattagaagtagggagatcagttttgcttgatgcaggcagttaaaaatcacgcgcatgtaaagaaaggaccaattttacttgcctcagtgttggcccaagtttggagactaaagcatttacagaccattagctctatacttcactcttgagaccacttgttgtaatgagctgtcaattattgtgcatctaagtgtagttaaagggaccattgggcttgcagtttaaaagccaacatttataaatgtgtaggaattgaattataaatgcagtggttcagtaaggatgtactgcatcatggacctgtctggatacagtatctgttctctgaaagattttagtgttcattaaaaacataagaaacagtaaaaatgtactcttgagcatatagctatacaatttttatgtttttacaatatagtttgggaaaaatatttttttaaatcaagagattttaaaaagtaaaaaacatttctttactaaggtatttattaaatatgcaatgaattaatttcagctgacatgttggagtgaggagaaggatggaaattggagatttccatttgattcagtgaagctacagtctattaaaaaaagtatattcttcactacctgtttatcattagtttttgaatagtatttgcctttgaaaatctgtgtactttgaaaatattttactgcagcttgtaaatatggcctgagtaacatttcacattttttcatggttaaagatgccttttgctttgaatgtgccaattctaaatatcactcttttaagaaactcctggaaatctcctctttttttttttttatatatatttcagctatttaattttatcatgttcttaaagtcaatattttgtatgtgaagagtgccccttaaagtttatttcttctttttattttttaacatgaagtaatacctgcttgctgggataaacaatatagatgagtaaaaaatattttgttcaattccaccttctctcttcattttctcatcttccctagaggcaattaccatgaacaatttggtgattatttcttcagatctttcacccaaacttttacaaagataacataggtagataagtaggtagataggtagttgttgatcacagatgtaaaataggttttcttatataaatgacttcatttctttcaaatggtatacaaaacctgtataacacagttatttacagatctatgttgtatgtagctgtcacaagcaggagttggcagactttttctgtaaaaggccagaaagtattttgggctttgtggagtataccgtttgttgtgattattcagtgttgtagcacaaaagcagccacaggcaatacctaagtgagtgggtgtgtgggactgggttccaacacatctgtatttatgtatgctgaattttgaatttcatataattatgatgggagttgaaatattattcttcttttaatttttttcagctatttaaatatgtaaaaaccaatcttagctcttgggcttttgcaaaagcaggtgactggcctgatgtggcccataggctatagtttgccaacctctggtctagaatattaaaataaaaatcatttacaaaattaaatctcaaccgggtgagacagctcacacctgtaatcccagaacttcgggagactgaagtgggaggattgcttgagcccaggagttcaagaccagcctgggcaaaaataaaataaaaaaataaaaattacccaggtgtggtagcacatgcctgtagtcccagctaattgggaggctgagatgggatgggaggatcccttgagcctgggagttcagagctgcagtgaggtatgatggtgccagtacgttccagcctgcgtgacagaataggacctgtctctaaaaaagtaaaatcttatattttgtaagaggtaaatatcacagtgagattggtgaataaaggcaaataaagaaaatacctcttttatagaatagtgatttaacactttacagactgtgaatgagagactgtatttaagaaacaagcaacaagcaatgataagagaaaaaaggcagagaattagctgatgtgaggtttcaagtactggagagtccaagggggtcttagtgttgtgaccaattcacaaactcccttggccattccccagggagaaatattcctgatcccttttaacattatgcttttatttgcatgtatcatctttttatatgaactttgttttgcagtgttagttgataagtctcatctttgtaattgacaattgtttttatctcctgtattgtattttaaaaagtttattatgaagtgtttatattacttataaggaaataaaatagttacattgaagattgcccaggaaatacatttcattttaaaccttttcaaatagatgcattgtaatgttaagcctggccccattaatttatttcaagggatgttctctgaatgcctgaaatacgcttgactccatcaattcaccaggcgtgtctcttgatggcaattctgctttcagaccaatgagaacaccgtgatccagtttagctgccttctgaagcaattgctagttttaatataataaaaataaaacaataggatgtgtattgttctacctgtgaaactgtcatttttccactaaaattacaaaatgcaacatacaattcataaaactaaaaacttatttttaatgaaataagaagcagtttattaaggtatattatactctctgattttatgcttggtatggaacttaatgaatgtgtgtggtaagaagtaaaaatggattagttgtgtgttttttttcaaaccacttgttccacatttttaaatttcattttcttcacctaaagtagagaataaaatagtgtgttatttttccaatgtataacttggcaatttagatataactcgtaatgagggatattcctactagacaatcaaatataagaatctctttatatatgtatatgaatgcacacatgcatatatgaataagggcttatatcttttattcttcttagaggttcatggcataaaatttagaaactagagaccaacataaggagaaaataaaaggatgtgtatttttaccacccagccatagccctattgatatttgtgggactaccttccagtgtctcgtgtctgtctctatatgcgtatacacatataattatagttcagtcctttatttctcagtttatatttgttgcttgtctactatgtgccaggcacaatgtgaggcaatagggacatgacagtgaccagaaccatcccctctttccctgaagtttactttgttgggggagacaggcattaacctaaggtcactatgtgtctagtagtaatgagcactgtgaagaagattaagaccagaaaaggggacaaatttgtgtgtgtgtgtatgcatgtatgtgtgtgtgtgtaaaagtaaagacagtaatgggattgtactatccatactttttataacttgcatttttaaataaaaacaatattaatatttttatttcactaaatatacttctaagcaagtgttattttgaatgctatactctacttttctataaacgaattaagtttatttaacaagttgtctaatattgtaaacattgtttacttttaaaaattgctattttaagtattgctgtaaggaatgtcattcactgaagacacgtgtttttacacatccctagaataaattcctagtagcagaagtactgggtcaaagaatgatcatgtgaaggctcttgatgtgtgtttgatatgttttaaaatgttatatggctccttcatgactcaatttgttttccttcccctagtccccttcactcttccttccatattttaagttttaaatctaagcaaaagtagatcgtatacttcatatttaaagaactctttaacatgttaccatgataacatattactttggtagtgaattttgtgttttgtttctgaagtcagattcttattgtgagtgagagggctaatgcacttataatataattgcatcattgcacaagctaacaaagtcctattgttgcttacaaagttggtatggaatgaaggaaaaaatacattaagcacaacaaaccagcagcagccttggaaatgcaagagattcagagcaagttttaacatgtcatttcatttgctttttttttttttttttttgaggtctgaaaaaagtctaagaatactgaactgcatcacaaaggaagcattcagtcttgagagaaaaccattttagcttgccttatgatagatttttctattccagcaaaataaaataaaatgccctactttgctgtcactttccactggttttctttcagttgacattacctgtaatactaacagtcataagtcacatacttacatagcatatcctctgtgccagatactgtatttcctcattttaaagctagatgggaattactttccacaaaagagagtggacgttttaccaccaaggcactagaggtttagtagctctaacccttttcagaaatcatagacagaagtagaagggcggtgttaaagcaatgctcattgaactctaaggtgtgcacaaatcacccgagtatcttgttaaaatgcagcttcccaggcagcaggtccgggagcctgagactctgcatttctaacaaactcctagggaaagccatttctcttggttcaaggaacacgcctcacataggaggcatgaggtacttcatactgctcatcctgaaagccacctctgtgataaaataatagatgattaaaaatttcttatttttatttttatgtatcttccaagttttcatcagtgatcatatattagtcttataatgagaaaaaaagtgaataaattgattttttaagtagagtagtccctttccccagatttctatggatggttttccttgggcctctctttgaagatctttgaggtaggtctttgagtgggttgttagacacttcaggtgccctgcccatactactcaacatttaacttttaaaaaaaacggtggtaaaattatctatctatctatctatctatctatctatctatctatctatctatccatccatccatctatctaaacggagtcttgctctgtcacccaggctggagtgcagtagcacaatcttggctcactgcaactgccatctcccaggttcaagtgattctcctgcctctgcctcctgagtagctgggattacaggtgcctgccaccacacccggctactttttgtatttttttagtagagacggggttttatcatgttggccagactcgtcttgaactcctgacctcaagtgatctgcccgcctcggcctcccaaagtgctgggattacagacgtgagacaccacgcccggcccatatttttgatatgatatagtttggatgtttgtcccctccaaatctcatgttgaaatgtaatccccattgttggaggtggggcctggtgggagatgtttggatcatgggcacggatccctcatgaatggcttagcgctatcctcttggatgaggggttctttctctagtagtttacatgagatccggttgtttaaaagagtgtggtatgtcccctcttctctctctctcagtcccactctttccatgtgacaccacctgctccctcttgattgtaaacttcccgaggcccttaccagaagcttatgctggagccatgcttgtacaacctgcagaactatgagccaattaaacctttctttataaattacccaacttcaggcatttctttgtagagataccaaaatggactaacacaccatcttaaccatttttttaaattagtttttgaaatagaatctcactctgtcacccaggctggagtgcagtggcgcagtcttggctcactgcatcctctgcctcccaagttgctggaattacaggagtgtacctccatgcccagctaatttttgtatttttagtagaaacggggtttcgccttattgaccaggctggtctccaactcttgacctcaagtgatccacccactgccttggcctcctaaagtgctgggattacaggcatgagccaccgcacccagccagtcttaaccattttttaagtgaacagttaagtgacattaagtacattcacagaattgcacaaccatcattactattcatctccagaactttttcatttgcaaaactgaaactctatatccattgaacagaaacctccattcctccctcccccagctcctggcaaccaccattctattttctgtctctgcaaaattgactactctaggttccccatataagtggagtcatatagtatttatcctgttgtgtctggcttatttcacttagaatgatgtgctcaaggttcatccatatggtagtatgtgtcagaatttccttgtgttttaaggctgaatactgttccattatatgtgtataccacattttgttgatccctcatccatcaatggacacttgggttgcttccaccttttggctattgtgaataatgctggtatgaacatggatgtgcaaatctctcttcacatccctgctttggtacttagcatttttatgcccaatttccaactgcctgcatctgtgtcttcttacctgagggtgtcttctgaccacctgccgtactcacatatgggccgaaaagtcagtccccctcccaccaattaggatagaaattggtgtataactataccaggtcccttgcttctggggtggaataactggagaagtgtattcttcacatttccccgagttccccagtgggatcagaccgcagttacccttggtggtaatctgcttgatatcacattctatactggcttccttccctggttcacttttcctcagtcaccttgtgtttcctggaatatttcctcccaaataaacttcttgttctcaaatactgacttaaggtatgcctaaaggagaacacatctaagggagttaaaaaggtgcactgtgaatatctatttacacccagggatactctctttttggagagcaacagtgagatttcaatatgtgtggtggattcttagttgggggtacatctgccttcccaccccattcaagtgatgttccgaataaaattaaatctgttcatatgagcatttaaaccttgttgtaacattttatacacatgttttcaaaactctatttttgcttcgtttctaactcaacaacttattctcccaatttaattaccatacatggagctggatcccgaagaaagaagaaaaacagctctacaaacaaataggtcttttgttggataggatagttgttttctatatatagattcttgtttcttccttttgctaccatgtttagcctctggggcttctcttggttgtatctagtttgttgttcttggctcattttggcattctctgtgtattgtatttttaatattaaattatgtatttagcagcaagcttagaaacagatgaagtttcttgtactagagctgctactcaagatgaaaatgcaatgcagccgacaatgtaagtcagagctgtgcttcagtgtctttgggggtgtctggcttctagggaggtgtgaagttccattgatctttgggagctgttaatgtaggagattagtttaagtatttacacaccaaccttatttaaggcagctactgcagaaactcagtaaaccatttcaaagggaaaatgtgtgcctttctaaaaactgcagccagcttccacactccccacaccaaaaataaatcttttaattgtgtatgatgcagtagatgcatgcatacttcaaaagtctgcctagatcttcctcttctgaatttaaaagataaattactctaattgctgtgtcgtctagctggtttatagtaaatgaataactttcaacgtagaaagcagttacagctacagaaaatagacagtaatgtcactgcaagtgtttcctctttaaagtcattgaaagagtatcatagcagatgttttctgttttggactgttttcccatgaaacccatggatgacgtttgcacatgataatttatctccttaagttaggaacaaacttatctgatttcatatactggaggttggaaatcctttttgttaacttagcacagtggtaactggaaaaaataagctttttaaaaagtaggatgaattgaagttgtgatcagataagcaagaagtaatatgaagcccaagcaaagcaaacttagtcattgtttctctgtgccaacacagaccatcatattcattatgtccatcaaaataggggaggtctaatttagacagataaaatgaagtccattcttctttgtgaaaggaatcggagagtttcctgggaaaacagctcagcctctctaagcctcttgcatgtccatgggcctcatggccagcatgtaacagcatcatgtgaagttacattgcatgcttaggggtggtactaatagcataacttgactctttttttttaattcaaggagcaataactgactttctactctgggccagatctgctctgttctgaagatacctgagaatgatcagttctttctgtttagctagtaatctttcggtacatctattgccccatcaattgatttatcaaccaattgactaactgatcgatcaatctctcttccctctttctctccctttttccttccttccctccttctttccttccttccttgcttccttccttcttttcctccctccttctgaaacaaaatattaagctaaagctagagtcaggcagcttcctgaaagttgagctctgaatcttaccttgggtcctcagtaataagatattattggatctctgtgactggtaataactttacttgttgaaggaatgagattggctcctttgagtgcagttggtggttaagggcatagcctctgtatcagagtgcttctgtttggcccaggaagggactaacgtgtatggtggttgcagttttaatttgatatagattgattcatatatgtagtcactgatttttaataaatctgttggttcgtagttcaaaaagtctgggcaaaagaatctggtttacaaggaaatcctgttccaaccatggtagactgttacatttggtgaccctgctgaactctgcctcctatcactcatgcccttgtctattatattcctcattgactctagacttggccatataacttcctttggttgatgggacattagtaaaaatgatacaagcagaggcttgataatcatttgggcttgttttcttggaatgctgcttcttggaagccaaccttgatgctacataaatgtttggactagactattaagtgattggccacatcgatagagaccctgaatgatgagaggccgtctcgcatgttccagccccagtcaaactcccaactgactgcagtctattgagtgacctcagctacaccatttacaacagaagaactgcccagctgagcacagccaacttaatgaattgtgaggaataatttattgttgttttaaattactaagttttacagtagttagttacaaagcaatagataactaaaaccatgtcctactttacatggtctgtgcaaaaggacaaaggggaccttgtgtatgttgtggctcatagaagactgcatttcataatgctatagtgccattaagagcatagtcagcaagggcataatgtttgtgtgtgtgtgtgtgtgtgtgtggttgttaaattgtgagatcactgcttctacctttgcaactgaatgtcatgcagtatttttatttccacatagttatacttaaggaagctacctttaagagtaatagctcttttattcattcaggttgtgaaagacactgagaattatgaagaaaagagcagtgactccaagtcctacaacctagagtccaactttaggaagttttcatattgtaaagatggttaacataatgaaaaactatacttgattcttattcataagcctggtgaataaattagtaaattagatccagttgagagtgctgacactcttgatatccttataaaagtgcttgtaagcatggacacagatatgtggattcttctattggatttatcgtttgcgatgcccaccactgcatttcattctctacattgcaatcagattgctttttctaaacggcaaatttctgacttatttctgcctatacaatagctcctcactgcctctagggcaatggttctcaactaagggcagttttgcttctaggggcatctgacattggagacattattgactatacttgggcactactgtactatattgtagtgactaaaatagagatgctactattttctagtgagtagaagccagggatgctgctaaccatcccacaatgcccaggaccaccccccgacaacaaggaattaaccagcccaaaatgtcagtagtgcctctgttgagaaacactgctgtagggtaaggccctaactcctagctgatgcttccctttctaatttcatacctctgacctttggctcatacttgtcatgtatgcttcttatgcagcagcaaactacttcctattttgatatcttcttacctttaggtctttgcttatgttgttctcatagtctgtgggttttatcattgtgctttgtgcatacttctgtttttctgatcacactgagttgcaattacttttttttgttgttgttgagatggtctctcgctctgtcacccaggctggagtatagtggcatgatcttggctcactgcagcccccgcctcctggattcaagcaattcttttgcctcagcctcccgagtagttgggactacaggtgcacaccaccatgcccaacaaatttttgcatttttactagagtggggtttcaccttgttggccaggttggtcttgaactgctgacctctggtgatccatctaccttggcctcccaaagtgctgggattacaggtgtgagccaccacacccagtctgcaattactttttaaaatctgttgtccctacaagcttgtgagttcagggtgagctagcaccaggctacatggctaggaagtatttgatggaaagaatgaatgtttgcgtgagaccactaccggaaaaggggctgaagctgcataagtggatagctgacccaccctcagcgagctttcctcacattgggtgaatcattcccatggaggcactgtggacagcagctctccctgtgcacatgattttaatgccacttcacagtggttcttcctctgtctttttgtgttttaaacctttaggagacatcagtgtcaactccaggtgggcttcacaatactccaggtagctttgagagacaacgtaagacatgcaaagagtgtgaagacaaagctttgtgcctcaaatgtcctactgtaaagaccagggcaggggagaatttttgagaaatgaaggactggttcaaggcactgtcttttgccccaaggcggcattaacattaatttagcataatatagaccagttattctcaatcttgcctgcacatcagtatcatctgggttcctcaaaaaataccattgttggtgtccagccccaagagctattggtataattggtcttcctgagtttcagaatttttaagtttcccacatgtttctgttatgcatccaactttgaggacaactgatatagaaagtagattatagatcttcaagttaacatttccacagtaatttactattttccttcttggtaatgtactgttacttaataattttataatttttagcataagtaataaattagtacttctaacttcattcaaatttataattgcattaatttaattaatatgtaactttttggtaaatgacattgtataaccccattttttttaatatccttctccctcttggccctgaaactcagaagaaatatcatcaagaagcagctgacccgtcttcatgttggtggaagttggaaggaagccattttttagatagtgtgcccagaaagacacaaaattagaactttccttttggttcctgttctgcctcccgtttccaatacccacagttctgtttgcctaagagaaaaagtaggagcatcccccatgatcccagaaagtccttctcagaggctaattgttactttttatgttttttatttgataaccaatgttatacttgttatgaatgtgctagttaggaagaaaagtgaaagagctgtctaatttattctactcatcttccctatttggtggttggaatgaattttggcattattttaaataggaaagctagaaatcgtagttttattcattccatgacactgtatgtcaagcaccaattttttttaaagtttatgaaaatttgggatccaatgacttttgccattgagtaggtaagcactgctgtagaatggctccttttggcagaagataatagctttcaaggcaagaattataatcatttaagctgtagaattttagattactatattgtttcatttcaagagggaatgttagggtagaaagaaatggtcaaaatgatatagatagtgcaaccctcccaacttctgcacaatgtgtgtgtatatatatttatatacacacaaggtttttatttgtcaagtatacctcactagagccaaatatacaatttaactttaacgattatataatttttatttgtcaagtataccttattaacactgaaaaaacaaactaacccccaaacaaaggcaaaagaaaccagaacaatttgtacaccaaaaacaactaaggctcagagtaattattgaattcatcggttgatcattttttatggaatatcctgggtctgcctctcttggaagtgctgtgttgggtgtgaggaatgaggtggtgaaatgatttgcccatggagacatatgaagttacagcagagccagaactacaaagcacgactttgtttcttgagggtattaatttataagaaatttccaggcttgatttttctaatttccccaccttgattttttataggtatatcctataatgggttaagagggtttccaatagatgtttatgcaaggtttgtgagttttaaaatgattggttatatttatgctgtcaaacctagaaaatttgattaaaataatatctaatagccatttggttaataagttaaatctttactttctaaaatttcttttttctattgtatagaaaagcacattttgcttttcctgaattacctatgtctaagaaaatcctctgaagaatggagttgtgcgtaagtcctagtactgggacacataattcatgtcccttttactgctgtaaatttttagcaagcttttaggttggacaagaaacttagagctccccttatctaagttcatttgacagatgagaaaattgaggcctggggaggttgaattatttgatgaagtttacagagctagtctgaagccaagctggggactagaagtcaaaactttttgaccccaaggtcggtacatttttactttagtgcagagtaaaaactgtaggcagcatttcttatacacataaatgcacacacacacacaccccacacacaatatcctcacactctaaagtgagtctattttcagaagtgtgggttgttagttatgcattgtcttaggttggcttctcccaaagctggtttgagtcaaggattggagtgcaagtagctcacttgggaggtggtcctgggaagcacccgtaggggagtggaggaagtgagataaggaaggaaagtcagccagtacagtgtgtgccgataagcagattccactgtgggcaactgaggctcctctgtgctggggcccttttggagactgggtagaatatgcttccgagttgtcccacaggaaaggcaggcaaggagctgggctatttatttaccagctcctaggtcactgcttgggggcttttcctggaagccttactccttgcacttgtagctgaaaagtctacaaaagagggtttcagttcctagaggaaggctttttaagtgtggttgataactgaatcagtgggaatgtggagggattggcagatcactggcaacttctgtgtgcactcagaaagaattgcaaatgggtgtaagtgcatattctacacacagtcgattccaatatgacaaacaccttgtctttgctctttcctctttccatcatatacttactgctttcatatgggaaggatagagctgagaaataaatattgaaactgataccatcagtgttggatattctgtttgccccttgagagtcactcttcactttctccagcctactctcctgaggctgggcattaattgcaacattggtgagcttccttgccctctggctttagaatgggttcaggcagtgggagcttctagaggagactggagggaggagaactgtgaggtcagttgcttaagagactcccgggtctcttcttgccaacatgctgttggttgactctgtccccctcctagaagccacagtcgaccaggaagatctcttctgtcgttctaatactattcttggtttctgtagctctgtcctcttactccttcaggcctaggacacgtcatattccctgcatggtttccctaatccctgcccacacctggtaaataacctcttattaaactcccttgttgccccgtttgagtgttccatctgtttcctgctgggaccctgaccgaggtaacatctttgaggcatttactctctagacagaatcagatgaaatgaaacagctagagatgttatgaaggtataagataatgaggcataaatcgtactcaagccctaaggatactcagcatgtaggatccattaacaaagaagggttacttactaaagaagatgttttttggaggggtgccttaggttgtaattggtaatctgtttttctcctgctctgtgggaagctctgtttaggtagtgaattgaaaattggattctgccttattaccatgtatgcagttaattataatgtatttaactctataaaatggaaaatttgtaattcaaagaaatagaagggtgaaatggatctatccatctggaaatttcagagatttctctcatgtgtgctaattttagataagtaagtattttccccttaattccttatgtttctcatccctttaatgggttataatttatttttctcaagtttttttttttttttttaagttggtgtgaaaggcatttcaagctgcttagaataaggggctagcaacagaaaacacccattctgtatgtatttacagagggcctcttgtgattcaggcactttgcttaagtaccattaactcaataatgaatgatatttgatcattgctttcaaggaaatcacaatgtagtttggaaaatagaagcccaaacaaatacttgtgacaaatatttttaagtgttataagtatgtagagaattttacgtgcatataaatgaggatttataagtaagtctgtcaagaaaaggcagagaggttagtgaatgacagaaatgtttcatagagcaagtgacattgagttgggtcttgaaggatgataatgaacgtatcaggaagataagaggaggaatggcatgaaggaaggtgtgcatttcctggtggcttgaagattcagtgagaaatatgatttgggagaaatgttggtggcctttggagaaatgcctggacttcggccataggatagaatggtaatctgattcttaatatgcatcatcacttaaaataatatagactaaaaatattagttaaaatatactctaaaaatattaggggagtgtaaacaaaacaaaaataatatctttggggatctttagacatttagtgggaaatatattgctagatatcatatagcacatgttttaaatactgaaaaatgtatgattttaattcaggagcatctcaaaacagggagaagacccactggtatcttctgtcactacacagctttgctcagatttgtgtgcacttatactaaatttgccattacacaattaccttctatcaccatagaattacctaaaatatgaaaatatgatgggttgcttggaaatatggtggattgccttttctatttctaatgattatattagcatccatacttcacaatcacctgtttagcagaacatatctggatacaccaaccataagagatatttgtgccttattccttctaattattctagtccctaaagcttaaggggtcagcagtcttgatgttataaggtgggctaattgatgaagactgtcttatcattacaacagttatagatgcaatgaatttttgagtgctgcttactaagtaggaaactgataaacaagaattccactccagaggcatgagcaaaatggtaactatagtacatgggtattatagtcaaagcctttgtaaatggaaaccccttaaaatggtcatgttaaaggtcattatattgtctagaaacttgaggtctcatgaagtacagggagaggaacaaagtccagtcaggtatcatggaactattaatagaatgccaacgtccagaattaagcttatactccctgtcatgcagagaatgtcttcttgtctatctgttttattctttccttatcttgtttgctaaccatgttctatctatattctgttttagttatctcttgctttttaacaaaccactccaaaacttactggcttaaaacaaccaccaccatttagtgcctttcatgagtctgggtggtaactgggctcagctgggcagttcttctgtttcatgtggtgttggctggggctcaaattctctgggggttcatatgagctggaatgctcaagaggactcactcacatggttagtagttgatgtgtttattggatgggagttcagctaggatgccagctggaacatctcagttctgttccatgtagtttctttccatgtggcttgggcttctcacagtgagggagctggcttccaagagggagcttatagatgtgcaaaagtggaagttgccagttcccttaagtcaagggctcagaagtcctgggtgaccactcccagtgcattctgtcaaagcagtcacagggccagcttccaggagagaggaaatagacttgacttcccagcaggaggagtgacaaaccatttaaaaccacattttttttttgcagaaggcccaacatgttccacgtgtcaccagccaccactattcacggaaactttcataagtgttcgtcatgaattgcctatagcctctgtgtctcttagttcaaatgctcccaagggacattcatattggttgctgaccatccagtcacctgtggttgacagggccaagtcttgtgctattaaagattttctttgaaggggctgaggtgggattagtgctctgaagattatttgagagaatgctctgtgcctggccgttcctctgaggcttgagataacttttctttccatggtccagagagctctgcctgacacttgccttctaactttttctggagtaattctctccctcatttttcagctttgcttttttgttttaagtttgtctaatatgcgtctttcctttctgctctgtgtccctgagacaagaaggctgtctcctctctcccggtccctatctgtcagctaacttctaacctgctcttcagatctcagctcaaatatcacttcctgaggggagcatggaacaccctggattaagccacatcccctgtccgtctccttttccctcatcttgctatcacactttgtaaccttataccagtgtggctacttgattatgatctgcctcccactgaaggctctagaaggcagaggaatgtgtctgtcttcctcagggctgcagtggccatgcattgctcctgttaggtactgataagtgcttgctatttgcatgatttaaaaattggaagttgagatggtttggtcatttgtcccttccaaatctcaagttgaaatatgatcccgaatgttggagggggggcctggtgggaggtatttgggtcatgggagcagatcgctcatgactgtctcggtgccctccccgtagtaatgagtgagttcttgttctattaattcacgtgagagctggtggtttaaaagagcctggcatctctcttgctccctctcttcccatgtgatatgcctgctcccccttcgccttccaccatgagtaaaagcttcctgagacctcaccagaagctggtgccatgtttatacagcctgcggaaccgtgaactaagtaaaccatctttctttataaattactctgtctcaggttttcctttatagcaatgcaaaatggactaacacagaggtagttgccctgaagaagaaaggaccaaggggagagaatatttatcttgatgaaagaagttaagactagcctcgtttcagggaatataaggacatagtttattggggactgccgctcatccccattggtgataccatgtgaatcagtgaagtcctattgttaagggtagaggctgcatgttagtttgaaatgtagcaagagttcctgcccagagatggtccataagtgcctgattaaaagccaactttttcttttctttatgcttctaccaccatggggccctaaatctgtactcagagatctcagtgatggctgaactttgtgaccattgggccagaactactcattccattcctatttgttctcccatgaagccagtatcttgtttggctgcaagccaaaaagattggttagattacagcttgggatatgacggatgcacctctgagcataatctccatgagataaccctaaccaaaactttttgtccagttcttctgtggcatgctatttatctaaaaagaaagttagtaagttagtaaaagaatcaaaatgccagatgggaaacataaagatggagaaggaaataactgagattttgttttatttaaagattctacactctttgcatgctaggatttttcaatccccacttttagattgagataaagatgggggcaatcttgtttaagttcacttaatttccctgaaataatttaatgctgtaaatatgtactgaacactccatatgtatctccgtggagggtgtaaagacacatacaagttggtatataatcttgaaatttatacctacccaggaattatggcatgcgtatatgacatgaggtcccagtgcaacaatcagataagaagggaataataggaattaaatgggggatggagtagtcaggagtgtttttatagaaaggctagacattgagctgaatctccatggatgagtagatttaggaaaagttgcctagaaagtagagggagagggcattctaggctgtgaaagccccatgtctgaaagttaaagtgtgagaaggagcaggaatgccctttcacacaccaaaggcagtgaaggtatacagggtaggggtgggaggttagggagtggagggctatggcaagccactgagtgagatccttggaggccaggtgcagaggtggaatgcttgcaagcagaggaagtcatatcataaaacctgtgatttggaacattatttcctttgcagttggtgaggtagttttgatgaggaagaggctggagccagagacacctcctgggagatgttgtggtcagcaccacaagggtggtgatagaaattaagagagagggaagtgcacaaaatgggttcagaggaagaatgggtggattttcatgtctggattcatagtgaggaatacaaagaaggaagaaataaagggatcttgaatctgggaaaattatttccatgatcaccagtacaaagattggaaatggatggtcacgccaaggttgtgtggaccagaggaatggaatagcttataagcaatgttaaataactgtgggttggttgaaagataaaggctggaggtgcaaatgagtgcatcattagatgctgttggattaaataaatccaatgaacacaaacttgggagttttactaggcattttaagcagggaagtgaaaaaagaatgtcccatatcttcagatactgacatctaattcaacagtaaattatgttgttctacattcacaacatatcccaaatttaagcagtttgtattgctggtatcactaccttctggtccagtcatcacccttcttcacctggattctgcagtagccttggagcttgtctgttcctgcttgagcccttgcccatctgcagtctgttctcaacacagcagcccaaatgatgctctgaaatagatatcagatcacgttgccctgctcctagtctaaatggtttcccacctcattcagagagtaagccaaagcactcacaagggccccaagggcctggcacgatcccttcctcttaatctctgacttcatctgttactaccttctcctttgttcactccatgttggcttaccttgccaactgcttttccttacacacactgggcatggctgccccagggcctttgcacgttctccctctgcctggaaacttctttacaatatctgcaggacttgttcctcacctccttcaaatctttgccaattggggcctttcttttagtgttgccatccctgtgacttgtacctgtccctttccttactttagtctttttcctccataacctttagtgtcttctaatatctagaccattggctgactcgtttgttgtccatctccctctttaaaattgaagttccatgacagcagagatttctgtctgtatcatgcatggacatcttcaatgcctagaacagtgcaggtacttagtagtaaacatttgttgagtgaatgaaacaaatgctgttagaaacttctttttgagtggaattttgatttccttgagatcagctgtcaataatttctatctttatattcaggcatagtcagtgctcagtaaatgttgaataagcaaatagaacctgaaatataaaatcctaacatttcacattagctagttccagaaagtttcagtactaaatgtaacatttaaaaaacggtggaggggagggatggtggaaggatagttttggtgcatttagcttagcctccactttcgacttcagaattcacattgcagtttggcaattctttcattattactatgattattaattggatgctatttaaaaatttggcttttaaactctcagctgatgttttaggagattatactatacagggtacagaaattgctggggctgactgtaactattcatggccaattaaggaacagcattggcaagaaatgcagggtggatacacttgtgctttgtgggaatcctggtggctatggcttcatagtatcaggggactagcttgctgggcttccttctgcaaaagggatcttaatttggttacctggtggatgcttttataaatgagaagaataaacagtcttgagggacttaactttgttggagagttaaagggagaaagaaaagaacaaagtgaagaaattactctttatttgggagcatttccttgagaagtctttctgaagtttgcttttagttttatttggtatcacttttatcttttcccaggggatgcagatgtgttttgaaataacgcatgcagaaaaaacaagctgtaggaggcagaaataaattcttgaaagtttagtaagtttctgaaggacagaactgcttggagaagctgggctgtaccacatctttaaggttgatgtctgggagaaccaactactgtgtttcctggtatgaccattgatgtgtttgttgatagatacaactaatggctaggttcttgcttgtacttttatgtgggactttttaaaagagttcaaacaatagggaaatatgacacaaaggaacctgaaaaacataagcagcagattacacctttgcttaactttaaggttaaaacaatccatagaaaattgttttggatttttctagctagtgaaaatactatacagccctttgcagatatagtatctaaggggtttaaagaaagttaaaggctggtgtggtggctcaggagtccaaggctggaggattgcttaagcccaggagttcaagaccagcttgagcaacaaaatgagacctaatctctacaaaagaaaaaaagaaaagaagaagaagaaagaaggaggaggaggagggggaaggagggggaggaggggaaggaggggaagaaggggaagaaggggaaggaggggaaggaggggaaggaggggaaggaggggaaggaggggaatgagggggaggaggggtaggaggagaaggagaaggaagttcaaataaaattaagtcccagagaacaaggccatacacatacgcagccaaaagatcattcatgtaacattgcctaagacttctccatggtgtcagttaggaggatgtttaaaatcagtggcagagctattttcctagctctgcctaaaagtgccggaggtatattgtgttttcagtctgggatccaaagccatgtgagaagaaacatcagagatgaaggcttttttggttttaaaccatcttagctgtgtttgcactcatttctgtcctcattaaagaggacaactggggtaactgagatagtgaaatgtatccaaggtgaaagtgagtgaaaacaaaaatatttctccagtatgtttttgtgatgagaagcaggaaatctgaaccactgagctcttaagaaagtccttcactgcacctttgtttcctgtgtcaaagaggccacattcattacatagcacaattcttggagtgaatccttcactctcaacaaatgagttaaaatgtttttctctaaaaaataaaagatgcatcttcagcaaattttatttttattaggaaaagccactactgcatcctacttttattctgggtgtgttttatatttttgacaagtgctctcacatcaaaaaaatgtgtctacattaattcaaaattcataatgatcactcttatcctgctgatacaattatcaaagttcttttttttttttggtcttctttcccctgctgttgcctagtgtttgtaattatcttttcttgaggttgggcaggggagaggatagggagagaatgttcagcaaaaatcagtcatatatttagtgtggcttcccattcgttcatttcatcttccatctatccatttatctttccattcacgcacccaaccatgcaatattcattgatcatctgtgagccacctaaattggaatagcaaggatctctcctatcaaagagtctagaataaatgccaggcatttacagtgggaaaatgttaatatcaggtaaattctgtcttggggagaggtcttgtgacctgtttttgggggttttagggaaagcttccaggaagcagtactgtctcaactgatacataaagggcaaattgaagttagctggaagaactgcatgtttgggctagagtgtggttaagcaatgaggaagaatttccagcagaagaaactccatgttctagaggtcatattttatgtgagggttgtatttctaaagttcttgcaaatttggaactcccatgattcaaaataattctgtcaaaagatggtggatattttcatttaccagctaacatggccctgtggccactctgtaaacagagtttagagtttcctctgccccagccagcatcaaaactacaattcttgaagaattgtttcggtgggggtgcctacatagatccaaattaatgtgagacaatattagtgcttttgtatcaccttatttcaaagctgcatgattcaggttcacctcaaatatgaccaaactctggagtttcagagcagtagctcatggcccatttgatggtattaaaagtagatcaggatggatagcatgtacacacaagactaggggtgagggagaaaggagataaaatggataaggaatcagggaccaggtcagtgaaggcttgtaaactgtgttaaaaggtaaaatagtcacattaacattttaaagaatttattcgtgtagatagtaattcatgaattgggcagcatcaggtagtaagtggttcagggctccgctgaaagggcacaaggggaacatttttataaggtgttctaggaagcaagacaaaagtatttggttaaagtggaaagtccctagttagaggttaattggtagtttctgactctttacatggtattttgactcacattgattaggttttggtttacttacttaggaacccaaggtgccggagccatctcagcctgatggcttctcagttagtttttaaaagcaattataataagaggatggcaatggggagcctctgaagaatgctgaggaaggaattggcgaggtcagcattatgcttttgtttaagtgtaaatagaagagagctgaaattagaccatatgtggatttcagatatttttggaacatttatcttttatttcttattaaactttgcttataaacaatgtaagcttttgtgatatcaaagtcctcctcttaaggtgttttgttaatttgcttttgaagagtccactaatcatcttgtgagagaaaataaaagacgtggcctgattggcaaaaagattggatagaggttcaacccagaattggggtctaaggctaggggagaatccgattagggaatcatacttggaggtctatggtaaaataggttgtgggaaatatgggttagacaaagttaaatagacttctttattgtggggcttctagatccttaaagacattaatgtatgttaaggtgcataggatgtcatcaacttgtttcacaactaaggaacctttgttccaaaagtagtcattacagtctggctaaggactagtattccaaggaatatgtatccgtttccttttgccacaataatgctgcataataagcaaccacaaaactgcagtggaatagaataacatatatgtatttagcctgtaagtttcggggggttcagctgctcaatgcttgactgatttcagctgatctcattcatgtgtctgtgctcagctatgggttgggcaggcagcgctgggttagttcatatgtctaggggctcagctagctgttagctgacctagggtggcatagctaacatctatgctagatcagggtgactcatccctgctaaatatgtgtctcatcctaagatactagacctagcatatactcctggctatggcagaggagcaagaatgagaacaaactcagttgtgcaagcacttttcaagcctttctttgcatcatgtgtgctaatatttccattggccaaaggaagtcacacagccaattctagagtgagaatggcaccacaaagttacgtagccgagactgtggttacagggagggagaattgtgctctttttgcagtcagactatcctagatcccaacttagaaattgcaggatgagattacagtcaattgagcaaggaatgaggtcagacttttctccatgccatggccacaggactgtacttttgatactgataagcagcctcacaaatagatgtctgagccatgtcaaggaagagagagttcatctgggtctgcacaggtctttattgtttttctatggaattatttcattgaaggctgaaaggattgtggacatcatctagttctagttgcatcgtgttggcagtcgtgaaggagacagtcccagagaggttaattgggctccttcaatccaaacagctatctagaagcaaatctgggccttgaacccagattctcaagccaattgagttttaattacctcaaagaagctttgttgtggggtggaagggactgaaatgtatttgcaatctttatataggaacaaatcacattcctcctggaggaaatgaaatataaatgatttttgaaataggaagaatagagagtagtcatgccttgttagatgtctcacaaagggcaaagggtaaggatagttaagcattgagtgattactgaaatactgtggctggagatccttggtaatagagtttcgttttcagatttttttttctcctgtctcttccctcgccccaagaatttctcctgcatcagggaagtcaacagaggacttctgagcggagagtaagaatttgtgttctagctccttctttatcaaacagaagatacaattgtgaaggcagacccagccttctagaatagctggcacattaacacctaacttacctgacattggtagggaacaatctgtgctacataagtaaaattttgataatgaaatcctaaccatttagcactgtcaaagtagctgttttcgtgatggaaatatttctggtccaacagatgtgtttccctgatttaataaacagaataattgaaacttccagcctcatccttttagacatcagttattgaactgtgcagtaatatagaaacatgccttgtaaagagccatgtaagtgtaaggtgttgttattgtttgcttgggtttctggagtatgtgggccacttggctttagacagatctgctttctaaattcttgtattccttgtttgttttcagagggttcccttgccctctggcctccaggtaggtgtagccaacaggaagcactggtggaaaactggagggccagaagagagagaggtcagggtgcctttctctgcctctctgctttctttggtatctctaggaacacatgtgtctcttccatgtgtctcttccaatcagctctcaccagactccccttttctccacagcagcctgatctccacggctgttgccctggtctctgtcagttggctctagcctctaggctctgataacgtcacatccttccattatcccacctgttagggaagatagcagctctcctcagttgctagtctctgggctgcttcactgtccctctgtggtctgtcagtcattctcacatctgtaacaagtcacctgatttgaaagacctagagtagtttctgtgttctggttgactttgactaataacgatttattgaatttgccttctcttgcaacccttacttccctcctgatttgcttcttgcaacgtactgtgcaggtgacatccacgttatgcagtttatttcattggacataacaatggaaactcttttaagcaatagagcacagtggttttgagcctgcgctctggtgttagaatgtttgcatcgtagtcctggctatgctactcattggctatgtgactctgggcaagtttcttaacctgagactgactttttaatctaaaaaaatgaaagtaatttcagtacctaagttgtctcaatatgagtttcctgggaaacaaactcccaactggaggttggtgtgcagaggtttgtttattctcaaatactcttcagattaacatctgtggaggggaaaggacggattcaggactgggcagagggagaagttgaactgcagtgcaatcttaacaagagccttagttaaccctctgaagcaggttgggcgcttattcactgatgttgaccattggaggcagttgaccgtgaatggaacagcttcctccagctgagggaattttccagagaggactgacagttgagggcattctgcctgcatcactcatagtagcaaggaatcaattcttcagtcctgaagcagtgtctgggcgtcacatcacagtgtccatgacctatatccaggtgtgtaatgtgaaagataaatacagtgattaaaccataagaaatgccttgctaggtgcgtaccacttggtgaatgctcaacactattagttaacattattgatgaattaaatacagaagtttcagttagtggactttatgatgtctagtgtagctattctgagagttttgactgatttcttctccataacccagtcctaaagagttgaggaaaagcagagtaagtggtctgggataaatagggttccatgatttgtatacatatactgtcatgcacatttgtactttcctatgacttttaatgtggtgtctttaaatatggcttacccataggttcttgtatctttattccttaaggtattcaaggtatttagcatcaaatttggtacaaatcaatgcagcttccattttttgaatacttactatgtagccatggtgctaaacatgcatcgtctcgtcagttctcaggatgactctaaggtgctgagattcctagtttagaaggaggcctgaggtcagtgaagttaagtgacctgccccaggtcacccagccaagaagtggcagagaagttctcctgccagggctgccagattcactgcgagcctaggcttttcactacacatttggacgatttaagcagcagtaggggaaaccttctcctccgaaaataactctagcaaagtgtaggtgttgttttggtagaaacatttcagctgttgccataaaaatcttcccccaaatggctttgtgagagcaaagctgtgcaggctctgcttgtgtttatgatgggagccttatggctcagccacaacacaaatgatttgtttttctggccttgttggcaaagtgatttaatttctgggtttccctgaggaaacaatctaaacaaatacagtaggccctccatatctgccagttctgcatccatggattcaactaagctcggatagaaaatattcaaaaaatttaacaatacaacaataaaaatagtataaataaaaacagcataacaaatatttatgtagcatttacattgtattgggtattataagtactccagtgatggtttcaagtatatgggagaacgtgcataggttatatacaaatattatgccattttatataagggacttgagcatctgtgagttttggtacctgtgggggatcctggaaccattcccttacagatactgagggatggctgatatggtttggctatgtccccatccaaatctcaactaaattttatcacccagaattcccacatgtggtgggagggacccagggggaggtaattaaatcatgggggttggtctttgctgtgttattctcatggtagtgaataagtctcatgaaatctgatgggtttatcaggggtttccacttttgcttcttcctcattttctcttgctgctgccatgttagaagtgcctttcagcctcccgccatgattctgaggcctccccagccatgtggaactgtaagtccaattaaacctttttttcttcccggtcttggatatgtctttatcagcagtgtgaaaacaaactaatacagtaaattggtaccagtagagtggggcgttgctgaaaagatacccgaaaatatggaagtgactttggaactgggtaacaggcagagattggaacagtttgaagggctcagaagaagataggaaaatgtgggaaagtttggaacttcctagagacttgttgaatggctttgcccaaaatgctgatagtgatatagacaataaaatccaggctgaggtgatctcagttggagatgaggaacttgttgggaactggagcaaaggtgactcttattatgttttggcaaagagaatggcagcattttgcccctgccttagagatctgtggaactttaaacttgagagagataatatacggtatctggtggaagaaatttccaagcagctcagcattcaagaggtgacttggatgctgttaaaggctttcagttttataagggaagcagagcataaaagtttggaaaatttgcaaactgactgtgacagaaaagaaaaacccattttctggggagaaattcaagctggctacagaaatttgcataagtagcaaggagcctaatgttaatccccaagaccatggagaaaatgtctccaggccatatcagagaccttcacagcagcccttcccatcacagacccagaggtctaggaggaaaaaatgatttcatgggccgggcccagtgtccctgtgtggtgtacagcctagggacatagtgccttgtgtccaagctgctccagccatggctgaaaggggctaacatagagcttgggctgtggcttcaaagtgtagaagccctaagccttggcagcttccatgttgtgttgagcctgtgggtgcacagaagtcaagcactgaggtttgggaaacttcacctagatttcagaagatgtacggaaatgcctgtatgcccaggcaaaagtttgctgcaggggcggggaacttcatggagaacttctgctagggcatcgtggaagggaatggggtcagagtcctcacacagataccctactggggcactgcctagtggagttgtgggaagaaggccactatcctccagaccccaaaatggtagacctactgacagcttgcaccatgtgcctggaaaagctgcaaacaaacactcaatgccagcccatgaaagcatctgggagggaggctgtaccctgcaaagccgtaggggtggagctgcccaagaccatgggaacatatctcttgtatcaatgtgacctgggtgtgagacctggagtcaaaggagatcattttggagctttaacatttgacagctctgctggatttcagacttgtatcggccctgtaaccccttcgttttggccaatgcctcctatttggaacagctgtatttacccaatacttgtaccctcactatctaggaagtaactagcttgcttttgattttacaggctcataggcagaagtgacttgccttatctcagatgagactttgaactgtggactttgggttgatgctgaaatgagttaagactttggggggctgttgggaaggcatgattgggtttgaaatgtaaggacatgtgatttggaggggccaagggtggaatgattttgtttgcctgtgtccccatccaaaactcaacttgaattgtgtctcccagaattcccatgtcttgtgggagtgtcccagggggaggtaattaaatcatgggggttggtctttgccgtgttattctcttgatagtgaatacatcttgagatctgatgggtttatcaggggttcccactcttgcttcttcctcattttctcttgctgctgccatgtaagaagtgcctttcaacctcccgccatgattctgaggcctccctaaccatgtggaactgtaagtccaattaaacctttttttcttcccggtctcggatatgtctttatcatcagcatgaaaacaaactaatacaatggctttaaatttatttgtaattggatgtttaaagaggagccacaagggaaagtcaaagtgggtggcccaggtacgttttcattcagtgagtgatacgataaggggaggaataaggtgcataggtgaattcactcagtgttctttcttcctagtatttggctctccattcttcatcaggaaatgattattataatcaaccaaaattttgcaaacaaggtgggcatttaggtatgtaggtgttcagcattatttttggagaacagagcaaatccggtcattatttctttttattgaaataaaagtaatgactccttttctgtaggaaaaagtaatttttcaaaataggctacatggtactgatgagaagttaggaagctgcatgatattccagtcagatcaggatcccagactcccatctttctggtccactatcttgatctttccattttccattggtcacttgggcaaagttcggtttaggccatcaggtccacagtgcacatgtgcagcgaggagggattagagagaagaaaggaatccttttagttgaggcatctcctgccatttttgtcatcttactcttaagttccatataacactttaaaaaaatttttcttgaccaatatttggtcacatggtcacatctcagtgcaggagagcctgggaaatgtagtcttgttttgggcaactgcctgaataaaattggggctctcttactgatgatggagaggagaatgactattgagttataactggcaatttctgctacatttgggattggaatactaatgccacaaccaaaagttttgaaatgatggagttaacattaaaaggtgaattttgttggtgtgtgtttctctaataatgctcagtcgtctgtggctggtgtgcataatgaacatacacagctcctaaatctgcttcactctggccccctttcctgggggaaacagtgtttggagaagcacactttatgtcattcaacagatattgatcagctaccatataccatgcactgtaccagatcttagcagagtctaggagctacaacattttccacatttatttgaccacctctcccacaaccctctccctccctccctcctttcctttccctccctcctttcctttccctccctcctttcctttccctctttcctttcctttcttttcctttcctttcctttccctcccttctttccttcctttttccctccctctctccctcccttccttccttctttccttccctccttccctccttccctccttccttccttccttccttccttccttccttccttccttccttccttccttccttccttctgcttttggggtacaagtggtttttggttacatggatgaattatgtagtggtgaattctgagattttagtgcacctatcacacaagcagtgtacattgtacttaataggtagttttttgcccctggcccccctcccacccttccccttctgagtctgtaaagtccattatatcactctctatgcctttgcttacttatagcttagctccctcttataagtgagaacatgtggtttttgattttccactcctgtgttacttgatttagaataatgtctccagcgccatccaagttgctgcaaaagacattattttgttccttttaatggctgaatagtattccatggtgtatatgtaccacattttctttatccattcattagttgatgggcacttaggttggttccacatctttgcaattgtgaattgtgaagactcaattctttgttgaaaagagctgcaaagtcactttacaaagggtgtggaaagctgaagaacttgagattcagggcctttttagctgtcaatctactgcagtgtcccagggaggaaaagcttaatttgtatggatgcttgattctttctgtaccttttctttctctgtttccacaaactcacccagttaaaatttctgttcattgaacacgatggcagctaggttgatgggattaaatcagttgtctttacctgcctcagtgtgttgggatcctcaaagctcagtgaaaccaccagctggtgaataagacttctgagtgggtgggtttcctgatctcacttgatgttttttgggacaatagtgatgccccatttcctttgtgctctgtagctaaactcccagggagtaagacatgtggcataaacataacctcatagactatacctacatcgtgcccactttagctctttctcacttttttttgtgtgtgcctccagaacacacaagacaagtaaatacagtatggacaataagttacgagtgaggagagagtgttttgagacagccaatagcaaacatcgtggagaacttctctttataggtcaatatccgttgtcttagtctgttaaattcttccagtcatagactgtgcaatgtatgcataagctatcaacacttaaaaaattatgatggtcactaagaagaccttttttctgtacactttcagtgcttcttcagtcatctgccatgggtacttctgttcttcatctccagattgtttctggaagtcctgtgggcagctctttaacactggaaacatgcagtctcctcatccataaaatgggcaatacctctctcaatgtattcgagaagtcacgtacaggtcacatatgaccattactcataatatgtaacactgacatggcactaactatgtgctaggtacagttctcaacaggcttatgaggtaagtgttattacagtcccattctgagatgatggaattgaggcacagaaaggttaagtaacatgccagtgttgcacagacctgaggtttgcacccaggtagcctagcactgcagacctgtttcatattcatgctgaaggactaactgcctctgtaggtgtgagtactgtacatggaaaagttagagaagtaaaggtctaattttgacagaattgagaggggagggggcattgacttaggttttagaaattaacttagactcttagtacataggttgctgtggcaatttacatagctatttctttcaggtacatttgacattcaaaagcaatcagatcgtattatctgttctttgagggattactgggctctgtgaatcttgaaggttacatttgcaatcagcattaattttattgttaaccattttccttcatgttggttacagggttgcctccctccctccctccctccctccctccctcccttccttccttccttccttccttccttctttccctctttgggctttagtggagcttataactagttgaactagatggatcaactcaagttgattattcaggaggccttattatcccccagagagcagacacggagcttggctggacctcacggatcactagtccatgtcactgcacaatgttcttcctctgttcttcgctattttagtccaaaatgcctgctaaatggagtggagtgaagaaggcacacaatgttaatatgaagtaacttccccagtgcattttctgattcatcaagatgctcacattaagctacatgaacaaatggaggaattcccctggaagccaaggacagagaaaaatcatatgaaaaaaaaaaaaagataaataagagataccaacttgccttttatattcaagcagattttcaaaaagtctcattgcatggaaagtggctataatttaaacaaaaagtcatttactgtgctaacattcatgaagatagcaattcttgggatgctgcatgaattgggcagaatgttaaaatgctgaaggaaccttgtgtctggtttaaatacattttggttggtgtcatataggtaaggaatggcagcctcatttttaactcttagtaattaaaaattggaacctttaagtagggagagaaggaaactatagtgtggaattcaagatagtgcacttgattttctcattcctggggagtcacatgggtttatgagactcctcaattgtttgacatttcatttaaaaaataaaacaacaaaatgagctttccctttcatctatacaagagtccatgaagaagcctccttctcttatgttgtaattcacagaccaaagagttgagtttgagtatataattactcatctagatatatttacaaaatactagtaattttactggtagtagctcatttatgctgggtgtgatggtgcgtggtcctagctatttgggagactgtggctaaggagcctcctgagcccaagagtttgaggctgcagtgagctgtgatcatgccatttcactctagcctgggcaacagagtgagaccctatctcaaacaagcaaaactaatttatgttgaattcttcctatatgtcagctagcctttcggccctttacctgttccaccatttatcttcacgataaccctttgaagtaggtactatccttgtctccattttacagatgagggaaccaaggcacaaggattctaagtaatttgcccaaagtcacacggcaaggaagtttcaaagctaggattcaaacccaggctattataatcactacactacaagtattttcaaacagtgtttcccaatatcagtcatacagataccatctgcatgctttttgccatagttgtattttacttctattattatttaatgtttctcactttttttttttgagacagagtcttgctctgttgcccaagctgtagtgtggtgacatgatctcagctcactgtagcctccaccttccgggttcaagtgatcctcctccatcagcctcccaagtagctgagactatgggcaagtgtctccacacctggctaattttttttttttttttaatagatttgggattttaccatgctggccaggcctgtctcaaactcctgacctcatgtaatccaccctccttggcctcccaaagtgctgggattacaggcgtgagccactgcacctggccactctcacgtttttttttttttttaaccgtacaaaacagtatttaaaagagaaaccttacacctctatcttaaatggaaaactattatgtgtgcaaatagtagatacccaataaaaactaaacagtgaaaaccatttagtgttattcaatcctaagtagatgccactggctgccaaaaaccctgcgtcagaggacgtcctttctttattgagacagagagattttaaaggcatgctctatagggttgagactatttgatgcaatcagttcagagtcagggattaaatttttctactaggagagtctgtcttattccatactgaatttgtaaatcatctaaaatcaccttgtagtttattagtgttaatggctcctacactctgagaatcacttgtctaaaatacaaagatgttgtactgtttttagaattatcttagggaaagtgaagcagaaagatgtttaaatgaattcaggcctgtattattaagccaatccaagtaaagctattatctgaatgattagccctaaagtcccttaccactttatctggtctctagaaggccagtttaggttgctttgtgggaagatgtatgggtgatttttatccaagttattatctaagaaggtgtggttactcctgaattttaaatcagactacttagaaaatggccttaaattgatcctttttttatccttgacagatacttattggttgaaacatcagagagctttaagctttctcaagtacatgttggagaccattgggactagtgtccctttgttaccaagaggacagtgtatgatatgcatgattaacataggattattatatattgattatagtgcaaaaagtaaaaggtgtcttttcatctttgagtttaaaataaagagatttagcatgtttttgtgtgataagagggatcttcttaattcccaagacctctttaaaagcaattcatgaacatacttaagactcatcagttgaacaataagttaatctgcatctgaaggttttgctgattatctgatcatataatttccctgtattctgattatgtttttctgatgccttttacagtatatgaattcttaatcaagatgattccgttagcagtagctcctctatacacagtgagcccaggagggcagagagcttggcttgatgaaagtttttacagacataaagatggtgaatgaaactggcttcatcttgctcagtatctattttgaaatattatatttaaatattaaacactaatattaaatattatggttccaaagtcatagcaagatattaactgtggcttgcatggatggtgaaattattacaatggtcttttaccgttcagtgtgctcgtgaacttcagaaggcttctgatagattttaggcctgtttagttgcccatagttagggagaagaggtggccatactacaggaagacaagctgaacgtccctccacactaaagctgccacaggacctgtgtcgccaaggagctgctgctcagttctagccaggacagcagggtgagctggatccaactccgtttggtggcataatagagagcacctttatgtgcaggtttcatctgttgagtagagaattgtggctgggagtgtggggggtgggtctctaacatttgctgtggcttatttagatgtagcccttaattgtcctgccctgccctgggctaggttttggaaaccagagctcgttagaagtgtgtcctggcttggggaaaagatgaaagaagtccaggatagttaggtcctcaaggaagtggaccatgtctgtttattcatccgtatatacctggcacctgacacagcgccgggagcatggtgggcactcagtagatacgtgttgagtaaatgaacgcacagagttaaattgggcagctgatgtttttggtattttataatttttgcttggtgacaggaaaccacaacaaaatatgtgcctgtgtgtgtgcatgcatgttttatagcttcctgaagaaatagaatcaatttcagtttttgcaactaaaaaagaatgcagaaagtgagcttggagtgaggagctgctttcttataatgacaaagaatagttacaagctgttttctagaccgaggtaatggtggaggtaacttctgctcctttgttctgtgtatctttgtgagaagggagagcctgcaagggcatagaaaagggagaagccttgtggaaaacagagaggtttcttctggacttcgggtttggaggattagcagaacatactagaaaataaggttctttctcttgggaaattactcatgctggcagcctgaaatagcatgaaaaggacttttattagtggcaggtcttcagatagtttgctagagaggagaagtgcttccaagttgagtgaaagcagaaagcgagccagagttgcattagcaagtgattcaaacaatgaaatctcaagcagcaaggcagctgacatctcagcacttactctgtgctgacagataaatataaattatttttgagacagtggttatttgagatatgtaaaagtttttagatagatatcattatcccaattttacaaatcaggaaacaagtttataaggtttgtaattagtccaatgccccataaacagctggtacataatggggctagggtttgaacgcagcttatttgatttgaaaacctaggttctttccacatgttaagtaatcccttgcctttttgagaactgcattttatagttagcatttatcctaagtggttcatggtttttactaattttaaagggaaagttctagttttatagggaagataacgttggcttgtgaactcagtgagaagatggacagtagagaggttaacttgtccaaaatcaaatcgctctgatgccaacccaggtttgttggagtgcaatccgctgctcttacctaccatgttgtgctgtctggctgattttaccacccaggagctgttgattaccagtgtttggttaatcataggaaagtctggcttgcagccattgccagtgcacaaatcatgttctgtgaaataaattttattttattgactcgaagagacaaaagtgaagctatgtcttctgaataatacccagcattgcttgtattggactttgtatattttttttcttggagtagaataaagtatgtagacaaaataacttatgaagcatttttattgttctgtggattctgttctaacttgaaaggtaactgctttttcactttttagattctacaaaaaagagtgtttgttacctggtgaatcaaaacagaggttccattctgtgatacgaaaagataattattaataaactaaaattaaataacactaatactattggcagaatacattaatgccgataatcactgatactataatagatgttcaatgcagccagcatgaagagctggaggaacattgatgagaattttaattcatatgatatttaagtttatatcctttatttctttagcatgttctgttttttttgtcaaatcttttagtttcacgattcattagagtggatgacccaggcagatggaattggcagtgtttattagaatgtcataccctgctttaaaataatgttctctgctaatttgtcccttgttccctgaaacaatgagttgactttaccctgagcatcctgggttgtcagctttaaagtcaatcttttgcaaggttgaaaggatcaagggcattattacataattgttttgtctttaatccatagacttttggaggaaaaggaagcaaaatgtggcgatttgtgtatgttttgggtattgggcaagaggaaagagagaagcagaggtatacctgtacctaaaaagttttcttaactgtcacgtcatggtgaattaatatgttggtgctttcttaaactcctcagtaatgagagtcaaaaaacagattcaatatgctattcggagttaatatgggaaaagatgctgtatatttatattaaagggaattggaaaggatggtatttgctctggaaacacagccttcgttcatgtttactagtcctatagtagttacgttcatcaattatgttttgtttcctagaatgtacaacatcctccatgtttttttctttctataatttacatttatattgtgtttttccttttttgtggtaataaactattgtaaatgtgaataataaatatattataccagtgcctcttgtggaggtgcaatattagctcatttaaaaaaaagcctaaaagccttatcttgttctcagtaaaaatgtttatagtcttactttacatattgttctgaaaagctgttttttaaaatgtacagacctttccgggggtatgctggtatacatttaaccactggtggggtggaggtgatttgtatttttaccaatttctggggtttaaatattcttaccatggccaattttaagctagcagttcagcatcactgaacctggggatgggaatagatgcacacagttgtcttttgcaggccttggaagctggctcagccactgattttagtaccaagagattggaaggggagcagtggctagaaggggtagtggagaggcagaaaactaaagaatgtagaaaataataagaaactaactaaattgggagatgggtttctgttaaaggaacttgagtaaacatgtcgactctgttttctgaaactgccgggatgaaaaaaataactaaaagtggggggaaatttttcactaaaagtagagaatggctaaaccccaaatgttaagcctctgaagaatatctgccaaatttggagcaaatctgagcagagtcaaaatatgtgtctcttagagccccagcaggtggattttttgcaaggtcatggccaaaatccctaattgggaacagagaggttgaagccctaggcgggttcctggagaagcagaacttgttcctcttttgatgttttgtttcgtagattatacagtatcctccatgttttttttttcctttctataatttatgtttatattctgttttttcttttttgtggtaataaatttttgtaaatgggaataataaaatattatgcttatagatttattcactttagacagtatctgttgagtcctaaatatgaaaaatttaaaacgtgaacattcatattttcttccatttttccaatctcttgatcatgctatttattattttttacatgatcatgatttatcacatttttattacattctatataccgtaatttgcctccatttcatatttaaataaattacattgcaaacatcagaacaaaagaaaatatcaaaccaggaagcataataaattgaaataatagaattaagatgaaccacctgcttattagaaatcataatgtaaacgagataagttcatttattgaaaggaaactattttgcgtgagtcatccaaaaaagtgattataggcaaacttaaaagtaagcagtggttataattaatacaaaagatgaagggtatttttacttttaactttattccttctgtggtctgaactttttcaataaacttgttttactttaccaattaatttttaaaacatcccagactgtagccattgattataatgagacacagctgcatcgttttcatattaaacagtgactgtttcactgcctgttttttgtcacatggcaggccttcagtaaatggtggctgaaagaacattttctcaagatgttatagtgttattatgatgtgtatctaatagttgccccaatctttggagtcttttttttttatttgcatgcacccttgtgagggaagtgattttattgctgttttacagatgaagaaactggggctcagggaaattaagtgacttgcccaacatcaaaccatctcatgtcttctgaatcattttttaagtaaaatatttttctcatcatatgacagtctcttaaatacaatattttagttatgattctgttgactgattagaatctatataaactgaagacattttaaaattatattaaatattttcttattagaagcattagaagagtataactcagtttagaaagatttcaatctttcaggggcatgattgggaaaaataacttgtgtgaagtagtttgttctttagtagtcaagtggatgaatatatgcagtgttgacttaattatctttgtggagtagctgtgaaccaccagtctattctgtggttctatcctgaaaactgtcttttcaatataaataagagcaatagactgtcaggagatttctggggaggtggagggaactgcaggatgctaggacttgagactgatggaaacgtttgaggtagagtcaggttttacacgtggtttgctggaggtgccatgactcagtttcttcctcttgagtctgcctgtgtaaaagtggttgaaatgtgcacatatgcatgcaaacactattgcatttgggtggtgttttttatggttacttctagcctgcatcagcattttggcttgggtgcccactctgtatgatatattggctgaatgttcatctctgaggtctgacagtcggcttttgagagcaaatggatggccacagtacaggcacgtgcccgctatagcaactgccaaggttcaaaacaaaaagtccagcttctcgagggcacaaaacatgctgtttcttatatgttctagtgtaatgcaaagcatatactaaatatccactaaatacctgtagggtgtgcttccattcgctatactttcatttgggaaagctttataatagtgtgaaatctagtactgatcacactgtaatttttagagatagtagtacaagttgggacagatggggagcctaataatttaatgattttaccaagtgcgttgaaaacttgtcacaatatcagcttggtggattaaaaattggcaaatgaaatctggagtttttggcattttccaaatctttctcacaaaatacaattctctctggatgcctctcaaatacagggtcccatgattaactaaatgtgggaggcacagcataaaatctcttctaacagatttataatgaaaataagcatactaaaaacttggagaaatcctgcagaatagaattctacttacattagtgtggattggccatcctaaaacatcctggaaccttgttttgcagaacattttacattctctgagcattttgggaaatgccaaattttttattgtaacgctgtcaccgatggatgggtaaacctggggctgtttgtgtgtgtgtgtgtgtgtgtgtgtgtgtgtgtgtgtgtgttaccatgttaatttgatgtagaattaaaatcctcttgagttataccaacaggacaaaagtctcaacattttactatctgtgcaaggcagataatctctagatctcattttagacagtagttcttaattatttttctttatatcagtgctacttgtaacttaaaaatttttaaagttttatttcctttcttgaactctgaaggtattataaaggagaaaaacagtaaaagatgccagcccaactggggaggttggaacagagattatgaatatattataaccaagttactacatttcctgaattgtgggcaatcagttgtgcctttctttcagtttatatcctgaattttttgtagacttcagtatagaaaaaacaaagatttgttttaaggaagagttcaggtgtggccttccaattttactcttcctattataaacaaacacccaacctctgatcaggtggctcttcttgttatgtttggggcctcttactcattcccgggcagtgttcctcggcaatatgcctgtgacaagcgtttgctgtatttgttgttcgacttagggtagttgaaagagtctctctcagccactctctctggatattttgttgtggctgtgggcactgtttgcccagcctctcactttgtagcggaggggtgggactctgcgtgaaaggaccagcgttatagtccctggcttctccggctaattcatcccgaggctcctgccccttcccattctggaaggggcgagcttatcctagacctgtgactgcctctgaagttctccacctgcctcaggcgtgctctccagtgcctgtttctgactgagtgaggttgaaatcctactgactccttttcaggtaaaaaagcatactgaaaaatggctttaggaatagcagttaagatttatatagagggggcagttttgttaagtttatggtttctgttgtttgtagagggctatcacggttttattttcatggtccctgaaggtaagcagatatagctgtatttagtgatagaaaatactatattgcttagagaacccaaacttcccatgaaaattgttatatttattattacttttttctttagactttcttataagagagaaattgaagacaaaattgtgccaacaaagtatattagacactgtgattttgtggtaattttggcatcaattagatatttattttaatatctctttttataaaattttcctaaacctaactgtaactcgaatagagttttccataagacatgtataggtatgatttgcttggctggtaggatttcttggtgtgttttatttatcacactccatattttaaaaattaactgtgtgtggggacaggggatatatgggaaatctatgtaccttctgctcagttttgctatgaacataaaactgctctaagaaatgaggtctattaaaaaaaaacagtcccttgataatactttctgtgaatacttaaatataatgtgataaagcacagatgatgttaaactttttttataaggcataaattttaaaaagctaattcatttttctttttcataattagtaatgaaaatatgggacatatttcagtattttgttttgattgccactttttttgttcaaccatattcagatgggtaaaatgattattttcaagtctcttttcctaaataagaagtgagaataaaaatatactttgaacatgaacgcgtacttattcattgtcttggaaagttaatgagccattatgtaaaattcctttctgaaatcagagagtaaaaattaacaacttagaaagttggtttgtgtatttggtaattatgtttctaaaacccattttttcatataatatgcacatgttcatggacagaggagtgatgctgaagtatgaaacttgtacttagtaccgaataattggctttgaatagctttagaaacatatttcatatttgcgtactttattttttcagttaggcacgccttaaacacatgtagttatgaaacaaacggtgaaaccatgactagccacagatatttgagcataaacaatcttaattataatgactgaagtaaacaaagcatgaccattaaaataaacttattttcgacagatttatacatgaataatatgcaacattctatggcaatttttaagggtgcatgaagaactttcacagctgtcttttatagctgaagcagggacagtggcctaagaattcctttgatagttattacctgttggaaaaaaaccactttatgtgctttttacattaaagagcaattacatataaagtgatgcactctccaaagatacagagaatatttccagacacattaaagcatatgaaactttccaaattttcaacacaagttcaactgtgttttatctttatagactctcccggggctttggggtaagttatcttatacagatggaggctagaactgaagcattatagagcaggagaaggtgcttccaggagacaaggtgtgcaaggcttaatgttgcttacctgtttacctgcacctgtttacctgcacctgtcttctctgaaggtgacgctgttgatgaagctgctgttgagaagacccaagtaattgagactcggtctgtgggcttgttatcggatcactccactgttttccacactttaatgtgcgtgtgaatcatttgtgattttgttaactgcatattgtaccacagcaggtgtggggtgatgaggcctgagattctgcattgctaacaggctcccaggtgctgctaatgccaccatttcagggaccacactttgactagcgaggagctacaccaccagataccaaataactgctcaggtcattgtttttcacttaatggacattgtctgtccatagtgggcagtcagtttgcgaagctcatgactgagatgtgattgaggggaatcgactagctggtgacactggccgctttgtggctgatataactgatgatgtgtggcttgttttctctggtagaaatgtgtgggattgtcacctctgctgaacttccacagcagtcttttccaggactcgtcatccttggcagccccaactcctgcctgtcagcccaagcagccaccaattaagaaagcgttcaagctcaacacccacctttcaagctcaagtctccctttgcggttgctacaaccaccaagggctcatcctcttctcctgtctgccctcatgtcctgccaatcaggagccttttaaatgcattgagtttgatttgcatcttgaacctgagtcttctgtggcatcctctgcccaatctggcttgcaggtgctccactttagctccctgtgaatttaaatatagaaactttatttgtgaggagctgcttccttcctctcacttaacacacaattttccaatgtaataatccagttttgggcatttgattttcataaaaactttccatgtctcagcttgtgagatatgtgtcttgagttctcaatgtaaacactttgccagtctgtaattccagcactctgggaggccgaagcaggaagattacttgaggtcaggagtttgagaccagccaggccaacatggtgaaaccccatctcttaaaaaaaaaaaaaaaaattagcccggcgtggtggtgcacacctgtaatcccaactactctggaggctgaggcaggagaatcgcttgaaacgggaggcagaggttgcagtaagctgagaccgtgccactgcgctccagcctgggtgacggagcaagactgtctaataaataaataaataaataaataaataaataaataaatactctgccagggttctagataccatgtgaattgaactcctgaagggaaggaagtgggcagtggggtgttggtgtgatactccaaattcttcagtgattccttcccattgtactttcctccacaacattgtttgtgaaaatttcaaacatatagtaatttgaaagaattttacaatgaacagctgtgtattcacctcctagattctaccatgaacactttattgcctttattatctgtccatccacttatccctctgtctttcactgtcttatttttgatggatttaaaaataaactgcaggcatagtttgtatattccagcatgcttattattaactggagttcaatatttcttatcagttattcatacgaaatttctattcgatgaaatgcacacatccttacttgtacatagcttgaactttcaacaagtggacgcacccagataaatcagtcctggcaagatatagaacattaccaccaccggagaaagttcctgcattccttccccaacctttacgttcttttttgagtctctccaaagaaggatttactgattgcaagtgatctgtggttagtttatttcttcaaaattgtgctttgatcagttttatttcatgcaagttactttcatacttaggaatgcatgttgtacaacactttcttacaaattaatatttagtttgttaggactaatttatttctgacagaactaaagttttaacaagagtagcttagattatctgttttttacttggtacagatgttttccaatgactttattgattcttatcatgttttatgagatggctggtgagataacataaatagagatgcaaagacatggaggtaaaccatgttctgagaggttctttgggctgacacacctggtttctctggatataaagaaaaaaaactcctctttcaggcagctgtttcctacgaagattgtgtttgaggatacagtaacctcatcatttagcctgaaatataagttggttcacactgcttcttcagaaacagaaagctctatccttgtaataatgataattcatgacattccatgtttgtgggcagtagtttcagtcagctttaccttcaggtacctaacaaggtctggggttgatttggatctgccctgatgtgggttcacagagtcggtaaaacctcagctatccagaaagctaattgtctgaattgccagactctcaaaatggcctggaggcagaaagttaaaatgtaccacaatctctttggtcatgaagaagcagtttttgaatatctaacatagcggtagggatatggtcaaaatgaatgagttataccagcaccataaagttgtttaggggctgtaaagtgctcacattgagttctttgacggtaccatgaaactcccatttttggtttgctccttttcacaaatcactacttcagtggaatatgagactcatctctgaaaactcacacagctccttaagctcttattcacaccttgacatagtttttttgtgtgtgtgtgaatatgatttataaacgatgggtttattcaggtattttctgtaagaaatccacattgtataacttggagttacctatcatatggtaggcgctcagaagcttcttttacagtcccctttagaatgctacaaagaaatatgtagtgattttcaaaggtacatcatttagtagacagtttacgtttccttgctcacaaaagaatgcaagagaatattccagtagtttcaaaaagtacagtatgcaatccttagaaccaaactgcacaaatattcagcagctgtctattcaaaaattaaaaccagagaccatattttgttagggctaatgtatagttgtcaaactatagaccagaacaacaagaatctgtatgtgcatatttattctaatcttgttttccaagttacttaatttatagttgcttttctctgagaggaaaggacagaacaagtattgcaaacacttgctacagtcagttttggcaaaaaaataactcagagagccatgttttaagaaaaataaattcaggttataaatttaagcatcattctactgggttgcaacagtatctgagacttctactttgaatatttcatctgatgatgtaattggaggcggcagaagcatattatctgcatttatttgtgcagttgtgtattatgtaagtggagaattgtgggaaataatgactatttcccccctcctcataattttaagcctcaatggaatggaaagaaatatcaatcgatcttccatatttggcagagtgcttgcagaggccactgtctctgcaaacatgataaacctcattttccccttcccctgtcaacttgtcaagaacagaattaacaggaggattatattaaggcaaaataatttggggttttctgttttgtttttgtctttgtttttaaaagttacttccatgtgtctggccatgtttcagtaataatgtttggcactttaataattcctttcatctgcaaagagcaaattgtttttctgaaataatttcattttgtagaatgactccatagagcaggttgaccccatccatgatctagaatataagaattcatcatataacaaaggaccaccatttaatgccagttttagtatgttttcagcttcaactaaaaacttaagattccataataagagagaagtcaccaagccaattccctgttgagtggaatatcttactcattttctacatacatcctacctatccttgaaagttaagcataaaacctcaccttgctgaagctttcctcactgctataagtcaaatccctgtccatctctccctttcctgagtgcatattgcattggcttataaaccttttggtgttactctcctgtgtagataaagactgttaattactctctaattatattttatgtattagtcttcccatgtcttccaatgtaagtcctctttgcagaaacaccatcttaacacttattttgcatttccattcgcatttccttttcttgtttagtgttttggaaaactgtcatttaataaatattgttggccgagtgcctgaatgttaagagaggccactgtctctgcaaacatgataaacctcattttccccttcccctgtcaactcgccctaagaacagaattaacaggaggattatattaaggcaaaataatctggggttttctgttttgtttttgtctttgtttttaaaagttacttccatatgtctggccatgtttcagtaataatgtttggcactttaataattcctgttatctgcaaagagcaaattgtttttctgaaataatttcattttgtagaatgactccatagtgcaggttgaccccatccatgatctagaatataagaaaaatctcactctgaagttcagtttccaaagacttgggaacagatgatgaactatgctttgcttgcagtgcctcctggctgtaaatataggagctctgtcaactgctgaactcttggttggccttgcaaagctttggtgtggtctgtggtctggggtgtagcgttgagccagtaaaaggcattgcattgttttatccatcctgtgtccttagttagatgcatcgcatgattggacctactcaataagaaaataaagagcagtagtcaatgttttgaccatacttttggtcctgcacagtgttactagttgccaactttatgcaaacagatttacctcatctcctgataaattagaagatctggccacatgcagacttgtgttcttcctttagaggagacacacgctctccagttccacccagcatcccaagacatctgaattagtttcctgttgttgctgctgtaacaaactgccgtaaacttagtggcttaaagcacagatttattatcttacacttcttgatgttggtagtcaaataggcctgcaggaccgtgttttttctggaggttctgggggagataatgtattccttgccttgtccagcttcttgaagttgtgcacatcccgtgactatggctgaatccctctgaactctgtttctattgtcacatgtctttctttgatccttcttcctctctctttcatttttaaaggatttttgtgattacattgagcccactcagataatacagtcacctctctatctcaagatccttaatttaatcttgtctgcaaagccccctttgctgtgtaaggtgactattcacaggttccatgttccacaccccaaattcacttccccacttccaccttcagggaagcatctaattccttcaggctgtgacctctacagtgctgaggaactggcactgatttctatttccctggagttggatatttatccaccaaataagatgagaatatttatttaaaaaactgattctcccccttcacaaattaccgtatctaggtatatcttatttttaaatgctatattaaataatcgcacaaaaataaaacaactctcctttatttcttggcttggttttgctgctactgctgctgcttcttgttttgttttgttttgtttttttctcctggagacagggtctcactgttgctgaggctggagttcagtggcgtgatcatggctcacttcagcctccatctcccagcttcaaggaatcctcctccctcagcctccctagtagctaggacaaagggcacgtaaccatgcctagctaattttttttttattttttatttttgtacagacagagtcttactatgttggccaatctggtctcaaactcctgggcttaagaaatcctctacctctacctcccaaagtgctgggattacaggtgtgagccactgcacctggcctattcttcttttttttttttttcttttcaattttacctggcaatattgtatatttcaagccttttttacattgtagttttcttttcatctacatttcctactaattaagatgtttcttccctccttggtcccttgactattaagctctttaaagcctaattattttcccctgggaaattgctgctgctattgctatttgtggttttcttccttgttttccaacttttaatataacttcttgttaatcactagtccttccttcacaattgtcttatctttgtcatctgacactggaaaatgatatacattttgaacttatgactgtcatttatcagcagaacatagtgtaatattcatgtttgctgataagagagtggcaaaattaatgtcagaaatacagaagctacttagtaatctaagaattgagaaaaactcatctatccacaaattatttgaggcaggaacaatttgtccgtctttgtttctaagaatcatgacattttctcttttgacctgtcttattgttattaatactgatggtgtagctagtgaaataaatagatttctttttagttgattcatagatatgccattccagaactatagtaggacataggtccagaagaccgggtatacagcattggttgtcaccatcagcatcagcattacctgggaattgctggaaatgcacgttgtcagaccccaccccagacctactggatcagaagctctggggatggggcccagaaatctatgttttaacaagctctccaggagatgatgaagtgcaatcaagtttaagaaacatcagtgttttgtattgtcacactagggtgctggggagaagggtgaacccttctaggtctcattctctagatcagtttatgcattcatttgtttagcttccagggatgtcatttccaataaactacattctccaaatattttcagttccgataaacagtgcactaaagattctcagttccaataaattgtccaagtaaccttatttcaccatggaaagaataatctgtggattggcatcaggaagaaatagtccttcttagtttaagagtctacccatactgcttaaagcccaagttgtgccaaattaaatacaaatgttatgctggagtgcaccaatttattcctcttaggtccgtgtctcatccataaaattatggcagttccaataagtgatatgatatcaactcactgaaatctttaaaatgaatagacagctcactctatagaaaaaaactctactccctcccctcatctgcctcctgcagagtcattcaaagtaaaccccacatctaccacataatcccatattcatagcaaatcagatcatccctgacattatctccaaatttggtgaaaggtccattgggcctgttaaaatatcttaactttattgaactataatttacacggaatgatatggatccatctttagtgctcattttgcattgcgtgagtcttagcaaatgtgtacaccaccaccacaatcacaatttaggacctttctggcaccccagaaagcttgttccagtcttcttgaagtccatttttcccaaccccttggccccaggcaactactagtctgctttcctgtcacttttagattctttttgctctctctgggatttcatacaaatggaactatgtattctttttatctggcttttttctttcagaattatgtttcagagattcctccatgctattgtttcctctatagcttttttacattgctgagtaatattcaattgtgtgcacatactaccacttatttacctgttgatgggcatgtgtatatttccagtgtcaggctgttaagagtaaggttcctatgaacatttgtgtacaaatatttgtgtgaacatgtttttatttcttttgggtaaataagaatggaatggctgggtgaggtggtagacgcatgatcagatgtgtaagaaactgccaaattggtttataaaatggttgaactattttcattccatccagcagtatctgagtattttcactaggccatttttacatgtattatcagacaaatagaaaaaaaccttaattttatgttgatatctactgcatatttatttacattatgcacacatatgtaaatgtatatacatacacacaaacagggaaatgtatacatattttattatatcatatgaagaagcaccagttttcaaagtaaaatataagatcttactttatgcataaaattccaacccatgagcatatacacaaaacccttaaactacatataagtaatttctgtgttttccttagtgtttgtttactttagtcatttgctggccattactgacagtcaaatagcaaacttttaagaaaaataatagaaactctaacatgaggaaactgttagaagcttttttccctctgacttgggaaaagataactgccacaattttggggctgtgacttctggtattgtatcatgcaaagtttaagaacttctgggataagcagtgggcaaagggagtgcaaatggaggaaactgagaaagaatgattatataaggagcaacaatgatggactggtggcgaagaaagaaagatttttcaaggaggggtggttggaacttggaaatcaaataaggaatcaaatgaagatggaacccatggctgtggccccatggagacagaaaaagtcagatttatacacaggtcattgtgacactaagcagaatgtgaaaaaatatatccaatagaaataaaagcagcatgttagtaggggcaggagagcagagtaataaaaataacctcgtctctatatatgaaatgctggaattgctgaatagtgttcctggagtgtgggaataaacgatgtggttgaatgggtttgggtttgttttacagattttatcctaaagatatgataactaattaaactactgctgttaatttgtgtcgaataccaagcagagcctcgggactggactgagacagggccaaggtgctggtataaatttcagtgactcatctcttgtgtctaaaatagcggtaggcttgggggcaaagtataatcaagggaggaagtcattttgacacatgttccccttgaaagcaacttagaaccaatgtaagtaattcagtttctcaagctagtgttggaaaaggggtgtagatggataagggtgggaaatggaaagtgagcttgcatcaagtcatgaaagacattgtgttgtatgcaaagacgttttgatttgatcctacttgttttcaagatgactttaggcatacacttgggcctaaatgaaaatattctaatggaatacatgcaagggctcagcgattcttaagggattactttccatgttttaaacttttacgtataccctttcttaaaactgatctgcctaacacctgcctgtcctcatctcattttgtagaaggaagatacttatctcatctttccaaaatattaatatggtacattgtcctatggtataaaaacattccaagtgctaaacagaaaaacaccgtgttctgcaacaaaactgtgcttaaaacatatttgtatcatcagttgataaatcgttaaaaataattttggccaggccaggtggttcatgcctgtaatcccagcactttgggaggctgaggccagtggatcacctgaagtcaggagttcgagaccattctgaccaacatggtgaaaccacgtctccactaaaaatacaaaagcattagctggctgtggtggcgggatcctgtaatcccagctacttgggaggctgaggcaggagaattgcttgaatctgggaggcggaggttgcagtgagctgagattgcaccactgtactccagcctgggcaataggagtgagactttgtctcaaaaaataaataaataaataaataaaaataattttgaatttggatcaccttctgtggtggcataaaactcaaaaggagttcagagattgaaacttttcttagggcaaaaacattttatcagcacttatgtgaagaaaaatgaaaaactggaataaaattgatggtaaaactttgttattttagcattaagtaatattcatagatgtatggattaattttttaaaagccctatccattttatcaaaagatatatttcaagtaaagttttatatttaataattactaaaattatattaatatttatgatatttatgtggtttttgtcaattgcctaccagtgaaaactttagtataacttaattaaaatacattatttcacccttaggggctaaattcaaagtaaatttaaacttaaaattctaaattatgtatatattttgttgtatatagggatatatgatagatcaataaaatacttttagccacaaaaatgtattcattaggataaaattttgcaggggaggtagaaaagaaatagaaaaaaggcattataaaacataaatgttaagtgtgaacttgcttatttttaaataattttggtgtttacattctagatacatttaggtatatctaacagctattatgtttaaattgtcaacatttagaacattctagaaattatatctttaacaacccttttgaacttatgataaaaaatgaagataacttaaaattgacttttggtgagtttttctagatttgtctagaggggtataggcacagattttttgaggaccacaattatgggtaatgggatatcactgaaggattttgaataggggactgtttgataagattggtggctttgaaagggtatttttccattgtgcaggtggatagggtggcacatagaggttggggtgatggtaaaccaggaacaagtaaaacagtgaggagaagagagagggagagttcaaagcatgaaagggagcaggagactcaatattgctggcttcaaaggtgaagtaatagggccatgagattccttggctcatggccccattacttcaaggaatgtgggtggcttctagaagcttgaatgacaatgaaatggatgattcctctagagcctccttaaaggaaagaagccttgttcccatcttgattttagaggtgagatccatgctgcatttctgatctacagaactgtaagatgacatatttgtgttgtttaaagccactagtttgtgaattttattacaggagcaatagaaaacgaatacagcagatttacccaggttttccactgaggaaggagatgagtcatttgatactgagttaagtatgccaaaggttggcagtctagacttgtgggcattttagcctctttgagtacatgcttgttttagtgaatgagagaaagctgttatgaaggaacattttatatgaacttgcttgttttcatttctctacacctcactgtcctcttcctcaaagctaggggttagaatagattatctcaggttctcttcagcttgaaaattctaaaattatttgccttgcataaaatgaaagaaacaaaacacaccactatccccataaaattccttctctggtgagaatgaggggaaaaaaggagaaccacctacaagaattattggtaaaaacacacatagaattcactataaaacacaagcatgtgctgtgcttcagatgccttgtttaggaatgtttagttctaaatgctagacataaatcaacatatgttctggaattttcatgatgaaatctctcactgtgcatcaaagtaagagaaatagaaagttctgaacaggagcatgtattgtcctaacaatcttgtggccccaatattcatcataataaaaatttttctgccttggtattattatggatagtaattattatggataataaaaatgatggtgtattagtcaagatcggctagcttatactctgacaataaacaatttcaaaataaaaaagaccattagtactcattgttcagcgatttaaatctcacaagtagaatcagcctcttgatgggggatttttccattataaagctggtgctacgatctgaattctgcaaattggggcatttattagttagtgatcatatgggattggtctatggaaggatgcatgctgaagtcagttctttagggctacatcttgcctaaactcagtttagcatggctggtgttacaaccctcaattcctttctgcacaggggaataagtaatttctgatataactgctgcctttcacacaaaggtgggactcttgctaagctgctagagtgcagtcaaccttgccacaaagactatgcagatgacttcagtgttctcaattcctcccttggttgaagatcacattcacgcccatttcacccattcaaggactttcaggtgcaaattttgcaagaaaaagctcctcagatttcccaagaatcatctcattagaaaggagtttggaatgtgattctgtctggatgctatttctgtgataccttgaaaactttgttcctacaaaattatttaagcatttgagcacaaaaataaacaaatgtccttgaatttattatcccatatgggcttgccaactgctacagtgagacttgtggagatgataagtcccctgtgagtgaggcacttaagctgcaggacccatatgttgtgcctgattgtaatgcagagaaagttctttggaaactatgaccttaaccaagctttgaatagctgaccaagataaagccatcagagatgtcctaagggttgccattcatagagggtcatcaaaagtctttggcctcatgcactttgtgccaccctcctcactaacattctattcatgatattagtctttttgagacctcccaaatggtgctgatctaattcatttctgcaaacagacttcagatgttatgaggtgtctgtcagatgaggctcagggtaccaagcattgtttttgcttgccatattgatcactgttaaaggtgtatctgaaagtaagtcttgatagtccctagcaatcaaaagtgtttcctcaagtcctaattttttaggtgtttttccctataccttctgagtctcttacttcaggctgctatcacaaaatgccatagactaggtgccttataaacaaaagccatttcttaccgttgtggaggctggaagtccaaagtcaaggtgcctgcagattccgtgtctggagagggccctctttctggtttgtagatggtcttgtcattgtccttacatggcactcaggtcggggggatggtggaggcagagtgtttgtctctgttcttttataatgctgtaaatcccatcatacaggccccatcctcatgacctaatccaactctaattacctcccaaagaccccacttccaaataccattacactggggattggggcttcattatggaaattttgggagtggaggacacaaatgttcagtccctagcaatctcactaggacaacaaagtgagacaaataattgttctgtagagcttcttagaataacaccaatacagtctcccaaaagagagaaagaagatcaataataggggttctaggaaattgctttcagaccttgggctaattttatgaaatgattttgagaaaaggaagggcaaagtgagtaatagattttagcaacagtcatgagagtgggagttgagagggcggtgtctgttttgttgttctttgtccatagcgtctcacctataacctggcccgtggaaaatgttcaaaaaataagttttgtataaatgaattgatcattagctggagtggttttatagcaataagaattaccttgttgaagaattggttcttctttgcctttaaatgtcttcaggtttgggctccattcttgtagctagctgctgactattggtttaccccatgtaaagtgagtaaagggttgagggttttttcttatccttaggctatcaatcacctgcttctggggctctcacagttaaaagaactctttaaagttggctgtgctggaagctacccattataccaggctgaagtgtctacgggaggcatgttcttcgttttttgtctaaaattgagggttttggggaatttgctcaatcatcgctaggcctaactcaagtctcagtaacccgggaacctgtgagctattacagaagatgcatctgtagtatttactgagtgcatggatgggtggtttacagacttctcctcaacaaatagcagggctgtaatagcaagtgacagggagcttctggcagaggtagagattgaagggcaggtggttggcctgttgtctctaggaaatgaactcccagctcaggcgcctaggacatgggacttcggatttttaaactgggactagttgggtcacccagtgctgaaaccttggccctctgccgacaggctaaggggcttcctggtgtagctctcccttctcagctgtctcagccatgtccttcccatgctctgagacaccaccagcagcaacagtttggggatcatgtgaaagaaaagtaataaatacctattctgtttggtcacatctaattgctcattttcatcatatttacaaggaagaatacgcttacagggcctgaagctaccactcagtgacttcaggattcaacgtgtctttctgcaggggtcagggagtcacgctgctctgcctcacagcacagctaggaagaatctgtctgtgtctattaaactacagggagagcaccatttgaaatctcccctgccccggaggatgttgtccaaacataagtggtgtcccagagttttctctaactctccagcccaagtccctcttacagcccagggaagcctggggctcacctatctcgtgaaaatgtgctgtattgttggtgtcccagccaaggtaccccaagcataatggggtaactccagattgggtcactaagcccatctcccactacacaacggccacatttccctccctccctcagttagttctggggaggaggaagtgatgagggctggtgaggcttctccagaacaagatggagatgcaactctaaaaccaggtagagcgggaggcatgggggaaagggctgtgataccacagaggacgtagaaatttttttccatcaccacacataagaaagaagaaaagctgctagatttttaagtttcagttttggagtagtatcaaaaaggaccatcaagctggagatatttatttagataagaatgctggtctaatttatcattattttcaacttctcttgcttgtagttataattagtgataagtaatattttaagtgttttttaatggtttttggaaatattgtatacagacgtttaaagttgtatacaaattgaattagggaaaatggaatctcactttcctgtttgtatgtgttattgaaaaatattattttaattttacatcagatatcttgatacctcactggtattaggctgaaccatacgaaattgctgtttttgttgatcaaaatgattaaatattagttacttcatatagctcattgtaacatatttataccctgggtctttataaccagagacaagtggattaatctatgaagctattaaaaaattctatagtaaatatatttataaactgaagaatctgctttaacgtgagctactttccctgcactatcagtttttgcaagtttacatttttttcctgcaaaaagaggcaaaattaattttaaaaatctaaagccattggaaggtaccagaagatgggacgtttcaaagaaggaattaaattgaaggtagaaggcatcctatttcctacattgacttcaacccccaccaccttctgcaatgattctgaaggcgatccttgctcaaaggtgaccacctcagtattgtggtcatgggaaaaaacggaaaagggatcagcattctttagcttcttttatggctttatttcagctgggttttcaaattttacttgagtagatagctttatttggctcagaatgagtcaaagtggttttttggtgaatgtttcctttaccttcataagcactttctttaaagttccaggtgaaacccccagcatggtggacactgtgtcgtgatgtcattgcaggtgctctatttgagaagccatccatggtttcttcagttctagaaatgcttcagattgataacattactatgctcataggttttatgttgttttgaaattaaattaatatagaaaggaaccatttgagggtggtgacccagcattgtgcctcaaaaaaaaaaaaaaaaaaaaaacctctggtttttatgattaggaggcaatttttttttattcaactagttttgactcttacggaaataaaacatcgccactatgaaccgatttatgagctgtcaggtgatcttatgtgttgtatacatataacacacgcatctaggagctgttttaaaaatcttgacagttgtacattcaatttgtgtaatgctagccctactgtaaaatactctagtttttttgttgggacagaaccacacctaagtgaaacttgcagctagctgcccatctgcccatgaatagtttactacctatttatgtatttatttatttttcagacagggtctcactctgtcagccaccccggctggagtgcagtggcacaatcatagcccactgcagccttgaccacctgggctcaagccatccttctgcttcagcttccccagtagctgggactacaggtgtgtgccaccatgccccactggtaggggtctcactatgtagtgcaggttggtctcgaacttctggccttgaaaaatcatactgccttggcctcccaagttgcttggattataggtgagagctaccacgcccagcctaagactttgcttccttgtggaaaaactccctggaagggaatcccatattaaatagcaggtgctaaatagaaacctagtgtttgactgagtgataacattttctatagttttttttttatttatactgaaatttagaaagggcatattattcagttttgttcttcaaatcatccttgactcctctctctcacactcacacgtggtatggtaaattctgtctgctctaccttcaaaatgtacccaccttcttttcactaattcccttgctgccatcctggcctgagccaggttctctttcacctggatgactggtctcttctcatcctggcttgttccccacactgacccctctccgtagcctgttctgcactcagcaccgaaagtgactgactaagtgtaagtcagctcctgagcctccctgctcagagccctccaaggggtcctcatctgactccgagtaaaagccagagtctttaccgtgacccaccaggcctgtgtgatctgactcctttttgcgtgacctcatctctagctcactgggcttagtcacactggcttcctcgctgctctgctgtcatcctggggtctttgctgtggctgcttcctctcccagtaatgctctgccttcccccactcatccacatggctaaatctctcatttccttagtttttgctcatttataaagctagatttcttattaacattaacccctactccgttctctatttttgctttttccacagcacttaccatcctttaatatatggtataatttatttatcatgtttagcgtttactgcctctctagaatgtaagtgccatagtggtggcagttttgttttatttactgatgttcaccaagcacttagaaaagtgcctcattcatagtagtgattcagtaaatatttgctgaataaatgaacgcccattcaagggtggtgtggtgggtgaacccttattgtcccttgaccttggatgcctgttttaaaaaatcatgtttaacaaatcctaaagccattcttttatggtatgggtttcagacttcacattttacatatctactcatgagataagagtcaaaagaaagttttttaaaaaatagtatttgtcaaaacccattctgattgttttttcttataatgacagattagtctctgccaactcattccagaagcttccatttgatcctcagaggtttttaattggcacgaggctcttttcaggaaagggccactttaacatctatggaaaaataatcatgtacttttaattccacttatctgaaaccaactagtaaacccaaagaaaacactgggtgttttaattttttgaagtggcttgaattgtcccgaggtcatggcatccagtgaattcacttctttgtctttcctgtctggccgtttttgtgccttctgggtgtgaacaactcaagcggtttgccatgtgccaaacgagctgctgcctcttctcctttccagtggtgtggtccaggtccactttgcagactgagttcttttctctctgcaggtgccttctacttctagctagttatcttgtgcttctcttcccagcctgtttatctaaatgagtttcttttcctccagcccagctgcctcctgaaggtacaggaaacccccaatgaaaccatcagttctgcctctgatggtttgcctgtcctttgcctcagacgctgagacctcggtgccctggccacagtgacccttttatttgctttcctgctacttccctacctgttgttttattttttacttattattattattttttgagatggagtcttgctctgtcacccaggctggagtgcagtggcgtgatctcagcttactgcaaacttcaccttctgggttcaggcgattctcctgcctcagcctccctgagggattacaggtgcctaccagcagcctggataatttttgtatttttttttttagtagagacagcgttttaccatgtctgccaggctggtctcaaactcctgacctcaagtgatctgtccgcctcggcctcccaaagtcctgggattacaggcatgagcaccatgcccggcctacttgtcactttaaaacacagccatgcctccacccactgccgtgctctctcttcaagaaacaccagcaccacttcctgctctaaaacatttgcacacccctgctgaggaccctaatgacactgtctgtgtacctcctttatcacagacacttactcttctgtcttctgttttcgtggtgtgcgttgcttcatttcaaggacataactatgtaaacttccatgccagactgtaaaccctctgagggtgaggattacgttatatctgaccctatgtgtaaaactttgctgtgtatgggttcagtaagtatttcataggaccgtgaaacattactggttgaatgggctctggaaataaaactactgtataggccagagttctagaactgtccagatttttaaacattctgtccttttatcttctgaaaattatagttgtatttttccactgatagaaactaagttttagttggaaaatgataatttccgtaggcaaatatcatcctatagtttaacccttcacatgagtgaattgtgattgaaagaagattcaagggtgggttgtccatgttcctcttactattctccatgtgttttacatgaaggcattttgcgttcatttgggaattattcttataggtctctcagttttaatacaaaatgggttataaatatggctctggtagtgaatctctcaaactagaagatttctcccagccacaattcagttacatctagaagataacattcacacatttcttcattcatttcagcaaagagtgactgttatgtgccaggtatataatatgaattgatcagacacaagtccctgctttcgtggagcttacattccagggagtggagacagatgaacaaaaaataaaatgaaaagtgtgccagatggtaatgtgtgatgcagagaaattaggcaggggaggaaggatggaaagccagggaaattgtaatttaaaataaggtgattggcaggggcctgaaggtggtgaaataattagccctataggtaacaatgggaagaacattataggcggatggaacaatggcactgtgtgggagtcacttgtcatgtgcgaggaacagcaaggacatccttcttcaacttggagagggttggggagtaggactggttgattcagagaggtggaggggaattcagaccacttcaatttcttttcagcctcgacactagtgacattctgggttggttaattgttcattgtggagggctgtcatatagtgacattctgggttggttaactgttcattgtggagggctgtcatacagtgacattctgggttggttaactgttcattgtggagggctgtcatatagtgacattctgggttggttaactgttcattgtggagggctgtcatatagtgacattctgggttggttaagtgttcattgtggagggctgtcatatagtgacattctgggttggttaactgttcattgtggagggctgtcatatagtgacattctgggttggttaactgttcactgtggagggctgtcatatagtgacattctgggttggttaattgttcactgtggagggctgtcatatagtgacattctgggttggttaattgttcattgtggagggctgtcatatagtgacattctgggttggttaactgttcattgtggagagctgtcatatagtgacattctgggttggttaactgttcattgtggagggctgtcatatagtgacattctgggttggttaactgttcattgtggagggctgtcatatagtgacattctgggttggttaactgttcattgtggagggctgtcctatagtgacattctgggttggttaactgttcattgtggagggctgtcctatagtgacattctgggttggttaactgttcattgtggagggctgtcatatagtgacattctgggttggttaactgttcattgtggagggctgtcctatagtgacattctgggttggttaattgttcattgtggagggctgtcatatagtgacattctgggttggttaactgttcattgtggagggctgtcatatagtgacattctgggttggttaactgttcattgtggagggctgtcatatagtgacattctgggttggttaactgttcattgtggagggctgtcctatagtgacattctgggttggttaattgttcattgtggagggctgtcatatagtgacattctgggttggttaactgttcattgtggagggctgtcatatgcactgtaggatgcttagcagcatccccggactccacccactagatgccaggagcatactgtctcagtccatttatgctgctgtaacagaataccacagactgggcgatttataaacaacagaaaattatttctcataattctggaggctgagaagtccaagatccaggtgccagtagactaagtgtctgtgaagctctctgcttcatgatgatgccttgttgctccatcttcatatggcagaaggtagaagggcaaaaggacctggctagtttgcgctagcccctttataaggcactaatcccattaatgaggatagacccatcatggctcagtcacctcctaaaggccccacttcttaatactgttacactagggattaggtgtcaacatgaattttggacacaaacttttaaaccatagagcacaccttctcccccacccccgaggtgtgacaactaacagtgtctccagacattggcaaatgtcctcggaggcacaaactcacatttggttgagaaccactgcttcacaccaaagtaaggactttgttaatttgagtggttctttcattttaaggaaagtcctctggctggctgaaggggaacaaagatgggaccagggaagaaaattagcacatggccatttgggaggtgaggatacctagaagctgactggggctggctggcgatatggtttggctctgtgtccccacccaactctcatctcaaattgtaatccccacgtgtcaagggagggaggtgattggattgtgggaatggtttcccccgtgctattctcatgatagtgagttctcacaagatcttataaggtgctcttgtgccttccctcacacttctctctcctgccaccatgtgaaaaaggtccttgcttcccctttgccttctgccatgattgtaaatttcctgaggcctccccaatcatatggacctgtaagtcaatttgtaaacctcttttctttataaattacccagtctcaggcagctctttttagcagtgtgagaacagactaatagagctggggttggtcaggagtgaatcagattttggatatttggaatgattaaccatcaggatttgctgacagactggagaccaggtataaagaaggagtcaaaaataactacgaggatgtgggcctgggcagggaggatgcaggcaaggagcaggttcctggggacattgagagcttggtttgaacattttgtatttgagaatattgattattctctgtattctccctcacaataaccctgagaggtgggtatgctctccttttacaataagaggaccctgaagctcatggagcttggttaattgcccaaggtcacacaatctgtaaaagacagaaagggacttaaatccagacatgtctaactactaaccccctcctccttgatatactttgaagtgattttgtatggtttagaagcctccagtatgaagtaatagtatagtattttataccctgcagagtttaattcagtagactaatttttcatgaaatgcagttctgctaaatactaacatttcaaagcagagacagttgtttcttttgcattttatagcaggatagaacacaaacatgaaccttaggaagtattttgcatacagtagtaaaataaattacatggaatatcagggctatggtttgaatgtgtgtctccgtccaaaattcatacattggaacttaaacactgctgtgtggtgatgggactaagagatgggatctttaagaagtgatctttaggactagtgaccttataaaagggctggagggaactagataggcattttttttttttttttttttttttttttgctttccaccgtgtagggacacagtgttcaaggggccctcttagaagcagagaccaggtcctcactaaacactgaatctgctggtaacttgatcttggactttgcagcctccagaactgtgagaaataaatttctattatttataacttacccagtctgtgctattttattatagaatcatgaacagactaacacaatcagtggttagttggattttaagtgagttctaagttgctatttctccatctgtcctgttggtacctagtcctaccagttatatggcaaatcaatggtctgtggtcagttttgtttggaaatataccccgagtccctctgctagggatctataatacacagactacttctcccttctcccctccagcacctccaaaatatattaagcatctcacaggtacaggtggtgctaaaccatttttccatctcgaatatatttctataggtctgctatggtcatggctatgtccagatattaattcattctgtatgtttttttttttttttaaatatacacatccttagagcttaggtatgatgctagtaggctattttgctcctctgtcatttttctgccaaacccttctgactttttagctgtgctaccaccagaccactgagtgattaacgtgaatggattttcttgaaatagatcctgagaccttttgcatctaaaagcaggttccctatctctttcagctatataattgtgtatttaaacagtgggactcaacaaggtaattgcagtcttggagttcctagcagagtgagccatcgagccggcagtagggagctgtgtgccatgattgattccatgggggtttgggaaatttgaggtgatatgagccgaactgctctgaagagttgcccacaggtatctctgctgttacaccttgtatagttttgtgatgacttaacctaatataaaagatcacactgtcatttctctttgagaataatcagtgccaagggaggtttcttaggaggtctttggcactttattcttgatgagtttttggcagggccaggttcatgaatgtgtgacctgtggaattgcacagggttctagactcagaaaggtcctgcctgtgttttgtgtttggtttaaagatagctgtcagagtcttgaatttttttttctttttttttttttttgagatagggtcctgctgtgtcacccaggctggagtgcagtggtgtgatcaccgttcactgtagcctcgtcctcccagggtctccatagggaggccctgtctctacaaaaacaaacaaaaaaattagctgggcatggtggtgcacacctttagtaccagcaagtcaggagtctgaggtgggaggattgcttgagcctgggaggttgaggctacagtgaactgcactccagtctgagtgacatagcaggaccctatctcaacaaaaaaagaaaaaaaaatgtcaagacagtaatagcagagctttaattcaaacacagagcctttatatgctatagctcaggttggagcacctatccgttaattagcagttttgcccaaaaggggcctatgcagatctcaggcccctctcagaatctatgttctagttggaaacaagggctaatcatctgtatgtaaaacaagctttcaggcaagatgcaaaatgcttcttgatcagcagcattgccaaggtgaaagttaactatgcatgttcactcatcattcaacaaatatttattgagcacctaccatgtgctgggcactgtgctaggagctgggatggacgctatcttgggttccttgtgaagcagacgccatgacaaagatttgagtgcaagtgacttattggaaagatgatcgcaggaaatactggtagaagagtaagaaagtgagacagagacatgaaggaagccaataaatggtttgttttcacagagaaaaactacaactatgtgcaactagggcctaatccactgaggaccagtgtagaacatgcctcggaattttcctgtagaaagacacaggttggttcctttcccactaactctgatccatctggttgagagctgcccagggttatttccagcctgccccctgtgtcagaatgaacacaactcctcagctagagaaagctcttaggcaaagaatcacagcatttgtattagaaagctgtatgtgaatattagattagtgggtgctaagcgtgaggggatgaagagtgacaagttggggccaccattttgaatagattggtaggacagagctttctgaagaggtgactcttgaaaaaagacctatgtctttttaaaattttactatttcaaaaatgggagtcatgcatcaagaaaaataggattcttaagtcatgttgtatataatagacaaataataaacatatattttgatctttgggaatgtttatattcttgaaaacattataactttcagagagtatttggctatttggttggtaattttcttgacaatctctttttgaatactgtggcatcttttcatctatattctaggttttctcagtgttagaccattagacctcatgatcagaatattacagttttcaaaaccaaagttactgtcttctttaaagtatgggatatagtgtctttaagcatgaactgcttttttttttaaaaaaaattggaagctatcactctttttatacacattcattgtgaacttggtgtttcgtgtttttaaacaactgaatgattataagtaaagaaatgactgccttgagtaggatagtgaaataataggaagtgaaatataaattttcacattagaaaaaaatgattcccacttctttgttgggacaagaatgtgaagagtgttccttatgattaaatgactcaaaattgactcactttgtctaattaatagataggccttactgtttagatgtttgtattttacaaatgtattttccaacacaaaaccactggagggtgaactcaggtaattttagctacatttttttttcctgtaaaacatagtttcacatagctttaaaatcaacctttttgggccgggcgcagtggctcatacgtgtaatcccagcactttgggaggacaaggtgggtggatcacaaggtcaggagatcgagaccatcctggctaaaaaacggtgaaaccccttctctactaaaaatacaaaaaattagccgggcgtggtggcaggccaggcgcctgtagtcccagctactcgggaggctgaggcaggagaatggtgtgaacccgggaggcggagcttgcagtgagtggagattgcgccactgcactccagcctgggcgacagagcaagactccatctcaaaaaaaaaaaaaaaaaaaaaaagaacctttttttaatttccttacttcaacccaaatggatgcatctgtaaaattgtatctctcataaatcattctaataatatttgcggtgattataaaaggaaaatacatggggcttgctaattatgagaagacatttgtttgtttgcttgcttaacagttacttcatgcattgtcctaatgcttctttgcagaaatcttttagtagttagtgcctctctttttgtgcagtaagcaatggatcagactgtaagcttttactttactaagtgaggcgatggcaagattttaagaccaaattaggaagtttggtttttctctggaaactatttcatttttagtccaattttagtctagaaaaatagggttacaaacaaagcctaataattcattgcttaacagaagttaaatgaaaaactgcagtttgcatcaacttcctggtttttcgcaaaatcatcccgcatattctttttagctttgtgtggaactggggcttatcacactttaatgtggatatgagtcacctggagttggtgttaaaatgtagattctgcacgtccaacaagcatccagatgatgcagatgctgctggtctgtgggcacctttgaggagcaaggtttctgtgttggttaattttatacgtcaacctgactcggctaagggttgctcgatagttggtaaaacattatttctggctgtgtctgtaaggatgtttctagaagagattagcatttgaattggtagacagagtagaaaacagtgtcttcaccagtgcaggtgggtatcatcagcagttcattgagggggtgaatagaagacaagtgcagaaatggtgaattcttctctttctgcttgagcttagacatccatcatctcctgctctgcccttggacatcggtgctcctggttcttgggctttttgactcaggctgggatcccatcaatcctcctgacctcctatctcaggcctttggactcttattgaattacaccaccaactttcccggctctccaacagattgtgggacttcttggcctccctaactgcatgagccaattcttagaataaatctcagtttatatatatctctctatatcctactggttctgtttctctagagaaccctgactaatacagtctcagacaactggcttcaggattcatcttgcctaactgtgggggcaaaaccatgcctggggaggggtggactgctttgaaaaacaaagaggttttggagataaagttagcctgaaaatttttctgattcagacaaccttgcatcagaaaaattttgatgagccttgcttaggagtgcaaaaagcagacgttacagttttaagcagaaagggctcttgatgttaagtaaaggactggtagagattacagaagaatttcaggtactgtagtaattacagaggcagaactcttttctccttagcaacagtctatgtgtggggagcagaagcttgttatagcagaggtcactacagagaaatctgtgtgtgcaggcagagtcaaaagcaattgaaacaagtttgcactaatgactttggggaccagagtgccctgacaatggaataggagggccatattatcaggggtgacctctaatttgcaattaaaatgacttctgggcatgtaaatggacaactgggtgggaggattgtgtaatgtgggtggcactcagtgaatttctttatcttagactttgatgaaggaaagttattcccctgctccttgcaagctcgatagtgacagatggttgttgcttccttgctggtttctgttcctagaggaataaagtaggaattggtgttcagaattcaggctatggaaagatactgatgtttgggtggacaatttaggtataagaggacattggctgctgttactcaaccaaggcaaagaagggttgtggaaagtcatgaagattaggggtagccaaaactactcatgtgatccttgagcaggttattaacctcttctagcatcaggttagtctgctttcatgagggtaataaggcctatctttggtgggttggagattttatttatgaggggcctagcagaatatttagtacaaaggttctcagtaagcggaggtgttattttagaaatttatcttgaggtatagctcatgattagatttcaagatgagagctagagttctgaattgaatttaaacttgaatttcatcaatacagtatagcgacaaagcccagagggaatataagagatgtaggcaatgtaaaatgcaagaaagcaagatgctcagtgtagtaagaaaactggtagattaatattttccacaaatgtgacaaaatacaaatttatttacagagctcttggcacattaatgggtgaaatgcctggggctgtaatgattagaggagagttaaattcttgtaataaccagaacttagagaattattagatgcctccaggtaaacgaccatgtgggcctctccagttgtctttcttctgatcacctggttgtaacagagagattttattattgtcaacccataactcactgcctacccattaagcaattccacagattctttcctaggacctgtgctgtccaatatgggcaccacttgctgcaatatggctattttgcactcaccacgtagccagttcaagttgagatgtgtctgcaagtataaaatacacatcagatttcaaagacttagtatgaaaaaataatgtaaaatatctcattaatttttgtgtaatatatggaatacatgttgaaataatatttagaatatagcggattaatgaaagatattaatattaaaaattggttttaccttgtcgaatgtggcaactaaaaaatttaagttatgcatatagttcacattttatttttattgaatattgctgcctagaccaccctgggacctgtataggaattttctggagaggcttaaatcaaactcccttgttgccaaacagaaataaaactaaaccaggccgggcgcggtggcgcatgcctgtaatcccagcactttgggaggctgaggttggtggatcacctgagatcagaagtttgagaccaacctggccaacatggtgaaaccccgtttctactaaaatacaaaaattagctgggcatggtggtgggcatctgtaatcccagctacttgggaggctgaggcaggagaattgctggaacctgggaggcagaggttgcagtgagccgagattgtgccattgcactccagcctgggcaacaagagcaaaactccatctcaaaaataaaaaaataaaaaataaaaaaaaaaacaaaatcttatgctgattcaggagaacttctgagctgagaaccattgtcatttctcaacaaaaggactctgcatgagcaagttaactgaattcctgtggtaaacatgttaggtccctctaggtgtagtctcagagatataactaaggtttttatatcatttatacttagctttttcttaactttgttttaagtcagtatttgccaactattatctagaaagcaatgttttttctcaaaggtgtctgtcactagaacacattccccccctctcaaaacaaatacagtagaagaacactgaaacaaaagaaaaatcacatagtgtacttttggtcaacatttatcttgctgtaaaaatagaagaaagagaagaaggtaggttggcatctattaaatggtattacaattactggttctgtttctttgtggaatatggggaatcaacaaagtaaatttattctttctgatcctaagttgtcagggagttattgaaagggaattgcagtcctatttctgcagcagaactaatgtgaaaggagaatggtaaattaaataaggtcaaaatgatttagctagctgcttcagtctcctgaatgatcacatgtaagatgcaaataaatgtagggctttgtgctattaaatagagttatggtttttatcttggaatggatactgtgatgtggctgagtagtcatattaataggatatttttggtcactcacttgtccttagattatctcagttccagagatgggaatgattaagattgtaccctactcatgaggaatagaggagacagtgtgtcaaattggaatagaagaatgagcaatgaattctttcaccagcatatcactgtgttcccaaattttgatttaccattgtattctcttttttaaaggccacctatgaaaatagtagagggctattttgactctcatttaatctttgctgtatcttcaaagttgagagggatatcacatggcttgtgatttcataggagaggtttaggatttcagaagtgcttggataaggttggtctatactcttaacatggtgtgaggagcaggaagataatattgccaatggggactctattagtaagtgttaataaatgttgaagtacttttaaaagaaattccaaaatagtctctagtcttttttgtgtgtcatttcttttggaactataggattcaaagctctggattgtaacactaaatcaccttgacaagtccctagaatcataactagggaagtacattgggtttgccttgggaaagaaggatataaaaatggaggtgtgtttttcttcctaccctccccatcccaacagtggtggaaagtttcatttattcattcaataagcatttattaaacagtgtagaaaccccatgttagataactttgagaataaacctaaaggacggtacgttgagtatttgattccaagttggctttttcaatgttcccatcactgatggaatcctgagaaccctgttagcctagcactgactgtttctttcactcttggatctcagatggtggggacactgaaatctaggggaaggttgtccggtaccacttacaattccagtttctctggttcttcgaaattgtcctgaatttctttaaaatcattattcttagtcttgaaacactaggttatattcataacaaatggttttgatcttaacagcatccttaattttctgagagaaatgaacaaaaattggtattctaaatgccaggtctcccagatttttattatttcagacaattgttgcagcatgcgaaatttttaaaattacaatttacttattttgagtcttatctcttcctgcatgttgttcatgctctccactgcattaatcttcatctatttacatttcagtcaacctgtttatctgttgttaatccatcttctggctgattcctgtcaatctcagcctacaatagctcactgggaatatattacataaaagtcatcaagggcaggagagagagaatggtattctgattttgatctttactcagaattctcaatgactttccctctgtgatagcagcagatgttcccaaagttagttattgaaaatgacagtctcagtttcccgtttttcactcttgactctcaaaaatggataccagctacttagtatgtcactgtgttttagcttcttaaagattcatgttaaaactattcattgtttttcagactaagtgattgtagtttctttaactttttcaatgctgggtttgaaatcatttccctttcttacacgtctgaatgcaatccatcaaccaatgctgttgtctctgttttcaaaatctgtactgaatccaacagcatttcccaatgttaactgttaccgcctttgaccacgccactgtcatcactcattcagactcttgcagtagcctgttagctggtttcggtgctttgttcttgccctgccgtagtcagttctccaaaagacaaagtgttcctttaaaacttaggtcagaccaggcaactactgctcagaatgttctgattgcttcccatttaattgaaaatcagatccaatcattgtctttttctgtgatctgactcccttttacctttctgatttcatcccttctggtgtcctcctccttcacttgctgttttccagctacgttggtctcttcacccttgcagaatacagcattcccctcaaggcctttgcatctgctggtcccactccctggattcctcttcctctcagtcttcttgaggctgactcactcacttctctcaggtctttgctcataagtcacttcatgagtgacacccttgccaaggccagttatctcaagtggtaaccactacccctcccctccccccagcttgctaggaatgcaataaatatttgttgaatgagtaaaataactatttttcatggaaagacatttaatttcctgttccatctatgggaatagataaggaatgcataaaatgatcctcagcagcagaaggcaggtaaacatgacaacaaagtgggaagaaatcagacatggtaaaaattccatatcatatatttagttttcttaaagtacaaacagtaacagaataaaaagtgaataagttgtttaaaaatggaaatcttccttggaacagctaatatttataatcagatcattattatgcaattatgtaatgttactggtataattttgtgttttctaaatattaaatgctcctccctttgcaattaaatttaaactatcaatatgcttgacaaactgccttttataataaaatgtacctgtgtgtatagtactgtatatatataattgcatatgcatgtgtttgcattatcaataatgtaggatttttatactcataaaagttatgatgtattagaattatttcctattgctaaatgggaatctattgtgattattattattggtgtaatattaatattggtaggtattaggcacatatatgcaaccttgtagagggaatatttcttctggaatcagatcttctgcatgttataactgtgtaaatttacttaactgtctgggcttcttgccttgtttttaaaaaggacataataatacattacttatttaaaggtagaaaggtagaaatacatggtactctaacatttgacagattgcaaagagtcatcattttaaaaatcacaatgagatattatcacacacctatgagcatggctaaaataagaagaaaaaaaactagatggtaccaagtgggtgaaaatgcagagtatctgggattcccatgcattgttgggaatgcaaaatggtgccaccactttgaaagacagttggacagtttcttacagtgttaaacatataatacatataacccagccatgccacttgtgggtatttacctaagtgatggaaacttatgcataaaccaaaatctgtacactagtgtttatggtagcttcatgtagagtcatcagaaactggagacaatccaggtatctctcaactagagaatgaaaaaataatatctggcatatccatacaataaaatactactcagcagtaaaaaggaacaaattagtgatgcatgcaccaacacagatgaatcccaaaatacattacgcttcctgaaagaagctggagtcagacttggaaggctacatactatatgattccatgcagtaaaggcaacattgtaggaaaagaatacagatcagtggttgtgtgggagtgggaagagagactgactgtcaaaggggcagcctgagggagttttgaagtaatagaattgttttatgtcttgattgtgtggtggttacatggctgtatgcatttgccaaactcacagcattgcacatgagagagtctattttattgcatgtgaattaaaaataaaaataaataattatcttgatttttaaaaccagttatacctctgatgccaggcattgatgaatcctaaatgtcctaggtgggtgatcacatctgctcttagttccccattttattttactttagttgccgtggtttcctggtgtggctttgtcctgcttcagttattattcatggcatgatggactttggctctgatgtcagaggtagcaatggtggaaagctttcccacattctcccagaagcagtttcatatccttagagggaccttgccagctgactggtctagctcagtggtagtggtgctgacaaaggctgggatcttgtcctgcaacttcgaatttgtagatatatcagctgctttagttcctttataaaaaccaaatagaaatgaataggaaacagaatcagagcaggctgtttttcaaagaaattactccaggctatgcatctggggcccttgttttcaatatggtacctgtctcagggctctgacatcagcagctgtgttctgggtcatgaaaagtttgcagactccagctccatcaaaaaaacaaaaacaaaaaccaggtaactgctgtatcgcactgtgttgtgccccagtgggccagcatatgaggtaatgtctcatggaacagatggttgaccagttgtctttggtaaaaaaaaaaaaaaaaatatatatatatatatatatatatgacaaatataaatactaatctaaacatataatttataactagagaactttaggcatttgggggttcttgtaagctgtacttactcttcttctgttctcacttactggctagtagatacattttatgtttgttgagaatgtgactaatgtaaaggtccttgaggtcatgaatctcttgtaaaaccagcctgtttccagttttctagactattttggatcctctgttttaggtatatcaccctgcttctatacagctgtcttaagagtgctataaacctagattgaacaggaaaccagcttcctaccagcaggttagaagtgacttacaataaactaaaatgagatatttttctctctggcattattctggagcaacagctcttgagtttcctatgctactattcttagtttaatttgcacagatcattttctctatatgcatagttatgtcagtgcagaaataaaggagtgggagaggaatgtaattgagtactcactccaggtttcaggaatgtgataggcacttttcgtgtattattccatttaacttcacaacaatgagttaggtagataattttgctgctttacaaacaaggaaactaggtccaggagaggttaatttacttatattctcaaagataggtttctctcactcccaaaaccactctatattccgaaggctccatttgggaatagtgttttttttttttttttttttttttttcccatttctttgtcacttgcaatgggggatggagattgcactggtcttttgagattgagacctggagcttcttcttagacctggtctgagaaccatgtctgttccctgttttacttttcagagtcccaagagatttggcctaattttatgtatttcttaaaatctgccattacacacgtttgatcacttggttctttctcccccatgactgcctttagaggaaaattgagtcccacagttgcgtggctctgaacaggaaacccataaggctttcttattttaataattctacttctaatcaccacagggaaataggaaagcaaagagaagaaaaaaaaacaaattaaaaagattcaaaatagttaaaatcttagtcgttgagtcgttgagcccagtttacatagtttctgaaacttagttcttatttcttaaaagatactaaaagtcttttttttttcatagagattacttttatttatcattggaactgtagttcaaagcagattcaagttggtaccacttgtgaaattttccagtcactatccaagctctaagattttttttgcgggggtggggatcgagtcttgctctgttgaccaggctggagtgcagtgacacaatctcggctcactgcaaacctctgcctcctgggttcaagtgattctcctgtctcaacctcttgagtagctgggattacaggcgtgcagcaccatgcctggctatttttttttgtatttttagtagagacggggttttgccatgttggtcaggctggtcttgaactcctgacctcaggtgatctgcctgcttcagcctcccaaagtgctgggattacaggcatgagccaccgcgcccggccgctctaagactttcattatgaaccagtgacgtaagaaatgtctaagaagtaaagctatatgtcatgttaaagagactgccactggatgggactggggaatgtatattaggcttaaagaacttttgccgccccgtaatgaaagccagagccacgtgtgatcattgaacatttgaaatgggggtaatttgaattgagatgtgttgtagcagactatacgttggattccaaagactcagaatgaaaaaaaaaacccgaatttaaaatttctgaataatttttatattgattacatgtacattgattatattttaaaattctatgtatactgagttaaataaaatacagacagttcttgacttatgatggttctgcttacaattttttctcttaacaatggtgcaaaaatggtaacacatcctttagaaatcatacttcaaatttttatatttttgcaggctagcatatgtaatgagtttctcttgcaatgctgggcagtggcagtgagccacagctccaagtcagctgtgtgactgcgagggtaaacaaccgtgagatattcaacgcttaactataaaataggctttgtgttagatgattttgctccactgtaggccaatgtaagcattcggagcacatttaaggtaggctgggctaagctatggtgtttggcatgttaggtatgttaaatgtatttttgacttaccgtattttcaacttaggatggatttttcaggatgtaaccttattctaaatctagagcatctgtatattattaaaattaaatttacctttttaacttttaattttgaggtaattacagagtcatatgcagttgtaaaatataatacagagaaatctcatatatcctttacccagttttccccactggtaatattttacaaaacagcagtacagtggcagaaccatgcaactgacgttgatgtaatccactgaccttattaagattttaccagttttacatgcactcatttgtgtgtgtgtgtttttagttctatgcaatttaatcacctttgtaaattcattatgacacgaccacagtcagaaatggaattccatcccaaggatctctgtgccacagccatctcccttccttctctcctctctaacccctgggaaccattaatctgttctttacctatataattttgtcatttcaagagtgttatagaaatggaatcacatagtatgtaacttttgaaatgaggttttgtcactcagcaaaattcccttgagatgcattcaagttgtgttatcaatagttatttcctttctattgttgagtagtatttcgtgtttcttttaacctttgtaatgatgccactagaaagctgaaaattacatatgtaatttgcatttctggctttcattgtgtttctattggacagcattggtttaagggaatgtttgttagaagtaattaaaaagcatatttctgttaagattttcatggaactttaggtattcctgtgttaaatggtgtattttgttctgctaactttaaatcaggttatttggaaataagcaagggagcagtggctttaaaaaaatcatttcaagagagtaaaattatctgtgtccctcccacatccctcctcctgccttttttttcttttttctttttttttttttttttttttttggtcagtttttcagtaagaaaccctttgtatttctatccacaaaagaaacttttcatcaggttaggcagcagaggggcatcttgcaaccactcccatggcattcagcacactggtttgagactaattaaatggctcatatttatctgatattttccctcttgggagctccagaaacttttttctttttcaactgaagcttcaaaaagaaaccagctcagttagcttatgaaggagggaagaaacaggacacagggacacttcagagcagattagaactgaggtaaaggagactaccattttcaattaaaattgcctggggaaattaggtaggcagagaataattacctgggttggcacacatccaagtttctgaaactaagaccctgcttggatgttctgagggatcattgacaaacacaagtagccaaggaccttgaagtttatgtgtcatctcaaatgtattcaagagttctggatacaatggatggctattttaagtcaaattatatagcatgagatgttctaacaaaaccctataaaaaccaatacccttgggaggctgagatgggtagatcacaaggtcaggagttcgagaccagcttagccaatatggtgaaaccccatctctactaaaaatacaaaaatcacctggcatggtggtgggtgcctgtagtcccagctactcgggaggctgaggcaggagaatcacttgaacccgggaggcggagtttgcagtgagccgagatcgtgccactgcactccagcctgggagacaaagcgagactctgtcttaaaaaaccaaaacaaaacccaaaaaccaatacccaaaacaaacgataccacaaagcatcagattaaaggaggtttctgtgacaaaataaatatacatttctgtgacctcagccatgtaaccaacaggacactggggctgagattgaactgtaggagaacatgaagaggactgattaaagtatagttttagtctcttacctccttaggcaaggggccctagtacattaacagtccttggttagcatcttacaagtaccaagaaacatcactgagtaaatgtcctaacacaaggacttgtccaacctagtcgtgcaaatgagtcattgaaagcaaatctgccttgaatgcaaatgtcaagatttagtattgtactccccaccccagctctacctccagtgacctattactattatacaactgctaagcatggtttctcagggtctgtgctgcctgtggctggtggcacgtggtgccgtgctgccattgctatggggggatagaatcgatggaaaaggttttcggttattgaactatagattttttctttctcattacctagaggagggcccaccatctgctccacaataggaaagggatccaatcatgtttcttacttgcttctagtgttagcttttgctgtgttttcattgtttcataatctctcaatttcaaaatggtgcatagtggaagagggtttagaaggaagaaaagagagaaaaaggaatcaattatatttttttctctttcctctttcaaaataaaacacaggggtagaggaatacttgtattattttcttttttaaagagattttcatagacttgctgaacaaggcagctgctggtatatagggtattttaacgcaaattacagaaatgtacccctttccagggctgcaggcctcactcacctcttggtcatggacatgagccgtatctgtctgagtgcaatgcatgtgtgcttggccaccatcttgtgctgtataatagatgcagaaatagcccctattttatactgtggaagcacagatggatgcacagacagttgccttaagaggaagggtcccagggccagtgcatcaggggtgaattcatgctcctttgcttacctgtcatatgactctggataagtgagatgactactctgtgcctcagtctgctcatctataaaccatttctgtctcatagagtttgatgagatataatgagttaatatacataaaacactgagagtggtacctggacatagtaatttctcattgattggtagttattactatttgcttctgacagttttgctgtctaaccaaacatgtttctgaagggagatttcttgaggattctcatttttttaagtcttatctaataagccatgtactagtggatatattaagcaggattttaattatatttaaacttttacttttttttttttctttttttctgagacagggtcttgctctgttgcctaggctggggtgcagtggtacgatcacagctcactgcagccttgacttcctcggttcaagtaatcttcccacctcagcttcctaagtagctgggactacaggcatgtgccaccatttctggctaattttctgtattttgtgtagagatggagtctcactatgttgacgaggctgatctcaaacttctgggcctaagcagtcctcccatcttggcattccaaagtgttgggattacaggcgtgagccaccacacttgacctgcttttactttaaatattagtgtggttatgtatatgctgcctctgtgtaacttcccaataatcaagtcagttgaatgaaagagcagtttaaattggttaacaccatgtacaaaatataacctaatttaattaaaacattttggcccatgttattaattggataccctgtcctaacaaagcaaaacaaaggaaacccaaatttttggtccttctaggtactgagtgtgtgtttgctgctgcttttaaagaatgtcacttttctagacatctagtttcataagatttagtttaaggtcaagaggagaaacatctcttatagatttagaacttggtagagtacagatattctttgcagtagatgtggaagtccaagaacatttgggagaattgttaaaaatgtactgactggttttatttagcctctttgctggtcagttagcttttcttgtgacatagctgcagagtcaagcctgagttacatagatgacaaatgcatgctaagttaggtgttaacaggcagaattctaaggtggccccccgagactactgccccttggtttacatctcctgtatgatccccaggactgtgactatgacgggatgtcactcctgtgattaagttatgttacatggcacagtttactttaagaataaaagtttgtccttgatggaccctaaaaggggttggagagaccgattcagagagaaagattccatcaggggagattctccatgactggctttgaagatggtgggggccatgtgacaaggagtgttgatggcctctaggagctgagagtggcccccagccgacagcctgagtgaacttgtaagcacattatttctctgagcctccagaaaggatgaagcctagccaacaccttgattttagccttgtaagatgctgagcagaaaacccagaaactcctggttaacgtggtgaaaccccgtctctactaaaaaatacaaaaaattagccgggcgtggtggcgggcgcctgtagtcccagttactcgggaagctgaggcaggagaatggcgtgaacccgggaggcgaagcttgcagtgagtcgagatcgagccactgaactccagcctgggtgacagagcaagactctgtctcaaaaaaaaaaaaaaaaaaaaaaagaatgaaaaagaaaacccagaaacgatgtctggactcctgacctacagagctatgagctaatgaatgtgtgttgcttcaagtcactacgtttgtggcaatttgttatgcagctgtagaaaactaatacacgaaggaaaccaggcaaaagaatgtaggttagcaattgcaaagccattaccattatttagagaaaaataacacccataaaaaacttgtaatgaactcctctaaagagccctgttttgcattgtagagccagttggccacagtaaatgacagatagaggtaagttttctgggcagagtttagatgctttctcgggaggggaaatgaatggctaaagtagctctttttcttggtgtttactgcatgacggcaaagaaaaaatacagaataggaagttggaatcccctcccttccatgcttatacatgttgctgatgagggctttcatttagggatcactcacttgggtcggtgagaggagaacataggtgacggagttggctgggtggaagtgctctggagggcgggggctgtggggatctgaaaacccaagctttctctgaggggacagatgcctctcagctgtggctgagttgtctgcagcattctgttgccacatcatccaaatttctaagagaagctgggagtctgtatatttatgtgtagtctctcattttttaatgttaataaccggctcaaactctaaaagatcaccatggattcatataaacatatatgtggccagatcaggcccatgggcagcctctctgtgaatgcagcctagagaattagtatatgggggcagttccagagactgagagaattggagggggtgagtgccatgagttctagaagttttgtctgtttttttcactgccatatactcaaactgagaacagcatctggcacacagtaggtgctcaataaatattgtagcacgaacttgaggaaacataaacatattaataccttacatggatatagaaaatatgactgcattggtgaaacttgtttctaagatttgattacttttaatgtctaggcatggtatgatttgggctaacacagtgtccttttggcccacccactttctttttttaacctgcgattcattcgagggcttttatggaagtcattaggtgctacagaacaaagcaggcattgatcccttctgtgttgcttgggtgccttgctcctcttatctcgtctcactctgaccctgacttctaagatgagtcctaacaccgcctgcattttacagataggagctggtttcagagaggtgaagacagttgcttgaaactgcatagctggtcaatgatggtgctcagctcttctgactgccaggtctttgcccttcatctctgtgcttgatactcagcatgcattggaaccagtcatgtcagcatcacctgagagcttgagcttcacacatgctgaatctcaggccctgcctcagacctacagtcaaacagaatgtgcattttaaccagatatgctggtgatttgtatgttaaagtttgagaagcattgtcctaccccactaggttctaaacttgggttattcctgaatcacttttatggatttggccaaatctgagttttacctgaacttatgactcatcttttccacttaaatgtatttgcttaaaaagaaaatacaaccatgataatgatggtaatgtggtaacattactattataagtagctgtaaataattatagttatgtacccaatagaagttatgtacccattcaatagaagaatgattccattttctataaatagaaggtaagtgctaatgcccatgcattctacattacctctccatgtaccattgtaaaatatctgtattttaagatggtacatggaaactgtaccattaataataaagtgtaataaaccataaaatatctcttcatggaccattagtgggagagtgttccgctttgggaaataatgctatggtcgattgtaaaaacgtccacaaggtcttccccactgtacattcatggctttgcagtgtgcagtgccccatcaagaggtgggaccatttctctatcttttgaatgtgggcttgaccatgtaactagttttgccaaatgatatattagccaatgcgatacaacagaggcttggaaagtgcttgtgctttggggcctgccttcttgcttctcttgcaaactagagaacaccaaaataagtggttattgatttaagctacaaaagtttgaagtctttgttgtactgcacaatctcactgacacaactgctttccaacattctgtttgcttgcaaaacaatcatttccatgttcagtattaagtcagagtaaaatgatctgtttttgttcaaccttgcccagttactcttcactttaaaacaaaatctgaatattgaatatcttgggggaggacatcacatgctagtctttttgtgttcagtacatatatagattcactaaaacaggcatggcaatgtcacctttaaatatttgtaggtttcttcctcctctgagaaataaaagcttcacccttggctaaagttccccattgctttgaaataagactatgtaaaacactgtggcatgattagtggtggtttacagtaaaatattggtgttttcttatggcttgaaggcagttccatatgtatgcttttcttttgtcagggtaaaataaaattggatgttttccatcacaaggaatcccctgaagaatcacaataagactttttaatatatataaattttatcacttactgtgttttcttgaagaatgtgagtgttttctcatttttggaaaaagctgactggcaaactcactatgtgtattatagcctttttttaaaagactgctttcatgaagtataatttacatatcataaaatgcactcacttaaaatgtacaattcagtggtttttagtattaatatattcgtggcattgtgcaactatcaacacaatctaacctttgaatcttcattaccccaaaaagaaatcccatgctgctcctctagtcatagagagccactagtcagctttctgtttctgtggatttgcctgtagtggacatttcatatacatgggaacataccatatgtggtctttgtgcttggcttctctccgttagcatacttttttttttttttttttttttttttttttagacaaagtctcactctatcacccaggctggagggcagtggtgcagtgcaatctcggctcactacaaactctatctcccaggttcaagcagttctcttgcctcagcctcccaagtaggtgggatcacaggtgtgtgccaccacacccagctaatttttgtacttttagtagagacaggatttcactatgttggctaggctggtcttgaactcctgaccttaggtgatccacccaccctggcctcccaaactgttgggattacaggcgtgagccaacatgcccagccagcgtaatgtttctttgaagttaattcacgtagtcatgtgtatctgtgttgcatttttgaattgctggataatattctattatgtgaacgtactacacgttttgttaatatgtttatcagttgatggacattgggattgtttacaattgggctattatgaataatgctgctatgaaattttacatgtaatttttatatggatatatgttttcattttttcttgggttcatatctaggagtggaattactgggtaatacagttacttcatttttaaccatttgagcaactgctagactgttttccaaagcagcagcatcattttacatttccaccagcagtgtatgaagtttccaatttctctaaattcttgtcaacacttgttatgtcttttgattatagcttttctagtggctatgaagcagtatctcattgtggctttgatttatatttccctaatggttaagtatcttttcatggttgtatatcttttttgggaaatgtctattcaggtcatttgcccatttttaaattgggttatttgtctttttcctgtccagttctaagagttcttacatcctggataaaagttctttatcagatttcctgttctgtgggttctcttttcacttttttgacggtgtactttgaaggacaaaagtttttaaagaggttcgacttatcttcttttttcttttgttcttcatgcttttggtgtcacacctaagaaaccattgttctggtcacaaggatggtgccacccaagatcacaaagatttactcctatgttatatttacttttaagaattttatagttttacttctgtgattcacttggagctaatttttgtccatgttgtgaggtaggagcctatcttcattcgtttgcgtgtgagataccatatgtggtctttgtgccagttgtcctggcaccgtgtgttgaatagactgtctctccccattgaatggtcttgatacctttgttgaatgaaacagcttttgtttgcattaacactgatacaactctgggatttgcaattttgtttacctattatgggaaaatatctttcttctttgaaagatcaaaacacgtgggaagacatacataaacaccccagacacacacacacacacacacacacacacacacagcctctgtctctcacacacacactcatgcacacagtcccttctttaccaaagccccatgtaatcccttcatgacccagaataatagtatttgaaaggaaaagttggtatgctggagtcttcattcacatattactacaactccaagtcagttgcaatagtttggctatgatatgccagtagctaaatagttcatgacaaattgcttatactgcttaacttctttgtagttaagtatttcaacattgccttccccacatgttgcaatatcttatatatgcccagaattagaaaggtttatggaacaatgaggcagtttatgttagatagttgctagggaattaaagaagagaagggaaaacatgtgtccagtctctaagtctttgattacgaaatgacttgggcagcaagtggtttctcaaaacgaggagcatggtatggcaggatcattaatcaatgagctttttgggaactcggcctgtttcatagcctcaggagacataaaagagtcatatagtttaacattccagctgtaggtaggccacctaattattcagcattcaacaaagatttattgagcatctactctgtgccaggcgttatggtaggtattggggaaatacctagtggttttcaataacacataatccctgtcttcatgggagtcgtatcttcattattaatacataattacaaatataaatgtaagattgaaaatctggtaaatgtcatggaagaagtggcactgtaggggttaaacatgggcgagggtgcctgggtttgaatgccagttttgtgggattcttgaatattcaacttcttcattcccttttctataaaatgagagtacatacatttttgagtttttatgtggattataaatgatgattcaatccatgcttagagccagcctgcatcatagtaaatagtcactaaattagtaaagtcagggtacatgatgctgtgtattccctaattctgtatatttgaagtgggatgttgctttctgtagagactttggagtgaattggctttttttccattttaattataaaaattatttgcttcatggtaaaatattacataatggttaaatgttaggttaaaatcaaagaccttaccctttaaaaatctccttttagtactggtcccctagagggagctagaggtagccacactcagtgtttcttgttttccctccagatgcgttatttgtgtataacgatatatatgtctgtgtatttacatatagattagtgaggtttgtcttaacacaatggagccatagtatccatattactacactacttcagactttttaaattaataaaatgacctgagaatttgtttctatgtcttttcatataggtacagatttcctctcttgtttttcatggtgtagtcttgtattatatgaatgtaccaacctacctgagaccttattaaaggactgtgctgtagtcatctctatacatagatcgtgaccttcacaaatttcaattcaaactttatagacacagttttcccaggtgtcatcagttgcctctgccttcttaccatatggaaatgggcttccccttacttttgtgtacttctttttttttttgagatggagtttttgtttgtttgtttgtttgtttttgtgagatggagtctctctctgtcacccaggctggagtgcagtggtgccatctcggcttgctgcaagcttcgcctcccaggttcacgccattttcctgcctcagcctcccgagtagctgggactacaggcgcctgccaccatgcccggctaattttttgtatttttagtagagacggggtttcaccatgttagccaggatggtcttgatctcctgacctcgtgatccgcccgcctcggcctcccaaagtgctgggattacaggcgtgagccactgcgcccggcctgagatggagttttactccgttgcccaggctggagtgcagtggcatgatctttgctcactgcaacctctgcctcctggattcaagtgattctcttgcctcagcctcctgagtagctaggattacaggcacgcaccaccacacttggctaatttttgtatttttttgtagatatggggcttcaccatgttggccaggctggccttgaactccactcctgaggcaagtgatctgcttgccttggcctcccaaagtgttgggattataggtgtgagccactgcacccggccacttttgtgtacttctgacaccacctggaacttttcctcccactccaccttgaaaagatcctgaaatctagatttcagccaaatcagaaatccaatgtcaaatccagaatcaacataaacaacttaataacaaagacaatacggaaacagccataaaaaaagactctctttgcaaatagatgtaattctgttataaaaagagttttttccaattacagttcatctaaggacattatactgctaatcaggaaaagataattatatttactttgagaaggttttagatagccttgttgttctattgctgcttaattattttaatagattaagagggtgagtaggatattagcagcattgtagagagagtgtataaactctgttggctgagtatagcagtaataattctgatatgatgactgtgtgtctgtgtcatttgtttgcaacttatgccactaatttttttttgtttttctgacgtttttaaatttacattagattctgattttgaagtgcaaaggactgtttttctccatgaaaactctaaaagtcctttacatcgatttgtcttgtctgtgtctgtttcagaggacagtgctgctgtgagtttgacgaagtggacatcacctgcagtcagtccagagctgcccagtgagtactttaccgcctgtgtggagagtctttggttgtaggtttctagaactttcagtctgtaagatgaatcccttcattctggctgatgctgcttctgaaatgcctctcaaaactgattcacagacatcttccttgatgcggcagagcattaagcaggatctcccagcactttctaggttcaattttattaatttcactactaaccttgggcactttaccctttgctagattttctacttgctctctgcaatagtgttgcccgcatttagtaagcatcacatgtttttgaagtgatcattgtctacaattctttctggggagaaatgtttctgtgacttgttttcagtcctgtgcagattttgcttaagaagattcccactgatgtgaaaaatcacaactgtgtacattatcagcaaaaatcctccattttgggggaactaccaggggatgatgtaaataaattcttccagtgctcccctaatggttcattttacaaacttttaaagaaacgcaaaaaggggaactggaaatatctttatatggctgatttgttttatttataaactgtaacttgccaatacttgtattccagagccagaatcctagtgaatatgagacatgttcttttataatcccttgatcaaattgctgtttgtttatttatttatttttgagacggaattctcgctctgtcacccaggctggagtgcagtggcgcaatctcggctcactgcaacctctgcctcctgggttcaagcgattctcctgcctccacttcctgagtagcattacaggtgcatgccaccacgcctggctaatttttgcatttttagcagagacggagtttcaccatgttagtcaggctggtctcaaactcctgacttcgtgatctgcccacctcggcctcccaaagtgctggaattacaggtatgaaccaccgaacctggctcaaattgctatttttaaattgctgttacaagtaaagcatttggactatgtatcatttcttaccttcaggaacaagaggtcattttatagtaatggcgtgaaccagcaactttattgtttctcctaataggtcctcctggaggatctgttcctctgggctgttggcatttaatggctgagtgttttcctccagcgttttgcatatcatgtgagatacttcattatcttctggcagtgcccgtggctgattttcttccggcctttccatgaggggaaggaagaatcgcacaacctgacacttctctaagtgatcagtgtttaatgatgacaagagatatccagaaagtagatttattattgaatgttcctatctatttttagtcaagtgcgctatcttttactactccccaaggatgactcataaaccatgtcttagtaggcaaagaggagttggggagtaggagggactgaataattctctcgggactttaaatcagtgtggacacatcatctgcttttcactccttcatcacattaatctggactatccactttctctgtttaagagttgtattatccttaaataggtcatttttcatcagctgtatttataaatggttcctatgacgagttatgtgcttattgaatataaacacttgattcaagagtccaaaaaaagaaccccagcagagctcagaagttttgttaaatattttaagttcaaagaagaaattcctctacattaaggagtgtaaatgccatgcatttaattttacaaagccttggctgggcgcggtggctcacgcctgcaatcccagcactttgggaggccgaggcgggtggatcacaaggtcaggagattgacaccatcctggctaacacagtgaaaccccgtctctactaaaaatacgaaaaattagccaggcatggtggtgggcgcctgtagtcccagctactcaggaagctgaggcaggagaatggcatgaacccaggaggcggagcttgcagtgagccgagatggcgccactgcactccagcctgggcaacagagggagactccgaaaaaaaaaacttttacagaggctttggatggctccagatcctggggctgaaacagtacatgggcagtgtactctcgttctcacccaataggacctgattagacttggagccccagatgtcacctggtggttggttgcttatgttacgcttgcctttcttccagagaatccttccatatgtccctccatcctctcctaaaaataaaaccatttggcctctactctagcatcattcacttgctacatatcttgaattgtgagttgtttttaaaacactgaactaaaatctgattcttctataatatcttcccatactcaaaattggaaacatctaaactctggaacctgagcatttctggttttgtcttgaaatgcctgctttacttccccacacttccaacggtgagcagctctgactctatgttagttctaaatgtattttttaaggcctatttatatgcagagtaggcattcagaatatgttcttatttctataaaggcaaaaggtatattttgaatcttgcttatatgtcacgttcaatttagcttttttttttaaacaaaacaaaacagtgttggtcaataaactcctaaaatagaaaatatttatttagagaacaaaatgactgtttttggatgaattatcctcacccttgcattaagtgacctttgcattgggagctttagattggctcttgctgaagaggaatgccttagtttagtccaatcaaaaactgctttcaagtttcaggaaaagaaagtaaacaacccttgataacttctctcctgtggcattttagtttggaagatacactgttcttctgaaaaacctatctaatgttgggggtgctttcttccttttaaattgttttaattaaatattcattatagaccgggcacggtggctcatgccacccagcattttgggaggccgaggcatgcggatcacctgaagtcaggagttcaagaccagcctggccaacatggtcaaaccctgtctctactaaaaatacaaaaaaaagttagctgggcatggtggcacatgcctgtaatcccagcgattcgagaggctgagacaggagaattgcttcaacccaggaggcggaggtttgcagtgagccgagactgagccactgtaccccagcctgggtgacagacgagactccatctcaaaaaatgtttgtattaattatatacagaatttataacattagtgttaggcatgcagctcaccaaacttaatgttgacttttctttcattttgcctctactttagagccttactcattgtcctgtcttctcttacaccttggagacatagatatgttgtaccagctattagcatatttttttcttgatctaagatctgtggcctagggttgctgcagtgctctataggaatgaggatccttcttattaccctgtaaatactttagttatttcaaactcttgagtgttacagaagctcttatccatggtacaacaatagcaagcacaaaaacctgtggtttctttcacattttcttagagcacattcatgcatgccaagagtcgtgagatgagctctccagaagcagactgagaagaggatttctgcacaagtggtttatcaaggcagggctcccaggagaaactagtgagtgggggaagggaagggaaagggaagaagccaagcagggagatgattcaagcaatgtgcctgccccagcctgatcctgggggcagagttggggggtgcagtgggccgctctggaacataattgctccctagagtctgttccacatcaaggcaatggagctgggcttttccactcctgcatcagtcactgactgtgggcaggtaagagagggctataaacttccaagcacctctgctgtcttcatctgcatgtgaagcagcttcggtggttgaagaaggtttttcttaagaaatgttggtaccatcccttagcagcaaagcacacaaaagccgggaaagggcacacaagacgattaaagggacccagtgttatctgggcaggacactagagtgtctgctttaccaatccacattccatcttcctccttgcctcactcctgcgggcacatttttaatccttagcccatttcctggtgtaggttaagcactttcagaggctgcataggattatttttcctcctctgagaatggagtcagctactggttcaaagagctaagtcctaaagtaattgcagtgttgggagacacctaggtaattttcagtgagtagaatttctacatatattagagttttagaaatagaaaacttgacatttcaaagctttccttagtaaaatcatggataatgatttcagtgccctgaaagaagaggtgaggatgtcatgtgattgtatgattggagattattcttactaggaacatttccaggcacacaggttaacttcattattcttcattctcatctcttttagccatcctttattttatttcctaatagttcacctttgcctttggaagtattttcttttcataagcttttaagggaaatatatagtgtttcttgggcaccttctatttatttattttattttgttttattttattttattttattttattttattttattttattttattttattttattttattttattttattttgacagggtctggttctgttgcctaggctggagtgcagtggcttgacatagctcactgcaccctggaactcctgggctcaagttatcctcctgcctcaacctcctaagaggctgggactacaagtatgcactaccatacctggctaatttgtaaaattttttttgtagagatggggtctagctatgttgacgaggctggtttggagttcctgacctcaagtgatccttccaacttagcctttcaaagcgccaggatgacaggcatgagctactgtgcccagccctcttgggtgccttcgattcagtacagcacaaaatttcatgattgttcacctgatgtcctagaccagccaacactgtccaatagaaatattacgtgaacaacatagaacattttgaattttcttgtagcttcattaagacagcgaaaagaaagaggttacagcagcctaaactggaggctggaatgtccaaaatcacaggtgaaattaattttagttacatatttaacttagcatatccaaataattatttcaacatttaatcaatgtaaacattatggaggttttacctttttttgtccactgaatattttgtacttaaaacggctttcaagactagccatatttcagtgctcaaaagcaacatttggctcgtggtaccatattggccagtgcaactttagaatattatagagaaactctggtaaaaggccttattctgtttgaataagactcttagtcagtgcttctgaatctcccagcttggtaacactactcagtaaggaaatgaggcagcaccgtggtccagagagagtgagctgatctgtccttgaggtgctattgctacttccatttttggatttagtgccctgttgtacatgaattaggattaaaacatttaggtttggcagctcagatgtcactgataaccttcaaaggtcacttagaagatagtgggccttgaatggagggtagaaagtagaaaaattttaaagaggaaagggagggaatttcaatgggaaaaaaatctatatatgtatatcgtgtgttttgggggaggattctagaaaagtttgggtataatacttttatgcaaactcatggggctggagtgttacatatacaatgagaaaggtatagttagtggccaaactgataccagactcaaagagtcgaattttgcagtacatgaaatgagatatcaccatgatatagtatatacgttgggacctattctggttatttattgttgtgtaagaagtcacttgaagatatagtggctgcaaacaacagcagtcacctttttacctctcagtttttctgtggtcaggagttagggaagggcccggctgtgcatttctggcttgagttctttcatgcagttgcagtcaggtggcagctgacgctggaagagcaggcagctggtatggctcagcgtttcttcctcctcacccagtctcatgtggtcttttctatgtggtctctcttcatgggcagctttattctcatagcatggcagcttcagagcagggggacagcctgcctgggcttcagtgtgattattctgtccaaccaggtggaagcagcattgctttatgacttggccttggaagtcatgcatggtcacgtctatcacattacagtagtcctctcttatctgtaggggttacgtcccaagacccgcagtagatgcttgaaactgtgttaagtactgaattttatatatgttacatttcttctatctgataatcaagataactactagtggccaatgagtgggtagctagagtgtacagcatggataagctagacaaaaggatgcttctggatgtgagagattgcattgtgttcctcagaatgggatacaatttaaagcttatgaattatctcgggaattttccatttcgtacttttggactgtggttgaccttgggtacctgaaatcatggaaagcaaaatggcgtctgcccagtttcaaagggaagagacttatgagttcaactctcagagacaggagtgttgaagtcacaatgtgcgaagataatattgcaactatttttgggcaatatcatctgcctcagggaccctctccattgccactcctgtacccatcttgctctcttgagctgtgctctgggagcgctgtggtatgagcacagctttcattcccgggcacccttctatacagtggctctctcttctctccttacccagtaagctggactggacagtccttaacaaaatgtgaagtcttctgcttaggcactaaatggccaaccctggccctctgtttatttttcattatcttccttctttattgttagaggccttcccaagcagtgggcaaacaccaaccccagctgttctcctctcattttttaatttgtggagcaattgagagagaggagagagaaagagcaaaaacaaaaaggaggaagaattttctaaccccttactggtcttactgaaaagacttgtcttaccttttccacctaaggatgtcatctccagaagacagaattcttcggtttggccaactgccaggtttttctcaccatctttccatttctaggttgattctcctttgctctgtctcttgctgtccctggccaactgggtttctcttcccaaggtgattagaaggaaaggggaaaagcatggggccaacaccatgacctttgagagagaactttcctaacagttgctaagctcaacattctaccaaatactgttcgccctggttttcataggaaaatccctctcctttgccacaatctcatctttacctcaacatgggctctgaaactaggtgcatagtgagcattgacttgctttcttttccctcctttcttttgtgaagtcatactttcaactggaaaagattgaaatgccagctgtgtaagagtttaggtgaagcatgctgagttctgcaacttatttactatgaaatggattaaaaaatgctgatggatggatagaccgatgaatgaagggctagatattcaaaaaagctagtagcataaagtgttcattgtagaatctagctggtaagtatatgggtatactacccatatatatcacatagtatatacttacgctgtataaatatacataatattaatttttttcaactttgtaaaagaaaaagttagagaagagaagcattaaccataaattatagtagtgggatacatttgaaaacaaaatgttcatttcctacttaacaaatgcttaaggcttgtcttggttttcaggtgaactttttaaaaggttgtattagcattgttaattgttctaccttcagtttaccttcaaggtttaagggacctggaaaagatgtaacagtcgagtctagaaaaatagtctaaaattctagccgttgcccttagattttgtagtttctttgagcttgtcacatattgcttgtgagtatgctattgaagtcattgtattacggttgtttttctgtgtcatttcctgagggcctttgtggtggcaatagtaagaacttattccaaagataggatttcttgtttcctcacctgttccacacactcccatgttaaattgggcattctgaatcttttccagaactgaaatatggattttttcccctgcattgggcatgtttgctttgttttatctgcttctataagagagagggaacaatataaatccagttcagctccctggattattttttgatatatcaataaaatgtttaaagttattggaaattgttgcatttgaaaagttcttaactattttacttttctgaaatgaaaagaagagcaggcatcttgtctttgctgtcctcaggtgggaaagggcagcttgctgaggactgaagactaaaataaaccctcccaggagaggaaccggccggtgaccttggctgcaaccaccttgcagatcagctgcttcattcctttccatattttgtggcctgtggggggaatcaagtgtcacaaaagcaggaagagagcagtttgaggaagactccagaggcactgctggtaaaagtgctgacgtgatctcctgaccctttccgtatggctggaggactggtggttttatagtgaccattcaggtagctgggaggaggcaatcctcctgtgaaaaataagctgtaagaaactgttgcaacagttgtgtttttttatactcctcatgtaataataaagcggtctagaatttggatagatgccgttacatttttgcattggaggtatgttaaagagcccatactgagctaatagaaaaatagaagttaactcactcttctgagcaagtagaagtttattgaaaaactgaatgattttggtgatttttaaatttgtcacctggctggatacatcacagtgtggtgggaagaatgtgagctctgaaacctgggacctgggttgtcccatctgtaaaatgagcacagtattacctttttcattggttttggaagtattgacagggagatggtgaatctataggacttttcttattgcagatactgagaatcttcgtccccattttccttcctttcctatagatgctgatattataaaacaagattttcatgaggctcagaactaatttctaatgaattcacttattcctcctcttctgtgggcttctgctctttcttctgtacaagtagaaaggaattaagagtctgcaaggcaccgatgttgaggagctcactgtatcacattattctcattttgggacccttttcctacctaatagtgctctgtccctgggactttacacagtgacatttctgtggattctaatcattttaccttcccattagcaacagcaagtgttctgatttctttccatcctcaccaacactaattttttgttttttttgtttgttttttttaaattagagctttcttagtaggtatgaaatggtacctccttgtggttttgctttatattccctaatgactgatgctattgttcaccttttcacttgcttgctgatcatttatacctcttctctgccctttgcccattttttaagtgggttgtctgcttttttgatgttgttgaattcattgtaagactttttttttttatatgtactgggcacttgatccttttcagatatatgacttgaagatattttctcccattctgtagactgtcttttcattttcttgataacatcttttgatacacaaaagtttttaatttgacagtcaaatgtatctattttttctttttttcccacttttcttgtcatatgttagatcccttcatattttgttgttatatttaagaatccaagtttatgaagaattaccctaagatttacaccctgtgttttcttctatcagttttatgatttttagcccttatatttaagtcatagagccatcctgaatatgatgtgaggtaggggtctaatttcattaattcgcatgtagatatccagttgccccagcaccatttattgaagaaactattctttccaagattgaatcatcttggcacccttgtcaggagtctattggctgtagatttgtgggtttatttcttgattctaaattccattgcattgttctgtatgcctatacttatgtcactgacacactgtttttattactgtgtcttttgtagtaagttttgaattcaggaaatgtgagtcctctagctttgttctttcccattattattttggctacttggggggctcctcttgaaggaagagttttattttataaataaaaatgtaatacttttattattgttttgtcctgcagtgatttttcaactatggtattatagctcaggagaaagcaactccagtaaataatcatgtgattgcatatggggttattataggcatgctacaatccaagggcttcttttgcttaaagttttacattctagaagccctggaaaccttgatgagaactacatcagtggtattcaaagcaaagccagcgcacagactgctaagttaaagctgcttgttagaattccaaggggccatattccagcagccttttggaaaagagcaaatgtatgagcttctcatttgcagtgataactagacactgtcctgatttatgcatatgtttgcctgtactagttattgccttcaattatagaagcaattttgaaaacaactttctcttatgtaaaagaaagctgtgatacaggcatcaaaatcaggaaaaaaatcagaattgtgatgagagagagtaaggaagaaggcaggtgattttcctgggataagtcacatttgtttccagtatgtttgacctctagaccattcctttttgagtagaggagactatgtaggattttccttttggaaagaacttttgtctgtggatccttagcaactactctttaagcacttccagatggtctttaaagtcctcatctaatggaagctgagagattgttcctgggggttagggggtggatagaaaagggctttaactactggataccttgacaatgggaagctataagaaggagacacatgtatttttcagctgaccctcatcaaaatacaattagaagtaggtacatatgtgtgtttatgtgtatatgtgtgtttatgtgtatatgtattagacactgctgagcctagagcactgagtgaaacacttcagtaactataatgggagaacttcttggattagacaaactaaaggaggaagaaagaaatgggctagggcagaaggcccagggccatcttcatgggtagagaaggttgacttctgggcccatgcagaacctcctaaagctgagatggagagaatgctgagaagcagattcctaagaggcagctgatatcaacaggcctgactcgggccagccagaactcaccactaggtccttggtcttcatggtttggcaggagcttttggcatcgctgtgaggataacattctcatctggtgcaaacaacaaaataaaacaaaccccatgctcttagagagtgcctaagacattgtgagagtttaataaatgatagctattatttttgtttaatatacaaaaagagtggttcttaaaggtcatcccataaagcagccttttttaaggatctccagaggaagtgtggactacagtctcctgtctgattcatccactgtgagagtttatttccctacgggcgtggaaggactagcaacactaaaatctcattaaacgggtacagaatgaagctgctttcagtggatgtgtgctttcagatctatcacaagtgtgagtagttgtcattttttagccactaaaattgattcagaaattctgcaaacaaaggaaggattttaggatgcagtgcagccagaagaaggccacatgtctcctgcttgtgctcagtgcctttcatggaggttattgtgcagtatggaaggtcagtaaccaaagtgcatgctgcagggagaaataccaaactgtcaacagggattccctttcaaggttccattggagttggaagttttacctctttattttatgttttctcaagatgtggtgaacttattttttttttatttggtaccttttaatacatctaaaaacagtttttacaacaaatctgggttctttgtgtttaaaacttttttccttcaaattttaagttcaggggcatatgtgcaggatgtgcaggtctgttacataggtaaacatgtgccatggtggtttgctgcacaagtcatcccatcacctagatattaagcccagcatccacgagctatccttcctgatgctctccctccccctacttcctgccctctaacattttttttgaaggttaaaaaggaattatcagagtgattatcagggaaaaaagctgggaaatgtattacactttttttttccactggtaatgaaaatgaactaggactgataacaaaataccatagactggatggcctaaacccacagttctggaggccagaagtccaagatcaaggtgttggcaggtatagtttcttctgtggcctttctccttggcttgcagatggctgctttctttctttgtcctcacatggtgtttgctgtgtacactcacattcctgatgcctctttttgtgtccaaatttccttttcttataaaaacaccaatcacactggatttgggcccaccccaacagccttattctaacttaataacctctttaaagatacagccaaatacaaatacaatcatgttctgaggtacttgggggttaaggcttcaacatatgaaatttgagggcagtgggggataaaattttgtccataataagcagtataggggtaaaggagaacataggtaaagcaggaactaagaaccagaaaagtgggtcaaagttcagggccatgaagttaagaaaaagttttaggaggggaatctgtagactgaaaatggcaaagaaaggatttccctgactgaccagtgtctcagttggctttcacaaaataacaaactaccctcaaaatttagtggcttaaaacagtagcccctcatttaactcacaattcactgggtcagcaatttgggctggccttgattgggaagttcttttggtctccattgggctctcttatgggtctctgttcaactgccaagtatgctgagggctgggtggtgtagggtggtcttagctggcatggctcatttcttctccatgtgtctcttgctttcctgcagagtagtttgggcttgttcacatgacagcagcaaagtacccagagtacgagagcaaaaccatgccataatttctgccacaattctattggccaaggcaagtcacaggccagcccagagattcaagaggtgaggaaatagacctttttaggtgatggctttaggagacaaggattatttgactgtcaaagtcccatggcctattatattttatattaataacagactttgcttatattcatgtatcagagaataataacctggaaaggaattacaagcgtatttatttatgggtggtacttctgtattcccaaatttggagacatagtttaatcagagcatttcttaacaacgttggttggcttttattttcctgtgttgctttgtcatccagaacactgggagagatcctaggagaactctgggtgatagtttccattttcagaagtctgggtgatagttcccttttcttcccatatcttactttgaatgaagcctccatggatgaggtagcccaggggaaacctccagctattatcttgtggggttaggtcgtatgaagctcttacaggagaactgggtctttagggtgttgtgtaggggggtaacttaggaaaattcagccataacaccttatacaggagattatgctgcatataaaccctcttggagagagctgccaccttcttgctgtattcactagtccttggtatccacatggggctctgttaagggagcccccccatctaattagttcaggtgttatataaaacatgatgtatatagcagtgctccttagcctcgttgtgggatagtgcaccgaatttctatggagatggggaagaacatattagcattttatagggcagagagaggaaacttgtgtgtagagtctgaaaatttcagtattaaagttttatatttggaaagcaatcataaaattttcagtacatttacataaaaaacatcttggcagattcttatatagttaaacatatactaaccatatgactccagcaattttacttctaggttttgtttcccaagagaatgaaaacttacatccacacaaagactcgtaaacgtatgttcatagcagctttagtcataatagcaaaaactggaaacaaccaattatccgccaacaggtgatggataaaaaagttatgatgtgtgcatgccatggagtactgcttagcaataaaaaagcaataggtcattgatacaaacaacaagttggatgaacctaaaaaacattctgctgggtgaaagaggcacctcacaaaataataaatgctgggtcatttaatttatagaatgttctagaaaaggcagatctaatccatagtgatagaaagcagatcagtggttgcttacatctggcatgtgtgtattgaaggagggtgatgacaaaagagtccaaagaaacttttgggttgatggacaggcctctaatatcttgattgtgatgccagttagcatagatacattttattgcatatagcacataccttaataagtttggcaatttgggaggaattgcctatgtttcttgtaatgcaaggcatcattaccctagaacaatataaaatctttatgatcatcaaaagggaacatgggtttgattaaagattaaagctttgatctacctttagtttagggattattcatttgtctctaaattgtctattgttgaaaacagtgggcaggaataaacaagaaaaccattcagagtctcatcatattatatacctggctcctgtgactaagccaatatcttctaaattaaaaccaaattttaggaattcttcaacagaagtatggaaacttcacttatttagttgaattatggtagctacagctgggtaaagtttgtaggtaattttcaacatttgatgcagtgcaaaggactaaagatcaggtttatggtttatagatcatatgtttatgtcaatcaaatattatttctttgatgaaaactgagtggtacaagtgggtaaatttttgtgtatgctatgtgagttctggaagagacaaaagtaaataagaacaggagaaaaatagtcccttagaattatcaaaatcctattttggctgttcagtctccgatagtttaaaagataaagctgagagaaaaaatatgattgtaatatgtttatttgggttgaatgcttgatgtaacttaggaagagaaacttctttgcttttagcatcaaagagtttattagttcccagatgtcattcattccccagagtgctagagacagtgatttatattgtcaaaggctgacaatgccaaaatggaagcagattttgttttacttcttaagccaaatcatagtctagttgaaattactcaaatgtatctcattttagtttcattttgataatccaaaaatgagtttcagatttcatcttctaaatgttttaatgttaaatgataatgataatgacctaaaaaaattttatgtttccgtcctcattagtgtttgctaaatagtcacttttttgtaattttttttctgtcatttgttcattcatttagcaaatatttattgagtgtctaccatgcaccaagcactgttctaagcacttggaagagagcaatgtacaaagacacatccctgatctcataaaggaacattttctaatagagggaaatagataataaaaagaagtaaacacgtgaaagaacaggataatttcatgtagtgataaacattaagaaaataaaaggaagtggtatggtagaggctatggtaggataggtgattcatttggatttatggtcaaagaagattgtactatgaaggtaatgtttgagcttagatccaaatgatgagaaagagccaggaatgtgaactaagagtaccactttctagatggaggcaaaagcaagtaagtttgcttgtaaataaggttgcaagtaagtttgagaagaacttatgtttaactaacagtggccagtggggagcaagtggtagattaagtcagaggggtagacagcagttagatgcatgatcacctttagaccttcgtaggaaggagtttttaaaattgttgatgtttcttgtttgttgtttgtttgttttaaatggaatgggaatttatcgataggcatgctctgatttctattttagaaaatcactgctgcagtggaaaatgaattgggagtgtacagttggggataaactggaagcagaaaagccagttaggtagctattggattaacacaagagtaaaggcttatacctaagtgctggaggtggtgacgtagagaaaataagcaagtttgggaactattttcaaggcacttcagcagcagatgagttggatacagatggtaaggtgaataaaaaaaggcactgaggatgactcccagggtgccagattgaacaataggtaggaaatttactgagatggaaaagactagaggaaaaatatggataaaaaatcaaatgttctgctttaaactttaaagctttgtatgcttattgagtgtttgagtgtaaatggcaagtaagcagttggatatatgagtctggagcagtcagatccatgagagctggggatgcagaagtgattaatggaaatagagacagcctctaaagctttggggccatctgtgatcacctaggaagagaaaatacatagaggtgggtcactcaaacatgtagaggttaagcaaaccaaaaaagatcaggattgtggacaagtggtgggtgaggtcaggaaaaacttggagattgtagaatcactgtcactaagaaagagaatgtttcaaataagagagagtagttcattgggtcaaatgctgtcaagatgattgatggagtcagaaaagtgatggttgaatttcaaaacctggagatcattgaggaccttgacgagaggaaagaagaattgtaattcgactggcctgaggaaaaaggaaggtaaggaactgaaattttcataggttgacacttgtaagatgttggattgggggtaattttatcattgagaaagggcataggaaaaagaggctggttctttgaggttactatatgatataatcattttagagagtggaaatgtaaatacccaaagaagggttactggacaatgcttgagtgttcatttgagatttgtcctcatgcatttaaagtaaagaccagtttgtttggccatcagttttctccagccaaactccattactgcagttgcttagtagagaatgaagtgtaaccatgtttggggaattaacaaagcaagtattctggaaagagaatgaggcaagggagtgaagagtggttgtaagatgtgatggacaatggaatataggatgggtaagaaggaaagggacacctaaggactgtgatggataatgaaagtgtggtagggtcagtggagtgtaggcctcagattggtcattgatggacttggagttctaatagagaagaggacaatcattgggcagggaaggggtgcttgcatctgattttgaaaggaagtacagttgctggtgatgatgatgtcaagcaaatgcacatagacatggctgactgaagttgaatggacaaatacacaattggaagttaaaaagtcaagggtgttgacctcacctgtgctcctgttaggccataaatgttaaaatgtattgatccatagtattatagaaaaatgtataatagtgtctgtttcctttgactgtagttgatgtaaactgactctttttctgtagtggacaacaaactatacatattgtagcctcaggcattcagaaagactggtctctttccaaatcccgctttcaaaaatctcagagaagacaatgactcgctcagcattgattgtgaggcctctgcaggagcagtcagctctgactggcagaattctcagatgtagaagtgggttgttgggcagataatcctgtaaatgccccttgcagacaccagctggtttacatcaggaagtgagtaagaaatgcttgggcaagacacacttcatgaaccaactcttattgaagagggatgaatgtaatttaagctccacagtcattgtttttggcatcttcacgagtggtctggattttgttattaacttacctttccggtttagctcagcaggaaacttagcaggctgtgattgtctttatctattccaggccagatatctttgttgcctagatgccttggcttgtctgtgatttgtttgtttataagagttgtgcaaatcataaggggatagcttattggatattcagaaagtgaatgagcccaggtaacctgataaagaaacaggacattcccaatatgcgggatcccccttcagggctttccatggtcaccatcccttccctaagcgtaatctctttcttgactttttataccttagattaattttgtctcttgatgtcttgatgtttgtacaggaaaatctgcttatggtaagcaggtactctggcacagataaaaccaagaatgtttaagtgacctataggttagtgcttcctccaaggcctgaaatccttgctgttctccacccctccaaccctgccaaccgccgccttccagaacaaggaagaataaccttatagcataaagaactactttaccttcaaagtctgctggtaattatgtaatgatataaattgataggacacaagatcttttcaggcttttccttttgtgtgcgtgtgtttttttgcaaatacgactctctggaacattcatatcaagagtcctgcagagaagagcctacttagactgagcctaattgcacaaggcagtgtctaatctttcgtgtgtgtgtctgtagtggagacctctctcctgataatggtaacagatgctgatttttaagtgctgtctgtccttctgcaacagatcagtgctgggagatgtcagacaccaaggcagagctttcctggactcattttggattgatgggagaggcacttatttcagacaagcggtagcattctacgtgagtttctatggaaactaacaatgtcagatgagatcaacagctgaatgctatttaatccaaaggcagcttaggttatgtgattttggataaaagttgtcctgtaagaaacaaaggaaaagatcatttctttcatgggaacagacaactgaaatatgatttatttacccagccacatacagattactcttgttatgtgttgaacacataggacatcatgacacctatgtgataggttttattctaataacttatctaaatgataccttcatgatactgtgtcacagaaatacagattgtggaataatgtgacattctcccacaggtcttaagagagaatgaatgaaaaaaaagacggcttttctgtattatactttatttttcctcacttttctttactgttttatttattgtggtataattcacatgtgggaaaatgtacaaatcctaggtcaagacttttcatatgtaggatacccatatcaccacttctcagatcaggatgtgtgtgtgtgcatacgtatgtttaaacgactatatgcttgtcacacacatccacatcccccaacccacacccccatatatcctaatctttattagctgcagcatgagataaccaaagtgaagttattggaggaaaggtgggtgatgaagattagattaaagcagcaatggccctgaatgaaacgctaaggagtttggactttttctagtaggagcttgctcctcaaggtattgtccaaggaccagcagcatcactgaggagcttgttagagatgccagatcttgggctccacctgatctactgcctccgactctctgggatgaggctcagccatctgtgttttcacaaacttgccagggatttctgtgcacactcaagtttgagaagcatgacagtagaccacagatcctgagaacataaaccagtagtgctaccaaagtttgcacaagaaaagaggaattttaagtggtgttaatagatactttgcacagaagtgaaatgctgaactaaacacagttagacacttttctttaccatgacattctcagaacccagagtatcctgatatagattgtgaatcccctaaagggagttatagtggaatctttttttttctttcttagtattttttataagaaccaagggaggaattaatattgcttggaactttggagacacatcatggtgggcagtgacaaggcagagaaagcttttcattaggagaggaatggagtagcatgatgaaagcagtgctctgcgaataatcacgtagaggcatgcaggtttagaagactggcctggttagggatagggactgcgaaagaaggaaatgattaacttggacaccactggggaggctctggagttttccagagcagctggaaagagagttctgagcagctggattagaatggtgattctgagaagtatggaggtatggctgttgtaggaagaactaggtgcctatggatatagtgccagcatatactgttttaacattgaactctgaaggagttctgttgtcacttcaatacaagcaaacatctcatggcccatgaacatggtttcggaaagaaatagtcctttgccaacagcctgaggttactgcctggtcagtgggtgcaggctgctgcacaggtgtgcactgtggaggaggaagtggagttgacccccccccgagggacaccttatccatatgtgggtgtcatccttcagcacagcaggaacactggtgaacagcatagcctttgatttccaaatccagtcttatcatttgagtcctttctgatatcacgctgtcaccaggcaaggccacctttctgggtggctgctgtgttgactgattttgatactgcaatacctgtgtctgtgattttccagagcataaaaggaaagtgggcattgttaacagttcctcatgactgaggcttttagtacaattttccatgctgtaaataaatgatgttactcaaagacaattaggttatatttgagaaactttctgatttgtatcaaaaagtaccctcctgtgcctctggatagccaattgggctggacctatgttgaataattattcagtttggaaagtataacattttagattttttaataagagtaatgtatgcacatgtaatgagatagatcaattcctgcatctccacttaattttttggaggcgatcactatagccgtttctgtttttaattcttatggtggtcattgctgtaatctaagttaaatcttcagtcttccagtactcagttgatcagttttaatattagctattgacttacttaatgaataaagatttatataaactacaatcttgattttttgatacttaccttactatttatagttctttctgtggcccgtgttagtttaaatagcatttttctgtatcttattcctctaacatttgaaggtctgtcttgactccttaccctgtaagatggtggtatttgctccactatcctctcttgaactttcttccttccactcccacttcttaacagtcctcttttacgttgtcaagtatccaagcattttctttgtcttattttttcatatcttacatcatgatagctttcccatgtcagtatagattgcattataaactggatttcaatggatatatcctgtaggggagaaaaagcagtatcttttccacacccatctcacagttcatggctgacccctataacaaagacagattagcaagagaaaaacgtaacaaatttatttaaccaaacctttctgtgatacaggagtctttggaaatgaatgcccaagtatccagggaaaactgtatttttgtggacagttgtgctcaagtatgattgaaggatggaagggtacgctatcatcgtatgtattagtcagggttctctagagggacagaactaacaggacagatgtatatataaaggggagtttattaaagagtattgactcacacagtcacaagatgaagtcccacagtaggccatctgcaagctgaggagcaaggaagccagtctgagtctcaaaacctcaaaagtagggaagctgacagtgcagtcttcagtctgtggccaaaggcctcagagcccccggcaaaccacagtgtcagtccaagagtccaaaagctgaagaacttggagtccagtgttcaagggcaggaagcatctagcacaggagaaagatgaaggctggaagactcgcaagtctgctcttccatcttctcttgcctgctttattctagctgcgctggcagctgattagatggtgcctgcccagattgagggtgggtctgcctctcccagtccactgactcaaatgttaatctcgtttggcaaaaccctcacagacacactgaggtacaatactttgcatccttcaatccagtcaagttgacactcagtattaaccatcacatagtaataaactggggtgaactcagcaaggcctatttgttcagattcttcttggtgtctgtacagaggagtagccctctggaatgagggtcttatgacctactttcaggggaggtaggccgaagaattttttttatgaccatgcttcaagggagagaaatgagagaggattagagagtgacctccaggtgccatattttggggtagtgtgttctgagcccaataatgatacctagtgttaagtaggtctcataatttttgtaactatattatttctctctgctcaccttctgcccagttttccctttcattctctctgtaaccatcgtatattgtaaataactttacaacttcagccttctagcctgtgaattttcctaactattattgtgttattgtgttctgtgctgtgtctgagcttgattttttcctgctattccctgcgccagctccaagccatgcccacttcagttccctctgggcatattctggtctgtagcattccctgccttggtctctgattgcacatttgtccttgcttttttgtctttatcttctattcttgtttgttcttgaccctttctcttctctttggttatctgtcagttctctttgttattccctttcatttgattggggggttgggaggatgagagggaaaggagagagggggagatgagtaacaaacacagaagttcagtccaacaaccctggccacttaggtaaaccgttgtctgctctgatggatcatggtacacaccagaactttgttactgcatttcctggtggtagcagagatctcaattgtttgatttgcagaaatcctatctaatacattgaatcagtcatatttcttcttcaattctctgtctccaatggtttagaaggaaagataagacctatggaaggaatatttaggctcagttttctttgaaatgtatgcaaaactggaagtaaatgaaaaattaatttgtggtgggtttaggtttattgcttaactacaaaggaaatgcttacttgaatgaaggcttctctgatttctttgttaccagtaatgattttatggctggggtaaatactgttacctttctcccctttctctatttatcttgcccatttacacacctcccttgtacttcctgctgtcagagaagctgaaatcagcaaatctgtctgtagatcattttcttttattcctctgatggcaaaatggtaacaacagaggcatgcatgcatacacacacacacacacacacacacacacactcactcactccaaaccacacaagagaaaccaatgaaccaaaagcagaatgggaaacaaaattggcaaagcataaaagaaaaggaaatgaaagaaatgtgataattgttgaccaacactgaatataattttccaagtcaggatacttgtgtgatgaatcaccagatgcattcaagattatgtctagagtagcaatggaaataggaggctttaagccaagggtataacctgcaggagccaaaataaggagagctccttccctagagagcaggtcatgggaaggcaggcaggagccttgacaaagtcagtagaatcagagaatggagctgaagcatgaccagaatgtcagcataatcaactctccagaaccttggtttatgacaataaacatttatttttggtcacaaattaatgggtcagctaggctttttttgctggtttggattaggctcatttgggcttactcatgcatctgtggtcagctagtgggtcagttgggggctggccaattttggatcacctctgttgggacaactcagctctgttccatgtggcctctcagcctctatcaggttagcctgggcttgtttgaggcatctgaacaaggttccaagagaaggagcagaagcatgcaaggccttgggaagtctacatttggaactgcaggtgcaggtgctgttttctcattctgttggccaaaacaagtcccaaggtgaaccgtagagtcagaatgggaagagatgtcaaagttacaggacaaaggccaagcatacagggaggttattaaatggaggcatcaaagcagtctgccgcaagctgggcagttattgagtcagattcatgggtatggtagactccccagtgctcgcagagtggaggaagttcagagaataaaacagaaagagtcattatgaagagatcagctttaaagaaggggatttgggatagaaaacctcacaggctccttcctaataacaaggggcaagttccttcagggcaaatgaaaacaaagggatggctcctttgtcccttgacaagcttgcctcagggtgataattcatgtgagcaataaaggggaccatttcatctgggggaatctaaccaatataagcaatggctggaccttcttaaatttaggcattttctgatttactaatagggttgagataaggggccctgaatgtccaatggacacagatgagactctcatgcccttctcttggcttaggctgtttagctggggattttacaggattggaggtgcctctttcttgtgctttaccctaaatcagggaattagagtagtggttttcaaagtgtggaccctggatgagcagtatccatgtcacctgacaacttgttagaaatgcagattctcaggctcaccccagacccatggaatcagaaactgtaggagtgggatctaggcatctgcgagttaacagccctccccaggtgatgttgatgcgtgctcaatttggaggcagctgaattagggttctgtgtggtattgatgggttcaaagcccatcaaagaagtggaatggatagatggatttagcaaataaaaaatacaggacatccagctatatttgaatttcagatcatcaacaagtaaattttttagtgtaagtatgttccatgtaatatttgggatgtacttttaatactaaaacattatttgttgttgatctgagaaccaaacataacccaatgttctgtattttacctggcagccttggaaagaggtatagaaaaactgcagaaagttcaaagaacatcaagattgttaatagaatagaaattctagagagaaaggttaaagaaattaacttgatgaacccagagagtacagcactggtgggattaataggttggaggattttatttaaagggaatgctgctgagctgttcttcatgaatgcccaaattaatcgagaagaaatttattttagaaaaaggcaagacttcctgccaataaatgacttcagtgggggttctgaatgattctgtgattctcaaaggaggtcagatccatttgggatttcatgggattgcatccagccaatactccaatttgtgtttgtgaaagagcagtttagagaggcatttgccaacaggaggttggagcaggtgatttctcaaggctcttgatgacttctctgtttgaagctgcaattttttgcatccttcttttttgaaaagcgcatagccttttgattatttttcaaatccgaatgtatctggaagtttggttttttaaaacgtggatataaaggggaggcagcaaagcagaggtgttaataggatgctttaaaaccagaccgcatggattcaaatcccagctgtgccacttcctagcctcctgcaacctttggttagtttgtgcctcaaatttctcatctgtaaaatgggaattattgtgaactactcattattatctcataggtaactgtgaggtttaattgagcttattcatgtaaaatataagaattgtgcctagaacatggttagccttcatgaaaagttattttatattattaaggactagagtctctttgtatatcctggacattcagaggttgttatggccagaagccattggtgaatggtcagtcctatgacatgtatggtagaagcattgtcccttgtgagcagtaatgtcctgtccctctccctgatccctaatcttgaggtgttggttaagcttagagtgatgttattctgtggtcgtattgctgcatcctaatcatgaatcatttctctttctctactcagatgaactttcccacattttctagaaacccccaagataattgggtttcatttcccattgcatgttgaattcaattaaaaagctgtaagagaataccatataatgtggctgagaatataatgacatttccaaaatattttttaaggaacttgaactctaaatcaatttagttctgctagtaaggacagagatttagtcatggaaaaatattaatctgatgactagtttttatcaaaattaaggatcaattatgactagttactttcagaaacttagttttggagatgaaaacaagtgatttgttttctgaactcctgcagggaacaaaaaaaaggtaatattggccccatacaatacataatttctgtctacgtgtgattgaagtgtcaaatgataaatcccaatcccctgttagaaacaacagtttagtcagtctgttcaggactttactgtatgtacttgatgatcagttaagtaaagagtgtttaggtggactttttttgttgttttgctgaaaagtttaagtttgttctttaaatgaagttcccttttgaatttgcaataaatagtaggcacccaattttgcagtgcttgaattctgatagtaaatagtgatggttgttatttttcttttattaaagaaaatgcagtataatgcctacatcatggcttaaaatattaagtatttagtcttcttcttgagtctgtgaacgctgggcagttctgagcaagtggaccaggcttgactgatctcagctatgctcatgtgtatgtctgtcagctgacatgttggctggtggctgtctgggcaagagcagccttctccttcacacctctgggagttggccagttgtaggttgaggatgggacaactgtgccatgtgccgcttatcatccagaaggctagcccagcctgttcatatggtggaggcaggagttcaggagttcaagagagacagagaaagagactggaagtaggcaaagtctcttgagagctaaactgggaattggcaccaagtcacttctgctgcattctgttggccaaaggaagtcccaaggtcagtccagaattttggggagtgaggaaatagattccacttcttgatgggaagaaccacagtatcacaagacaaaggtgtttgggggtaggccaaaaaagggctcacaaaatccatgtcaaatccctggaatctgtgaatgttaccttctatggcaaaagatgtgattaagttaaggattttgaggggaagagtttatcctggataaacagataggccctgccctaaatttagtcacatgcatctctacaaaagagaggcagaagaagtctgagtgagacccacaaagaggagagggtgatattaagatggaggcagagataggactgaagcaacctcaagccaaggaatgcttccaccagcagaagttggaagaggcaagaaatggagtctccccctagaacctctgtagggagtatggccatgccagcaccttggttttgtacttttggtctacagaaccaagaggcaataaatatctggtgggttttttttttttccagcctcccgagtagctgggactccaggcacatgccacatgtcctgctaatttttgtatttttagtaaagacagggtttcactatattggccaggctggtctcgaactcatgacctcgtgatccatccgcctcagcctcccaaagtgctaggattacaggtgtgagccacagcacacggccaatatctgctgtttttaagctgtctagttggtggtaatttgttaaagcagcccgagaaaactgatacaggtgtggatacagggagggataaagaattgaagacatttttgcaacaatctacatataccataaacttagataattttatatagctctttttcacttaatatgacaaaacatttattcatgttattacagtactgttaaacactattttgaataattgtataatacatactatatactgagttgatctagctgaacattttattgttattgacaattccttccatttttctgatgaagccctgtgcataaaaaaacataatctctatgctctgaatcaccattcagtttctcccttaccactatacataccttcaatggcaaaaaccacaattacttttgcaccaacctaatagttctgggaattgttataaccgccctgtgaatggtctcactctccctccagcagatgtacaaacccagctataccagatttgttttctgatgaaaaacacagttcaagttagctaaaaactttcaaagtttgctttcaaatattagttctttaatccaacacttaatactcctgtggtaatgttgtctaagtacaattgtcatatagcactttttttttttggtaaggctttggcatcttgaggacagcactgcttttttcaactttgtgtatcctaacatcgtctgccttggtgttttggaggtatgggtcactctgctatctgctgcatgatgagtgaataaaggagttaaaaaagggaaacatacttataattgtcttctcttgtcatatatgatcccagttattcaatatgactggatttgaactcgactgggtaaattgccttgttttagttgcttaggggagtcttaatattttcataccattgacccatttggcatctggagaagccttctcagaatagtgtttattaatacctagaacaaaacatataggattaccaaagaaatcagttgtattgcacaatagttcaaagtattatgaattgcaatatagtaactgtgtgcatctttatattaatacataaaataatatatagcattaggcctcttagttactattatttcaaagtagtgatgacagtacccagcatattaagatacttcaacatcataatgtgatattaagatatctgtgttttttattggtggcagaatcacagatctttttagtactactgtagtttgttgccaatgcccataattgaagaaaactctgcattttaatgagaggtagtataaatgaaattgtaactttgttttcattttagttcatgaattacctgaattctgtagaccgcaggttgagcacctgaaaagcttttttagaaatagctctagcctctgttttccccagttgtcatcacataagtttgattaaatattttgagtagtttatgaagttatgggtaggcaagacatttctgaacacttgcatgtataacatagcacctaagatattgtagacattatgtaaactctttttgaataaaaatacaaccctcttcaagtgcagatggaaaataaaaactcactcacttggacacatttctgttactaaccttcctgggtagttgttttgttaagtttagttgtttagttgaatcctttccctgttggtactaaattgataagttgcttgcatatagtgtagtctatgaataattctctttgatttttatttgttgagtttgttcccacttccaaaggggcttgaggtagattgggttctgaaacaaagtgcagaatagagcaattatgtaaacatagatttcctggaggtcctgaggaggcaggtgctccaggcacctggtgatctgatttccactcttgggcattgcactctggtctgatttctgtaggtggagataaaatgggaaacatttaatgcagcctccatttcctctcaatagaaattatacaaaaatattttttatttcttaaaaaacatttttctttcaaatttaaatagcctgtaatacctttcttcattttacaaagccccgacttacagcagcataatatttattaatagagttaagcagaatcaatgcatgtgtcctgtcacactgagaactgtagtattgtggacaatgtttctaatgtattgtgatcggttagctctcatgagaataagatgaatgtttatattacatatatattatatatctccatctatacccattactatatctgtgtatatatatgtatatatacgtatatacacataacatcgaaagtatgtgtatgtgtgtttatccatgtactgtgattaatactcatgtacaatgatgttcacttgaacgccagcatttttttatgtggttgatctttgcatttttctgtcttcaggccatctaaatcctctgactttgaggttttttgatttggttgaaactaataccaaaattggaaatcttttattacaccaggttaactcaaagagtttcttaatatgggataaagggatagtttgtaagattaggaataaatgtgataatcacttgaagttcctggagcatacatagtgttttgattattaattttggcatcgcttaaacatgttagaaataaaaagggccagcagccttttgtgtcagattaacttagtaaaaattacataaagagtttgcattatttatttctgttttctgtttcattgagtggaaaatttaaatctgacctactgactcttttaacacactgagaactatgtatttatttctaatttattgagtgtcagaaatatgtcttcaaattccctaaggctcaacttcaaggcaggttcctttatgaggttttctctcatcccctgcattaatttcctattgttgctctagaaaatcctcacaaatttagtgacttaaaacaacacaagtttattttcttataattctggaagtcagaagtccaaaatcactgggctaaaatcaagggctaaaatcaaggggctggcagagctgctttcctttctgggggctcctgagggggaccctttccttccatttccagcttctagcagttgcctgctttccttggcgtgtagctcccttctatcttcaaaaccatcaagtctttcttacaatgtcatctctctgtttcttactcttactcttcctttccccctgtttaaggacttttgtacctttgtgattccattgagtccacgtggataatctgggataatctctttattttaaggtcagttgattcagttgattagcattttaatgccagcttttttttttaattttattattattatactttaagttttagggtacatgtgcacaacacgcaggtttgttacgtatgtatacatgtgccatgttggtgtgctgcacccatttttgagacaaggtatctctctgtcgcctaggctggtgtgtagtggcacaatcacaggtcactgtggcctctaactcctgggctcaagggatcttcccacctcagcctcccaagtagctgggacatcaggtgtgtgccaccatgcccaactaatttttatttttttaaattttctgtagagacagggccttgctatgttgcccaggctggtctcgagctcctggcttcaagcgtcagtctcccaaagtgttgagattacaggcatgagccaccatgcctggcctcttaatgccatttttcatcttaattctcctttgtgatataacctaacatagtcacaggctctgggcattaggaaatggctgtctttagggaggtatcattctgcctatcacatcccctaaaccagaaatgatctatgtgtctttcataaggtgttagggaaacactatctcaacgtgctattattcacgtgcatgctttatctctcctttataatttaacctatgggaaagacaggaccctgtctatattatatttatgttctcctcagtatatagcaacactgaaagaaccaggtaaatattttttgagcaaatgaatgattctgtatccaaggaatgcattagttataagggagagaggtcagctatagaaagagagaaaaagaaaaaaggcagaaattgacagactattatcagcactactcataagagaatagtgtcttcatatgcaccattgcctctaagcagcaaataatttaacttgttaaagttatgatccacttaagagttatcctattctgtctcactataaatcagtattttggcacaaaaaaatccttcagccttgtgttggcttactaagaataagttccttgaagccttgcaagctctgggcatcctacctttatgaaagtgacggacacactctgtgatggatgccctgtgcagagagacctattgggtagccagcctgcacctgtcaggtggtacccacaaaccttccttaaactctgtgagctttacagcattaaaacacttctaaacacatgcagcttttctatgaagcactcttaagaacaaaggacagtgaatgaattcccctaagatgttcagaaagccaagatttcccccaagtattaccttaagactgcatatgagttatatattttactcccatgatgcatttgtatagttctaaatacataaaaattgtttgtttgttacacatccaggaagtgtccttttgagatgtgtgagcacatattcttaccatagttctgtaacgtaggcaggcattatttgcctgtcttgcaggtgagggattcaactcacagaatggaagtggcatgcccatcatcacatatctggtatgtgatgtgtgcaacacagtgagtaatgaatctagattacttcacctcaaactccatgcttattacacatttagtacctcacaaactacatctcatgtggcatcatgatttgtaggccatcaggtgttctgttaacttatgaactgaataatgcagcattttctaaaatgtgttccatgtcacattactccagtaatattctctgtgaagagttttgtaatcaacaatactttcagaattaaagagtgtgttagtatagtagtgactatgcatgtccaacagagaaatgtgttttaactttgtttttaccccagtgtcttccaaactgatatagccacagaacccttgctttctgccctcttgctattatctgttgggcaagggacaaatttctaggtcctggatccccagttgctcagtcatgattatgcatccagccatggtgtgcaaattgagctgttgttaatgggcaaaggttggctttgccacctggttttgttaggagagctttcaacagcaagaactagaatacctaagtcattttgtttgagcccttgctaatgaaagtgtggtcctcatatcggctgcatagatgtcacctgggagcttattagaaatttaggatttcagtccccatccttgattttgtgaaagggaatctgcatttgaacaaaatctccaggtaattcatatgtagtgtaacatttaaaaagcactgattttaaccataagaacaattattttttatctaacaagaaatactgaggtgaagcgttctattttattggcaactcggtagtggcatcaaggacctggatgcttgtctcctcatggtggtaaaatggctgccaaagctccatacgttatctcttcccccagctgcatttaatttcaggatggaaagaggcagaggcaaaggactttgttcttatgtggctccctttttttactaacttcttgctcagaaggtcacttgcagccttccccttagttcttacccattagatggattactggcaataataaatgactggcaataataaagacctcaattccctttgatcttgaccaatgttgtttaaaaaatacataatgctagccacatacataatttaacatttcctaatggccatattttttgagaaagcaaaaagaaaacaggttaattttaattatatattttattaaccaatatattcatactattatcatttccacatgtacccaatatataaaaattgtcagcgagatattttataatctgtttcttcaaagtctttgaaattaagtctgtattttatgcctatagcacgtctcaattcagatactaaatgttcatcagatattcttgatctgtatttagatctcataaaagtcacaattaaaagtgttcataaacctaagttgttccatgtaataattaaccagtaaccaaatcagtagcagattttaaatgtaaatgcaaattaataaaaattaaaataaattgaaaactgggtccatcacatttcacatgttcggtagccacatgtggctagtagctatcatatgagacactgcaagtataggtcctcactactcaaagtgtggtccaaggaccagcaatgtcagcatcatctgcgagcttgttagaactgctaaatcttgggtcctatgctagagctacgaaatcaaaatttacattttattttaatgcatattaaagtttgagaaattctagtctaagctgttctcaatcttggctctaatttagatttaatgtgggaactttagaaaatactgttgcctgcaccctatcccagaaccttggaatcagactttctgtagtggggtacaggcattcatttttttaattgaagctttctaggttattctaggatgcagctgtgatggtaaattttatatgtcaacttgactgggctaagggatatcagatagctagtaaaatattctgcatatgtcaatgaggatgtttcaggaagaaattagtaaagaagattgccctcatcaatggagctgggcttcatcatccagtctggggaagggctgaatagaacagaaaagcagaggaagggtgtgaatttgctctctctgcttgagctgagacatccatttcctcctgtctttggatcctgaagctcctggttctcaggcctttgcacttagattggtacctacacaaccttggcttccctcgtttttaggccttctggtttagacaggagtgacaccactggctttcatgggcctccacttacagacagaagattgtgggacttctcagcctccgtgatcatgtgagccaatcagtctcttgtaatacatctgtctgtgtctctctgcatatcctttcattctgtttctctggaaagccctggtaaatgcagctgctaagtttgagaaccactagcctagactaatcctgatccatcatctccaatcagacacactgtagcctaagcagtactatggtagaagctctcgggtgagtaaccaactgtgacttccccactgggttttgcttccctctggcctgtgcacatttccagcagagcaagggatccgactagaatcagctatacttgctggagttgcacattcttggtctttgtccattcactcactggctaactccttcctctccttgcctgtcagcagtttcctcattcttcaccttcctcgttctccaggtagcaaacaaggtagggctcctgctctgtgctgatacctactcagacccaatctggaaggccatcagtgactgccagtttctttcagctcctcatccccactcttgccccagtgaaaatgggtttcccttccctgttgccctgttcccgtctctttttccacttctagatggcatcttgcacacttccagtctttgtttccttcaggtgctcataattctgcagtcattttgcttattatgttttgcctctttgttgatgataagctcaaatgaggtatgcataaagtctgttcatagaaagcagctctgaatctgtgaggccaaacttagatgtgatttaatgaccatatttgggtacactggaagctgcccatgttcacttcccaggtttcctgaagatttagaaggtgcacatacctcaaaacataggcttgcaaatttacgtgcctctattgccagctggatctgctgggtttctctttggagaagggaattttagcaggacacacatgaaaaaataagtgctcctctgttaggaatcttcaactgagaaggtgccatcagtgcaaacaaagccatgttagagcaaaagtatgtttggtctgcccagctctaatagatgatgttcatgtcccttgggctcaagaacaaaggaactgcctgacagtcttttgaaatctcacctgtttcttggtagagaagcttctgtgcagtatacatttccatgataagtaactgctgtcaaatctaataagaagactaatctaaaatttaggctgtataaaagttaggctgtgtaataaataaaataaccggattatattaaaaaataactgtttttatttgaagactgagcacttggagaaatataggagttagccaacaaaatcaattcttcagcttacatttgaaaatgaagttcctgttttaagtgtataaatcctatgataaaaatgtctcagcctagaaaatgcaatttttgaaatgtaaagttttgatgtaggattaaaaatgttattgtcttggccgggcgtggtggctcatgcctgtaaccccagcacttcgggaggccaaggcaggtggaccacttgaggcccctaggagttcgagaccagcctgggcaacatggtgaaactctgtctctactaaaaatacaaaagttagccaggcttggtgttgcatgcctgtaatcccagcttcttcggaggctgagacacaggaatctcttgaatctgggagttggaggttgcagtgagctgagatcgtgccactgtactccagtctgggcaacggagcaaaactctgtctcaaaaaataaaaataaaaaaaattgtcttatcacatttacataattattctctaatatttatattgcaataaaaatgaatctggtaaaattcccttgaaatgtggggatgtttattgcaaatggtccaatggcttttcggagaagctccttgagaaatatccatatgattcaaattatgtgcagaacagcaaagtagtaaaagtatactatcaactttctagtattagaattaagaaatgtcaagaagaaccacctcaaattttggaaggccagagaaattttgattcttctgcaatcactctagtcagtaaaagagataaaccaaataataataataaatacacatatctagtaaaatatatatttatacctgctcatatagtgaagtatatctaatttatccaatactatagataagacatggatgtgttgtaccttgccctgttaatggtgcgctcaccaataatctcatcatcctctatggccctaggcagagttcctaatacttttgtttcatttgacagatttgaaaacactcagagaaaagcagtatatacccaaagtcataagaattgtaagattcaaagtcattcttcttgttagcttctgttcttttcactgcagtatgctgcctctttattccttgaggccctcagccaataggattttgtaggcgtgctgggcttttagacattaaagaactagccattgagttgaacattccatggtggattaaaccagcctaattaacttgtctctcctctctactacaggtcttcagtcttttttttttctttattctggaagcagtaaaactttgaacttagtttttttttttttttgtaagtttagcataaatttaatggcaaaatcatgcccaaaccaacagatggtaatatataatctttatttatcccacttagagtgaatagccatagatttcactccataaatacctatgtatttgataaggatccacaaacattttctgtaaatggccagatagtgattattttaggccttgtggaccataccatctctgttgcagctactcaactctgcattcgtagcatgaaagcagacatagatagtacataaatgaagttgtggctgagtgcaaataagtctttatttgcaaaaataggtggcaggctggacttggcccattgaccatagtttgtcaactgcctagactaaaaggtgatactcagatctgttgggactattgcataacatatatatatatatacacacaccatattacctttctgaattctgaaatatttcagacttgaagagtgtttagtaagggatcaagagtgtgtacctaagatttaaaggaagttttataaaggagaaagtcatctctattatggtcaagcattaaagttctcgtatacatatgtctggaggggcaactaaggttcagatattgctagtgcgttaatcaggaatgagttttgtgaacagcaaagcattggaacacatagcttctttgttgtcccttgtaacaagatcagaggtaggcagtccagagctggttcaagagctaagtgattccctcagggatccagactctgtccatgtttattctccagcatccttagttgatgagccttcaccctgatgctcattgtctcatggttgcgagatacatcctgtacctccagtgtcaaatgcacactcccagcaaggagaaaaaaagaaagcagggagaattgtctctcttagagaagtagaaacttacccctgcaaatctcgacattcctcttgtcggctaaacaaggttacaaggctactcctaattgtaaggaagactcaggaagcaagtatttttagttggattcattttcatcaccctgtaaaaacaggagaaaggatgttgggtgggcaagttgcacaccatctgctgaggcatctgttcttgtttggtggctgttatatttcgttacagatacttaacatcatattgtcttctcccttgaggaacatatctttttaagtatccccagtgttagcagcttgttttccatctgagttggaaaattaaataacattattcacatttttatgtaaatgttgtataatgtgcatatataattacttgagaatggttttcttcagaaatacattttcctattttcctgaggattttagttttggaggactttgtttacatgtgactctagtatgctgagtagcaaggcttgagggaagagtgaagttgacataaatggaaggcaacttgcacattgaggtttgtgggcaagtgattgttctcatggaggatgattccatctaagagcaagattttatgaactcagagaatcttaagaagaaacagttactcagtaactttcttaaaatatagatctgatacaggtatgagagaagagcaattaaataggcacacagagatcattttagttcttaacttgaatatcttgggatacttcctttcctcctagaggtagtatttattctgtttctggaaacagggcatgtaacttgctctttctttggtgtagactaccataataagaaaggatggaggtaactgcatgattttaattgtgtctttttgctttagtagaatgtcctaaaatgacacaagtgagaatagtgtgaaaataaatacattcatttattggttaagctttaaatgtgagtgaaattttcttcaactaattataatactaaattaattctagaatctgtttcaatgtagccatataattatgtagaactataaccctttattgcccagataaatcttgaccctgaaataatgtacgatagaccctcatctgctataattctgaaaactgcagtaagaaagccaaattttaatccaaatgtttcatggttctttgggcttccaagatgacaggctcatcaaaaactattcctgacttggccagaaatggaaagatcttcattttgatgggtacaaatgaagaagccacatagatacatatttggaccaagattccttccttttggcttcgagatctttcactaacaggactgaacgaaccagaatcaacagtattgggaaaagtagataactaaaatataaattttaacatgaacaaatttaccaactgattcagaagaaacagaaatcagagaagagatggaactttaaaataaatttaaattttatcagggagttgtggacagactcctatgaaaaggaggacttcaagagcaagaagggattcttggaaattaagtctgattgttgacttttaaaaacagcatattagctgaaagaaaagatgcagaacttttctagaaaacagaacaaagaaccaagagttggaaaaaaaaattaatgaaagtggagacattagagaatcattccacgtggtcctacatcttctaatagaggggaaaaaaagtggaggaaataaagatgcgcacacacacagatgttttaatttagcattggatcatcatctcccctgggcagcatgtcttttaaagtatctctagtgttagcagcttgttttccatctgagttggaaaattaaataacattattcacatttttatgtaaatgttagataatatgcatgtataatcacttgataagtgataagaaaaagaatttgagtggaccagtaactaaacacattttcacgatatttcagaatagcaaggaaaaggagaggatgttaaaagagtccagaaatgggagtggggtggaaagttgaccacaaagataatttctaggccgggcatggtgactcatgcctataatcccagcacttcgtgaggccgaggtgggtggatcatgaagtcaggagttcaagaccatcctggccaacatggtgaaaccccgtctctactaaaaataccaaaattagccgggtgtggtggcgtgtgcctgtagtctcagctactcaggatgctgaggcaggagaatcgcttgaactcgggaggcggaggttgcagtgagccaagatcccgccaatgcactccagcctgggtgacagagctagacttcctctcaaaaaaaaaaaaaaaaaaaaaagataatttctagaggactagaggacaagggaatgacttcatggtttggaggtaaaattattctgaacctgcaattttgttctcagacatactgcacatttaccaggaaggtgaaataaacacattttcagacaagtaagatctacattatttgatcaccccagatcattcctaaaagaattaatgcagtgtaagctcaataaaacaaaagaaggaaatatgggtttcgagaccaggtggaaaaactagaccaaggaatgcaataaaaaaaatctaagacaatagttatttggcaaatcttttaaagcagaacaaaaagttggcaaaattacaataggatttttggggaactcagaaatcctaaaagcaaatgacatttccctaacaggaagtgtgatgaaatggaatggtctgagtgagtggatgtagtttatactgtttaagagggctccttcttctcagtttttctttgttaatgttttttgagcagcacaactttagtgataatattgcatggctttctctctgcatttatacttaccacttgtttctgcagagaacaattatgtaattttcatattgtaaatgttattcatccaattttaaaaacgtgtaaaaaatagatagtacagaacatgatatcaccttgacaaagtaaaagtaataattaatggagaaaggttgggaagtagaaaggggaaaagaaatgaagagaaatacagggactctaatctgttattttacagagagaggatttaagagaaactcagtttggtgaattaagaaagagaggtttaaatacaaggctgtaaaagtcaattaaaaaacgaaatattgaaataaaactggcagagatggagagaaggagggaatggcatactgtggagttaaatgataatttctcagtaaacaaatcaagaaatagaggtttgagcatattatctaaagatacactcttcaacccagcatcccaaccatgtgtggttattgagccactgaaaggcagctagtccaaattgagataggctctaagtataaaatatatacccaacttttcaagacttagtatgaaaaaaaagaatgtagaatacttcaataatttttatattgattacatgaattgataatattttggatgtatttggttaaataacatttaatttattaatattaattttaccatttaaaattgttcttaatattactactagaaaatgtaaaatcacaaatgtgacttacactatacttttactgagcagtccctgatctagagatttggaggtacatttgaagaatggaaattagaaatgatttatgtgttcataccatcccagaagtggaccagggtgcaatgggaaaggaagagcctttatattatattttatatgttttagaaaattttcatactaaacactgagcagtttcaaagggctatttgtaaagtatatgaaaagcatgaggaatactatgacaacaaacacccttagtcaccacccagtttaagaaaaaataaataaaataccatagactttgaatgcatttcctccttctacttcaggctagtgtactgttttgattttcattttcttaataaacatagttattctctttttgtaaaaagtttctaattgaaggatatcttgtgtagttttttggcaggggttgttgaataatttgtcagtattaaattttagaatgtgtgtgccatttgatggcacagtggttccctttgagaaatgtattctgtatgttttgaaaaatgcagactgcaaaaaaatgtatagagtgacatcatgttaatttttaaaagcatgtatgtttatataattgtatagttatagatctacatatacatgtatatgctgacattgatgtatacatttacttgatatatatgtgtgtatatatgagcttatgcatatataataactaggactagtgcttgtgtctcagaagtcttattggattggcagaggagggaacttcatattcttgttttataaattttcagagagagagatgatcatagaattatgattttatttacttagatttgttcattttctgtatttttcaagtaaaaatcccttaaagaaataaaatacatgttgaaatatgttctagccccggagactatcttagaacagaacacattgccttagaaggtaagaagcaatatgtttacaaatgaaaaagaggctaagttgcatgaaagtattaaagccattatttttcttctctcccaccctaagtatattagtccaagaggcaagtgttcgcactttcaaagcaatactaaaattgattctttatcccatcctttcagtctaagacacttttaaagaaaccaccagtcttcctccagtgtgcttcattttctaacacagtgtaagaagcatgtgagcagatcacattaatgtaatgatgtgtgcttccagcaggacaatcaaagcaaaggggatgcatgaatctctctttttttttttaatttgctgagtgtagaccatgtataatttttgttaatgtttacttcttctctaatcatatatgtgcgtgtgcattgaaaagattttaggaaattcaaattccaaacaagaaattaaatacttacagtaattctgccatccagatataaacactaataatattttgttgtatttatttctagaatgtctagacatatacatataaccatttttaaaacttaggaaatatgctgtgcatatgattgtttttctcatagaatattgtgagtgctgtttcatggcattgaatgttcttcataagcatagttttaatgactgaattagatcattttagagaaatcaattaaaaatattctaagagtttaaattgggaatgaatatatctttgtggtgaggactgaacatacttcttcttttacttgactttgagtatgtaattgatttcataagtaaaaagataatgaaatgtttaccttgtcataatcaatagtgatttcctaagctgttaatgttaggtgaatggaagtcttcccctgtggatatggaagacatatccaaggacacattgttaatgagaacagactggctgtgcacttcgatactctccaataagtgaaaaaacagaaacttcattaatgaaaaatgacatggagctatatacccttgcattttaagacaaagatgaatctatattctgtccttgtctcaaggaggcagaaggttgcagattccttttggctgtgttgtttacctttaactaatgactcatttggcataaaccagcattatcaaggtgaattccacctgatccaagtctaatacatgtcatacaagacaggataaggtgatcattctggaaagtgggaatttggaattgtgtcttctatcgtcagttgaatgaatgggataggctgagctggaggaggaatgattcttttgggatatggggacccaagaacgagtgccatctgagaaccattaactttttttaaaaagtggaagatcagagacattcacaaggactataataagaaagagtatgatagctcaacatgagagaatagatgaggtagtcaggtgagtaggtgagtgagcgagtgagtgagtgagtgagagagagagagagaagagggcggaatttataaagagcatagctcccacctcctggatgccttctgcaggccagccacttgtctcccatgggttgggaagggagttacctgcaaaaggaagagcatggaggatgaggcaggatttcttttcacttggcatgtaaggatgatgagactggaggagtaggaaggaaggaagtagcttgaggtaaacagagttttaataatagaggagtttgaagagttgacactgtctggcattccatgaggaaacgaagactccttgtaaatgacttgcagaaggttacatggtttttcacaggaagctccaggaagctgcctggtactgttggatatggacatgaactatttattcctctaagatcctgacatctgagacaaagccaggatgttttatacaactctggactagatgtgttctctgatgaaaagtgaaactgcatcctctttgcattggaatttgcaggcactctctcaagctgctttaagtgagaaaaaggggaacgtattgaaagaacacaaggctgtgtccaggaatctcagagtaagcaggggaggatctaaaaatatgaactggaaagctttaaagaatccaggcagtgattgattttcagcggctctcttatctctgctcttccagtgctgtttttctctgcccttgtttctctgtatacatgaggttgggtgactgtcctagatatttacatgcctatttcaggcagctcttaactagcatccctgaagttcaatcccaaactctcaagagaggaagaagctgatcggctcatgtgctcagctttgagcacatgtccctccttggtccagtcagcactggccaggggcaagatcccagcacaaatatgggtgccatggatagcgttgtggataggggtctgataatacttgtcaaggaagaaaattgtgggctggagttctctaaaattgaccactacctaaaattgaccactaccctatgatatcttagcaggtctgggacaggggacatgatctttcaccatcactgtcttttcttttctaccaacaagaatatctagtcccttgctattgaaagtatggcccatggaccagcagctttagcatcagctgggagcttgttagaaatgcagactctcaggcccttccctaggcctattgtgttagagtcgcgtggtaacaagataccctgataattgtagagcactgacttttgagaaatgctaattagatggaggagagaattaggaaccaacacagaccagggctactgagatggcttcttccacaggtacctgtctccttttatctggcagctaatttgttttggccaagcttcagctaagagctatcccctgccctcactgagctcttatttaaggtgtttctgctagaaacttgagttcaggatgagctggagagagctgcctgtgttcaagagaaagatagtttttgtgtccatcttattgtgtattggtaccaaaggggtgatcagtgggatgaaaaaaggaaagagaaaagcagtaaaggtgttaaaatcatgtccaaaaggcaagtatcagcaagttcatttttaattagttattaccttgaggttacttatattcaatcattatactacacctgttttcacttctgcctctgaaagttttttaacgtctttaaaaaggcatcttttcataaagcttaagctctttgtgggctaaataacaagttttgatttaggagaaattactagataattctgtattaagtctatttagaatacagactccctcaagaaactcaccaggtagaacatctgtggcagcaattcagaaatccatgccattaatatttcggactttgaagtctaaaaagataaatttctgacactctaccttgcaggaactctgttttccttcattttctcttttatactccctaaaaggccctgggaactaatgtgtgtcctacaacctgccattattgttaaatcaatctgcttatttgcaggaacgctttaattatttagtaacctgattggaaaatccatataaattattttcttataaaaatccttactttgtaatagaagtgatcagatggaaataacaagaatttctaattctgtgggcaatcaggtggcctctctcaatggggcccttctgacatgaattcagaactttcatcagtgtttatgttgttggagtagaaatgtatagtttcactggatcatgttggaattgttgaagccaattgctgtaatgcacttgattttttgtgactaaatttctgtatttatcaaaacagtttcattttgtctggaaatgtaatgtccttttcttgaataggcatgtggaagtatttggaaatctttgaagtactgtttctcaacctgagctgcatattggaatcacctggggagctttgacaactactgattcctaggacccatctccagagagtccagagtaattgctctgggtgcagcctggactgtgggatttttaatcccttccctcccctgagattctaatgtgcaaccagtgtcaagagacatcatcctgtcgaccgtttaccaaacaggtgtggatgtgggcagacaggcttgtcaaaatgcgttttcccagatgccatcccaagacaacaaattcattagttttggggcaactccaagaatctgactatttaagcaagtccaagccccattgtgattttgatagaggaggcccttgcaccacatttagaaaccctttcttggagattatttctaaaaagagaatgactgggaccaaaatctgttcagtgttgtagtattagggaccatcagtgagtgattgaggtgtacttgaaaagatgacgaggctggggactgggcgtggtggctcatgtctgcaattccagcactttgggagctcaaggcagatggatcacttgaggtcaggagttcgagaccagcctggccaacgtggcaaaaccccatctctactaaaaatacaaaaattagctgggcatgttgccacacgcctgtaatccctgctactcgggaggctgaggcatgagaatcacttgaaccccggaggtaaaggttgcagtgagccgagactgtgacactgcactccagcctgggcaaaagaacgagactctgtctcaaaaaacagacaaaaaacaaaacaaaaacaagcaaccgatgaccagcagttatgtggtataggggcaagactcctggggtcacaacaaaataatagagttctgattctcacagtgttttcgttaccagttctgtggccctgggtatgacacttaatctttctggtgctgtttcccttcaactccaaaaagagggcttggagaatattaatctcaggtcctctgaagctgccatacttgattattctctgatggtaaaaatcttccattagcataaattcttacagaaacttctagcagtgctgttgatggatgccctgcctcagtgggtcaaaaagcatagtgcctgggcaagcggcagcatggtcatcttgttagaaatgcagattctcaggccccaccacagatttactgaagaagcatcttgggaatgggtcccagctgttttaaccagcccttcaagagatttcgatgcatgctcaaatttgaggagcacgcctctaaaaatagtacttggaaaaaagaaagttgataagtattctttttacctgtggtgaagagaaatcatttgctaaacatataaacatttaagactatttagaaagaaatgttggcaagcagcttcaagtggaaaggtaactgttaagagaaatactgaaatctacagccttgctatacaatgtgtggtctcctgatgggtcaacattgctatctctggagaactgcagaatctctgtctctgccccagatctactgaatgagaatctgcttttttttgttgttgtttgtttgtttgtctgtttttgcttgtatgtttgtttgtttaacaagctcgcttggtaattcatttgcagttaaagtctgagaagcactgttctagataaagatgttaagaccataatgtcagctttctcttacttttgtaatgtgtacctatcagtaaacattactgtgaggtgtcccacctcacacgtctgaaatcaaatccagtaaaaaatttttggccctgtaagttggatccacacctatatcaatttaatagttagtatctgttattttcattgtgttttacctgtttggggcttttaagcctttttaaaaaacattccttatggaaaaaaattgcttaatactgtcgctttctttttccttttcttcctcttttgaaagctgccatttcagtctgactccctatagtacttgaacatttttaaattatttttttctagtgtctgaccacttttctaaaatggaggctgggtagaatattgagggtttgttctgtgggtttgattttatcttgattcattgctacatttctatatttgtgtgggtctcaataaaattataaattagaagattaatgttaaaatgttacaaattataaattaagttaacattaaactgcaaaatgtatgggaaagaatccttaaggatctgcagaagaaccttctaaattaacagagaactagccttgtgcagcagtaccttaggatagagataggcaacctgagatttcacaaatagaacagagcaagtttatgataaaatgggtggaaatggagcacgacatactacgtgtatattcttatgtagcaacttttaaaaataactcttttaatcatttgttccctccaaaacttaggtactctctctagtcacagttcctaggtactgggaaatttattggcttcaaattatgagaagaaaacaacagtattaaagtgattttcattaaatatgtgccaaatatgacatttcttcaaccattttgtcaactaggacattatatcaacttgtaacttaaatcatctttatgacttatctataagctacatttgctgtgtgtgccttcactatgtttgctatgatttggggaatcaagaaaaattcctaaagctaggaatcttagaacactggccttacatggttaattacttcttttcttctgtggttattccatgtctatttttctgtttagaagtagaaattagtcaagctttttaaaataattattatttgtaataaaatatatcataaaagggcagtttttatttgatttttgaggttatttttctctctagaaaatcagttattgacctttttggggggttaaaactcatctgaaaatctcatgaaagctgaagaacctgtgcttagatacatgaaaatatgtagaaaaatatacattttgggctgaagattaaccttcagtgtcagtgctataatttgcatatttgtcccctcctgaatttaagttgaaacttaatctccaatgtggcaatcactttaagatgtgcttgattcatgatggccctgccctcatgatagatttatttgttcatggattaatggagtaatgggttagcatgggagtgggtctgtggcttcagaaaaagagtaggagacacctgaccatggtagcatgcctccctgaggtggcacagggcatcacatggcaaggaggctgagtgtgctaacatggttaggtgtctctttctgtcacttctatagagagtctccaccagcaagaaggccttcaccagatgcagctgcctgacttgggacttctccacctccataactgtaagacataaattccttttctttataaacccagtttcaggtattctattataagcaacagaaaagggactaaggcaatcaattaattcagtaaagacttttttgatgacaaaaacaaactagcaaaattaactagtatgttcaccacaggagttttaagtgagacaaaggtaactttttggttctcattgaacccatggctgggtctagggtcttgatcagtctgatcatacttggtttctttctgtttctctgccatgtcttctgctgtgtttggtttcatatttcagtcattgacagctccaggctgatatcccattattccaaacatagcagaataaagactctaatttcaaagtatctcaagtaaatctcagaactgagcttgtgaatcttgattgcttatatctgggtattttgtccattcctgaaccaagattattccatctccagctgtggtaggtcatagcccaagtcacaatctttcacttttagagtcagtttcacaggaacctcgggaactaacagcaggaaaaggaaggatttctagataaacatcagtgccctcttatccatacaagggggacgatgttaagggggaaagactatcaacatccactgcagaagcagaaatggtgttaagagacaaagactatcagcatccacaaccatgagcaaccactgttttagaggtaaagaaactatataattagcacaggccaactctttttttatttttataatgcccagactacatgcatgtcttaatcatttcttttatataaaatttctgtgcacctaatgagaaggtatttttagctacacatccatgacccttatcctcattgttgcatttctcctctgaaccttgtcatcacctaccttgcccaaaaggcactgcttgttttagccattgagcaaggtgggtaagcatattgaatttgctgtcatatcctccttaaaggtgcagcaatgcaggtcacatgggatcaaaaaaatgaggcttattcctaatactttaggctatacttgtgaagcctcatgggaagtttttctttaaacaagtctacagcacttattttaggcttaactaatctgattagttgttaacagaaaaggatatatttaaagtccacggatatgcaaacatttaatcagtgagtataggttttatgttctgtcttcatttatcagtgatgagagtgaccttggctatgacctcccacagctaaggatggaatgcttttggttcaggaatggagaagatgccaagacctgaccaattaggatgaacaagctcaattctgagattttatttgaagtacattggaagtggagtctttcttctgctagggttaatactactggcatattagcctggagctgtcagccataagagataatatgttcaactatgtcatcattccaacacagtgagcaaggactgagtgctactgaaaaatctggtaaacagaaggttgtttcactttggctatattttgctggatttaaattgaacgtttctgaaacttctgaataattctgtcatagaaagatccacgacagggaacattttataaataaactactcttatatcaacagagatcaaggcaaagaaaagaaaccactctaggtatttcacacaggaaagatttaatacatggggattgggtacttagaaaatggcctgaaatgctggtgaatgatgaggaatgttgtagccatcactggacttttgagttcaagagcacacccactgttgctatagctgctgtaatttcctctaaaacctgtatctgtcaaattgtgattgccaggggcagtagcagcaggaagatggccactgccctttaaatatttaagtgcttctaactggtgaaactcagatgcataggagtcttggaaatttaatgtttaacctcctggcctccctaaccaaggaagggtgggttggcaatatacagacaatccatagtacataatacagtattaaaaaaatgggttcccctgggattttattaatgaagttccttttgtattcaagagaaactacctgtctatgacagcttaaagtaatattaagcatcactaaatggtgaattaaagttttttctttttatttattttaaaaggtacaaacagtaaaattcatactttttgatatattagatttgacaaattcattgaatcatgttatcactgtcataataggatacagaacagtgtctttactccaaaaaattcttgtctgttgtttgtctgtattccagctctcttcccatctatacctcctggtaaccaaggatatattctccatcactactagctttgccttttccagaatgtcatggaaaggtaatcatacaatgtgtattgaatgtgacattagtagaatgcatttgagcctcatctatgttgttgcttgtataggtaatctatttctttttattgctgatcagtattccattgtgtgtatgtaccattcatgacttacattttgaaagaatcacatatttccttttattcaaactctccatatatttttaaaaaataacatggatattatgaaccctacttgcaacttcaaactcagtgttctttattgatgattaataaggttatatagtttaattatgattcctgggtaggatcaagaaaattagacaaatctcaagaaatttccagtctaatatatagatcaagtatgctacctagaatgtaccaagtgcccatttatgccacctcaatgagttttccaaaaaaaaacaaatattttttagatgaattatttgttgatttccatactatcatggaaagatcagtgaataccacccatattttcatttgaaaagatggactcatttttggccttattcacagacagcctttcttccagacaaatttcagcatattttgatgactcattgtagaaattggtttattatttgcagcaggagaaagcattgctagccaacagctgagaaaaagaaaaggttacaacattctgttttaggtctctaaaggccttattgggcagaatgtaatttccagctgtggattcatccagcctttgaggacttacccctgcctgttttctgaagtgttctatgattgttcattacctcaagttgtccattttacatcttatttgaaagcaggaccctgacagtgctaaactttctcaggctcagctgaactgtcagaggtaaagaaaccaagaagtttgcttgtatttattctaccccagacattctgcatattacattcattatctcacaactttatcaggtaggtagtagtgttaccaacatttaacagttaaggaagctgaagttgaaagaagttagttaccattcccaggatttacatagctcattcaagaatttttgaacccaggactctctggtaacaaagtttatgcttacaaccattttgcatttaagctttctgtcatttagaagacattgacgttgtcattactattttttatacatgaattatgtgcatctataattaagatgacaactgcttgtccagattacttatccctgtaaaaaaatgtttccgaacaatgtgaagtgtgagtaaataatacatcctgcataaaatgttttgtggatcaatgagatggcttattagaaacacttagcttcttccaagaagggtttccaaaatagcaaatgtagtagaattctttataacacttgtacctggagtcagaagtcacacgtaacatcagactaactatatcagttggggcttttagggttgtgctttttggattttagagggatgtgatttgacctttgattaagaaggcatcatggggctgggtgtgggggctcacacctataatctgagcactttggaaggctgaggagggaggattgttgagcccaggagttcaggacctcagcctgggcaacacagcaagatcctatgtctaccaaaaaaaaaaaattggctgggcgtggtggcatgcacctaatagtcccagctactcgggaggctgaggtaggaagatcacttgagcctgggaagtcaaggttacagtgaactatgaacatgccattgtactccagcctgggcaacagaataaaaccctgcccacgcacccccctcaaaaaaaaaaagagagaaagaaaatatcaaggtaccatggctaagaaggtataacaatttcttaatacagaactttgttgctgttgcaatgaggttcgctgtatcacttgaaaataatttgaagaaattaaatcagatcagggccttgtacctaaaacattacatgtgctttagtagtcataaaatatgttacgttaatgaggatgctgactggcaatcagaagtctaaaatggggcattactgacactttacatgctgtcatagttaataccatagctgcaggtctccaacctagactattgagggtctgggtctcaacccctatctcctctcctcccctcattcctcctccaccctgaattacatgcaagcctggacaatattgctttagcactttctaagtatattttatgttggcaagtcatatatttactcagttcttttgtgcaaagcaagtaagctaccagagctctccccttggggccattaatcaaattgtttttgagcttttctgctccccagggtggggacgtgtgacaaatttcttggtgagcatacccttaaaatgaaaagatgttcttgggtgatatcagacaaggtcagtttgttctttggtgtcatgaaaaggctctcccagtttgttcactgttactagtgaacttgacttaccttgtgagcttctggttacagggattttttttttttttttcatttcattttacctaccttggtacctagcagtgttggatatatagaaggtactttctatattttgtttttggaaaatactttaaagttacacaggagaaaatatatccatgtaattcagaggaggctggattcccttcaggaatgggggcattattggttttaatcctcagtatatacttattagaaaataaacaatgagttgaatgtttgacgtaggtcaagtagcatgcaggaaggataatcatagacctgcttttgcaaagcgtacaatcaagggtaaaagacttacaatgtgagaatagaatgatgtcactaccacttttatcattactcttgcctagtatgtatcgagcaacaatgaaacgtcagaacttcttctaagtcatttcaatattaacgcctttaattctcaaaacaacgctcttgaagtaagcactgtgattattcccattttacaaatgaggaaactgaaatacggagaggttaagtacttgctgaagatcacacagttataaaaggcatgcctgctatttgaatttttgcagtctgactccagagcccatacttgtatgtactggtcagatggaagaagcaggggatcccaaatgagcccctcacccaaagctgtgggttagagaagggtcccagagtcagtgacatctgtgctaagtcatggatgatgggtaggtatttgccaggtgaaggaggaggaagaggaaggtgttgagttatgttctgttcggatgataatacagactggttattatggttgcagtgtgtgtgtgtgtgtgtgtgtgtgtgtgtgtgtgtgtgtgtgtctgtttggagcagatgatacagatgctcgagccagagtatgtatgtctttgttaagccatgttattactaaatgtgggtttttatcttgtgtattgttgtgagccactgaagggctttaatcaggtaacatgataaaacttacatttttagaaaagttagttgggcttctgtgtagacaatgaaagaaagaacaggaggaagactgctggcaggatattaactaggaagctttgcagcagcccaggaaaggacggattaatacaaaactagagtcaggggaagacggggcagatgccagagagatccagggagtagaatccagcaggacttcgtaactgattggctggataggagagaagaattagacagaagagtcacatttagagtatttcaaagaaaaaaaaattgaattccacagttcttgctccaggccagtttttcattgttcttacagttcatttttctttagaaaggaaaaggcacattaaatgttaaagaaacagatgtacctgattttttatggactcctggtccatttgactttcctttctaatgctatagtttcttgagtttacactacttgtggtggcgaatactttcagtaaactttcttgtatgtcatctcttaaaaattgcaataccaatccctttaagttgccgtaaaaaagagagggcaatgcaggatgagagaaattatgcttgtcttcagtatcttaatgggcaccatactccttagatattaagactgaatctgacttttaccccccaaattatcagattctgaccctattttatttgcacatgtaaacacatgtttgggaacagcaaagttatttccatcagccttggacaatgcatttttataatggcaaattctattcttaaatatcccacatagggttaaagaggaaaatatcttctgtcctacgaaaaccatgccttgtgctttgcctctactctttgtttctgagcatcagaaactgtgtttctcttgagaatttccatctgctgataggttttctctatggttctagagagcagataaagatacaagtatcccttattatatgacagtcttgctttttctgtacagtacaggttttcaagtagtaaaattcctaccttgtttaaaatgtttaaaatctatactaattatttggcccctttcctctttgtcccttttcattttgtaattgtcattcaagtgtaagaaaaatataaccatgcttaagatacttgaaaaaatctttccaattcagaactctttgaatgtaatagagactctttagaattttaccatatagaaggaaatactgtttcaaccaccatatgaacaatgatttatgatatttcttattgtattagcccgttttcatgctgctgataaaaacatacccgagtctgggaagaaaaggaggtttaatttgacttacagttccacatggatggggaggtctcacaatcatggcggagggcacaaggcacttcttacatggaagcagcaagagagaatgaggaagcaaaagcataaacccctgataaacccatcagatctcgcaagacttattcagtatcacaagaatagcatgggaaagactgactcccatgattcagttacctcccactgggtccctcccacaacatgtgggaattctgggaaatacaattcaagttgagatttgggtggggacacagccaaaccatatcatttatgaaacagcattacctggtggggaggaaacaagtggcatattatcaaatgggacgctattattgcacaaggtcatgtggctgttaaatggtagagccagaactccagccttgttctgtgccattcctaggccctgctctttcttactttcataccacacatgtcattcctgcctctagctcacggccacagtctaattttttgatagggagcaattccagaaatgaagattcaaatcccaactaattctgttctactgaaaatatggcccatggaccagcagcattgagatcaccagggagctgttgatagctgcttgtttttggagtgcttattttgtccaagtgacgtgccaactccattacatgcattatctcatgaccttctcaaaagatgtgcaatgatacaatccttctttttccacagatgacaaaagtaaggataggaaacttattgaccatacttgtccagtgctgtacaaggaaaggttggaggtgaatttggacctagctgttctgatttcagagcttatacttttaaccatacactgcagtttaggatgcatgtggagctgtttcaggggagagcacagtagggagtgggaaggtgaggaggaaaggaaacggatggcaaatgtgtcacctaggtaggctagctgctgtaacaaagaggaccacaaacatgtaatggcttgaaaatatttatctttgctcatataacaatactgggcaggtgaaggggttgatgcaactgccacatgttttcgtttattcaggaatccaggctgatgagagctctgtcatttttagcacgtagctgccaaattcaccctggagtcaatgtagctagaaggacgaaatcaccaagaggaagggatgttcctgggaggatattttatgggccatgcccagatgcgatacagctacttccaatcacatttcatgggccaggactcaggtgtgggggcctgagaagaggagccagatgtgagtctcagacggggaggaatacctggattttactgagttttcaggaaatagtaggtcataagccgctattagaatcaagcctctgggtacatttttatatgttttattctttcaggctttgtgagagggggttatttatttcatttgcaaagcagtgaattgagatccagggatttgtccaaggtcacatggcttgttctgtgccattcctagtccctgctctttcttcccatcataccacacatgtcatttctgcctctagctcacagccacagtctagtcctttgataagaagcaattccagaaatgaagattcaaatcccagctattctgttctactcaaaatatggcccatggaccagcagcactgagatcaccagggagctacttagaaacctgcagtttcatacttgggaggctgaggtgggaggatcgcttgaacccagtttcaggctgcagtgagtgatgattgtaatcctgcactccagcctgggtgacagagcaagatcttgtctctaaaagaaaaagaaaaagaaatagaaatgtgcaatttttgtccctaccccataactgctgaatcagactggtcattttaatggggcccccaggtaatctggatgcacagtaaagtctgggaagccctggaccaggttcctggaagccagcttctccacctactgccgctatgtgactgtcatcttccttccgtgtgggagaagtggattcactgcatgttagctacagggtataaccactggagtaaaatttcagcctttttgaagagtaaacatgtttaacctagaaaggactacttagcaacataatattgaaagaccgctcagcccattttttgaaaagcatgagctgtttccatagataagccaaacaggcctgaacaaaacagaggaaaagcgaactttgctgttttgatttgtggatgatgatttgattttctaaaaagaacagctttgtttctttccctgagaacataagattactgagttcttagagcctcagctcatgcagctttcctgcttgggtatatgggtagggcaaagccagattaaagatgcacagtatcaagccatctgacctccaatgccagatttcctgcagtagtctaattaccagtttattagctgttaaccttgcaccacagttacaaaacggtaactgctggttagagtcttaatagttgataagtgtcagggagggtcttccttctggtgagaccagtatccttgtgagtctcatgatgataatttgctttagagctcagtcactggaagggaggagagaagggacataatgaccgagggtacccaagtactgtgacagaaggccatagacagctttcctatctaggaggaattcagcctgaagcccacagctcaaggggcacacagaccaggcactcctgttttgaaacaataaaatgaaactgttttttgcaagttttgttcacttgatcattttgccctgtgtctgtgatttcccttagaataaacaaattaggaacagtacctcggttttagtataagaccaagtgcagccacaacaacattgccttagaaggtaactttatgctatttgtattcaattaaatctcacaagccacccagagtgaatgttttcatgttgctttcttagagatatgaacacagagaacagaagcttgcttaagttcagagcaaacagaattccagttgcacggactctcccagttacagctgtgtgcttatcaatacttggtggatagggaagaggtggcttgtgaactgcaagactttaatacatgtcagtaaccttctactacaaattgaaatgctctgtaaatcaggaaagggtttgccatttttatgctagtgtatttcacgacagtccagttggaaaagagttagtattgatgttctattggcaaggtttccagaccagatttgatttataagaacagcactgcatataagagtgtacattgcttagatgggacatccaggaactgtgttaatctacattttcaggtacttctactcaagagaagcacagaaaatatctttacaaagttccaaaattaaattttagaaaaaggtttgaacaaaaatgtttgcttattaatttatccatggttactccagcgagctctctcatgacaactcatggcatgctttactagatgctgggccctatgcatgggtttcatctgatattaccctaaaaaggactcttcacatagatatcataaccttcagtttacagtttgagggagctgcattggatctcacaacgagcagatatgagcgctggacttccagggtcctcgaaagtagcaatcactgtgagtacatgatggcagccgacacatagaatggacgtggtccatacaggccatgactagggcaggttgtctcactcacacaaggcctgttcatttattcattcatttctcttcacttgtttaataagtacgcattgagaagttaccatgtgccaggagaacacaaaaatgaaagattcacaggtcctgccctcatggagttccccactgagtttttgtttgtttgtttgtttaaatacaagctttactgtatttcctttcttggatggttacatctaggtaagacagatacgttgtatgttggatggcctcaattaagcaagatgctaataactttatgaaactgtgggaaaaatttggagtatgttatttggttaaagaataggaacatttctaaggacagattacaaagttaaacctaaaattaaacagtttgcttgccaatgtattccttttgtgtattcctttatctgtgagttcattgaatgcttcctatgtgcaaggtattatgcagagtgtaaaagttgaattcagtttctcatgcagctgaaacttctttcagacttggacatgagcttgaaataattagagtgctagatagaaatgttcattgccttggagaggtatgtataaagtacttgggatttaaaggaagagagaattagagaaaacgtgaagggggggaaatgacatttgagccagacatcaaaggacagacaggattggaagatggggagataggtaggaatagaagattcattttagccagagagaacaatagggaaaatagaagagtgactagcaggaaattcagctcaaatttgagatatgaaagatattttataggtatcaataattgacttacttccaaagagttcatcatcattttaatcttccttgaagattattttttaaatccaagtaagatattttaaaaattagaccgtacataaaagttgaaaaaggaaaaaaatgctgaccttcactccagtgaaaccactggctaacgtttgagtattttccttcaagtcttttgcattttgtttctgtgcctctttttgagtagttgaaataatgtattgcattctgccttttcatttaaaataatactaccagcacctacccacgttatgaaaatctctttggaatcgtcacatttaatggccttatactgtttagccgtttggctttgtcatagttgactttaccccaccctattgctggagtttagggtgtttcatgttttccattgctatgaacagactagctgttggccagccaaccctttttgtatttcacaaatggtaaagccaaggcacttgtaataagccaagatggggactgacttgttcagttgctagaagccaaaagactgttgcataaaaagctgccttctgactagaagaggggctgtggggtttctaggaatagagattaataaggtgcttaggtcatatcccctgagaagtttaatctgagtgggccactgaccttctggcctctggaaaggagatccattgaatttctaagccctttggtactcctcccatttcctgcggaattttgattgtgggtaaagtttcaaaacactggctcttcacattggatttccaagttgggaagagaaggcaggaagacctatcaaaggacaaagatattgtgttctccacttcgatctgaaagatggaatggcaggggagaagggaagggaaaaaaaggaggtgggtgtctctgtcctaatttcactgggtttctcatcccattagttgaagttagcaaacaggaaagcattctccttaggaagaaaaatggcaagaaaactgatgcctgccttgcttggatttttagtgttgccaaacacctatgtttgtgacttattgattttgtactatgaacctagcctgctttgcatcagctcttcttgtctttggtcgcgtcttttctttgtgaaatttcactcggtgaggaaatactgaattggagggagatacggtccttactgagcatgctgaagtaaatccagctattaaatccagcataaatcccagcagaaagtagtgtatcagaaatgtggttctgtatgccgaacatgtgttcataataacagtgcctggaggcatatttgtattatagttcagcaaaggaaggagacaggaaggagactcttagcttagggcaaagaaacatctgctacaaaaaaaaaaaaaaagaggtataccacatttatgtaataaatactgttttgaaagtttctctgaaattagtttcccatattaaatcatgcttcaaactttcttaggaacttcactttttcaaagaatcgttctattaaatttttgagagagagcagaatttcttaacagttaagtatactaaccctgggatgaggctaccttattcaaatattggcttcaccatttagtatctttgtgactttggaaagtgatttaattgcttgagggcttaatttccctatctgcaaaacagacacaataataggaccatcacataaagtctctatacagattcaatgtgaaagaacattttagaatgcagtattagaagtagtttaatcactttaaaatgttgctattaataatctgttaattagcaagtgatattatgcatgtaaaataaaattttggaacaatatttttcttacaatgagccaggtctgtaggctaggcatattaaaatatttaaaataagtcatggtatattaggttaaaatgatggaatgaaaacactccaaatcagagtttcaaagtaattcaactgaactgtaaagcaaaataggtataacacaattctatgctaaaatgttttaatcttaggtttatcatataacattttattacctaaaactgctaaaacatgtaggttttatatttaaaatgatagtttgtatttagtttgaaatgtggagctgaatgattttgcaaaattaaattgggaatacgttatattttaggtaccctggaaaattgtctgtggttagatggctgatacctttccttcttatttagtttaattgaaaaaaaattggcattgaagaattaaacacactctaaaatttcaataaatattccatgactactttatttatctagatatcaacttactaataatatcagccatccaagttaaacaaaaagtaaaacatccagaagtgaaaaatacagccaaatgttgtacatggctagtatacagatcctgctataaaatgctattataaaatccagctgccctcactcagagcctactgattcttatatatcacataatctttcccttgttccttcctctgaagacagtaggagctataaacaggaacagtttgggagaaagcaaagcccggcatcaaaagagatatagaacaaaatgtagacacacaactttgttatcacagggcatgatgaccaaggcattcctttcctcattcagttattcacttcttcatcaaagattctctaatcatctgtgatagtaccagtctgtcttctaggtataggctttagaaaagtaggtaggagagattcagagaaaaataggatataaacatttctctgtcaggttgctcacaataaggttgacgtatttgtgttcacaataattcatgtcatccagaaaagtgatgttacagttttatgtacttcagagtcacagatggtttgctttaattttattatacccccatactcacaccctggactgctttgcaagtttctaattgcttcctctccctgcctttttattttggatttcctctcttcttccctgtatctccttaatactcttcaataatatcatttatataacacaatcacagtgcccacttactcactagagcctcacagagatctgtcatccgattcagcctattttagcaggtatataggttagcttttgttgtgtaacaaaccaccctcaaattttgcagaattttttaaatcatgttttatttctcacagttctctgtatttgttgagtggtttttctggccatggctggcttggctcaggttggataacctaggatggcctcactcactttatttggggcctcagccaggaggactggattgactgagacttctatgtggcctctcatcttccagtagattgtcttaaccttttaaacatgataatctcagggtttcaaagagaacaagaaggaaaccccaatgtacaagtacttttcatgcctctgatttgtttcaaagcaagtcacatgtctaaaacccattttcagtatccatgtggaacgaaagtcttcatatcttgatgggagaagctgtgtagtcatattacaaaggagtgtgatcaagggaggggaagactttctggtcatggaaatggtctaccatgcctggagaaggagtggtaaatatatccccccagaagggacacactttatcttcaggcagaaaccattggcctgaactagtcatatacatgctcctccttctacccctgcccccagctgaggctgcatgcaaaggaggatgacaaataaataaagccctctatgtattacatttgtctcacatgacaaagttctatttcacttattttcccttgacaaaatccattgaggcctttcagagttagccatattcaaagacaccatgaatttccaccttcaactcttaggtgtctgaaggctgatcttctaataggtggggtttgggggacggttttatgaagtactttaaagtttcagaagcaagatgctgtcttgctgctgatcatttatagtctcgaacattacatgttgcatttcacataagaattcttatcctttatggcctagctcagaagctttctccaggaggcctttctacccttttctctcctgggcaggggttatctctcctggttctaaattcctgtaaaatattattttgcttatgttgaatagtctacctactctgctggatttgagtttgttaggatagagtctgtgtcttatccactattgaattctgtgtagtatctagtctagcagggacacagtgaaataataaatcatcccttgataaagaaggaggaggctatatttaaccctaatgccctactttattccctttctattatattttttaatgttccatttaattgttttctatccctgagtcaccaacacttaaggccactgtcatgtatggattcctctgttaattccttcattgagaaaagtcagaagagggacacattcattcattctatacaggtctatattgagcacccactacgtggcccatatatttgtgtgacagagacacagcagaaaacaaaatatatgtagtcactactctggtagaggaaaacacaaacaagatatataaaggatcagagatgaagttgttgatgtgtgttacgtagaaaaatctaggaggtaacaagaaagagagatcctggtggtggtgagatgccattttgttctgagtggccaggaaaagcatcttagatatggtgacatttatactatgatctgcaggcagtgagccatgccgatatttagggaagaatggtctaaactgaggtaatggtaaatgcaaaggccctgaggcagaattgcaagtggcctctatgaggtacaggaggaagtccatgtggttagagtcaagtgagcatgggaaaggaataggagatgaatggagagagatataaggctagattatgtaaggtcttacagcgtgttgtatagattggcttgtatcccaagggagatgaggagccttatgaagaaagggtaaagaaccaaaggtatggagaattacatgggtttgaagaaagagttgggggagagggaaatgtatgatctttttcgtccctgtcctccaacattaagtggatttctcaccttggtcccccctgtgaaaaatctacttccaagattggctctgtgtttgctaatcatcagtatctatgacatgtatagaaataccttcttccacaggaaatagataaatagatcagagataaatagactatatagtgtttgctggtaattcttgccattttaccagatataatcgtttaaaaaaacatgtcccatatttatgtagtgctttattataatttaggttctcaaaaagattagtttttaaaccaggtctagagctctgcttaagttgtttcaacaaaacccaactcattatatgttataaatgaaaaagcagttatttaaattgcaatggccttgatgtcacaggactataaatgagaggatgcccaggggaggggagaacattcactttcagcatgataaaacatcctgcatgaagatatgttatttttacaaactcattttctgcaaagaaaaccatcaaaaaacaaggaactttctgtgtaagtgtgctaggaatgttttttttttttaaatttgttacaaaagtaacatattataataaatgtaaacaatttagaaatttttagcattttaaaaatgtaattatagtcagtttataatggcattattttaaccagggcaaaccagccttgttatgaacacatttgtttattttcaagataatttgattagagccaacttattggtttcatgtgactaatactgggctgtggtgtgcattgtttagtcaaagaaaaaattaaattatcatttttactttctgtggcctttagtaaataaaggctgatttactaaataaagcctgacttactaagttctttttagcatagtatagttctcctcatagtagaattcataggaaatcttggccctcttttatgataaattgatatgcttgggtacaagcctatttattactgcaatatagacctgctttctgaggttcttctttctcaggaaagtaaataaacattacagaggatatttgctactctgtgtgacccagtaaagagttctcctggagaaaactttgcaaataacatgatcaacaattgcatgctttggggccataaacaaaataagcaaaaaagttgttttagatcctagaaaagcttgatggagcattctactgtctggtaaacaagaccagagtaaatatggctccaggtagcaagtgaacagccagaccagggtcaaggccagcattcgcttgcaggggttagaatgctgtacagcagtgaaaatagtgtccatgtctattgtgaaatagaacaatgccataaatgcgtagacatcatcttttctatcttgggagcctcctgcaaagtgacattataggcatgtctgttttcagatggggaaactccttgaaatatagtttgtgggattctctttcagcttcacagtaattggttgaagcaggtcttaaaattggttcttttcacatggagtgcactttaccattaaaaggaatccatgtgtctcatgaaaatgtgagttatcttgtgtaagtatgtgtgttggtgggtatttgaaattagcctggagtttaggagttttaggggtttttccatctacttttaaattcttggacatagatgcctacaattaggtagtttatcaataatcaaataggctaaaatataatgaacacatttgggatatatctccacccataaaccttcatacttctttgtaaaagttttgctgaagaagtatgtgtttatcatatgaggaggtggttatgggtatagtggaagagacagatttaggtttggaaggtaataattagggaaggttctctggcttctggttttacttcaatgtttacatctatttcttcaggcctaaagccttttgtcccattgtcaagaatagttcaggaccagtgttttattccatgaggccaagagagaaaatgccagttgtgtggccaatcacttaagcttaagaatgtgacatagtactctgcagagaactaagaatgtatcttgaggtactacatctaggttcaaatataaccacaacatacagtgggattcacagttattttaagaccacgccagtgaggtcattctgagtcatgacctcatggatagaggattctaatcaactgctgaagtctacagagaactaatgaacgaaagagtcctgagatctggtaggggaattttgaagcgccatcagtatctttgtatagactttccatcccctaggatctgtatggtcaaataaccagaaaggcttccatggtcaccttcctggacacctggctgtgagccaaacaacttcttcaatctcttgccaggtctctagtctgtgagtcaaagaataccatatttatgagtgatgttttgagatagtgggtgctctgtgaatttcaggtagtgtttttttgtttgtttgttttttcctcaccagggagcatcataatttttcagcatgtttgttaacaatgtacattttattttaaaaaaaatcatgacaataaattcatacattgccaaataacaggtgtctgctatctgattctgtcagataaactttataccttttctggaatatatgagttagaaaacttcaggtatcagactcagctgcctcaagtactgacataccaggcatttctctgtttaatcatcactcaactcatggatgaaagtattaggaaacagaagggattatgaagataactaaagttattactggcacttgaactgaatttctcttaaaatatcagtttactttgatatgtgctacaaagaccttaaccatgtttctgtctgattcttttgtgaaatgaaggtatcaatacagaatgaactgttttgataagctccctcacaattttaaagtatagagttaatctctaagaactaataagcaatgattccattttcttgattttatttttatgagccacagttttatatcccactgcttatctgatttgaaaatggttgtaatattttgagaaagttaatatcgagtcatgccaaaaccttaataaacttagtcttgaactaatatttcaggctcatgagggatttctgtatgctaagatagattttaatattacagaaatgcaatagtgacctttccataaaaccttaataaaattactttgttctataaactgcagaagagatgggaactttcttgaaagagaatatgcatgatttatctgcatttcatggcttaatcttatatctcatttcttcagatctcttatgtttttcttttccttaaggcaaacaacagtaatttccatatttttaaactagagaacagacagaatttttcaaaggcatgttttccttttgcaccagtgagattgggttttggactggcagttcaaggatgtggttctattgcagctccaccagcaggattgtggcaccttgccaagctcacctgaggtttcttggcctatgttcccactctattacaggaagagctcagattaagtctgaaatccctaggattatcttttatcgactgttgcttaaatgttataactttcatattcttcaacattcttgtattttgttgatatggttcttaaaattgtggcacagaaatgtacaaaatactgtaagcaatgttaggatctgaaagttcactaattttattatagccctttatcagtgacctccctaagactgcgttaaggtttcaacaagtacctcttcaccattagcttattaaggttggagttcaccaaaagttcagatgtttttcacataaaaaggcctttttcctttgtcctgtagttgcttttttttttttttaacttctacgatctttgcattgctcacttttacatcaatcttgataatttgtcttattcttcaaagcagtccttttgtagcagtgagcccatctcaggacatatttggacatctggaatactggagggagcactggtggagatgtcttaggaggctgctgaaaacgagggagtggagttttggaagggtgaggagaagagtgataccataggattgccctgggagggagaatactgagagccaaaaaggataaaggacagaggaggtggagggatggccacatgtggaaagaggatcaggctgaaggtaggagttacattctggaaaggttaagaaagatcaggatcaacataagaacattgagcttaaagaccaaaagtttcagctactcaaaaaggcatattttgaacagaacatatatgctagattccatattttaagacatttacagtgagttgacagttaggaaatgagggtatccagcaaagtcttttttccttttttcacaaaaattggccatgggaaggtataacatagatggccaaaatataccttaattataagtcttcttctctgtacaacttcagggcacaataattaatttagtgacagtagatattttatccccaaaactcaatttaacttattatccatgcaattgtcatacttgaatcttatctcttttcctgtcttaccttgggggttggtttcaaatatggcagaatagaaataaaaatatatatacaatggcttaatcacacttgtgatttcaccagtattaaatataggcagcaacattgattttattaaaatactccctataaatattccccaaatagcattgtagaccaattaatgtcatggcctaagtggctagattgtgatgtttttataaaactaagttttctctatcatatttggaacactctacaaacaaagccaggatttaaagacacagtgatctatttaaagtgaataatgattttataagggaataaaaaaataaaagaaacttgaaattattcgggttttttttggataatataaaatatttactgatgttgatgctgaggttaccaggatctctgtcctcaggtcatttcaaagtggaaaattggaaactgatagtaatgtggacatctcctttattgaagcaatccttattttttattaaactacctcttattaaagcagcttaaatacagtcccaggaaaggatgagtttccctcattttggttggaggccatatctttagagtgtttttttacttgaaattaaggaactttcgtcatgagaaccaaggtcagacaatgagggtgttcggtcaaaaggtttgttaagttctattaatagttctaccatatttgagggattctaagctttctgagctttactttccacatttttccagttgtgttaagatttctaacttcaagagagtatataacttcaaaagagtatgtaaaaatacttggtaaatggtgaaacagtaagtggatgctgggtgcctttattgtgagagctttgagaagtgtgtcaggtcaggggtaaatagcccctgcttttagagcagagtggtgactttcatttctcattactgcagaaggtccagcatctcttgcctaatgagaatgtcatcctcctggtctccaggtcaggccgttgagttctctctgatgtgtctttgaaacttgctggcagtcttgtagcattttagaatatgctggatcaaactttatcctttcagaaaaaaaaaaccaaaaaaaaaaaactaattgattgcagacacaaggaccaaagcaatttttgtaactgttcattagtaccgacacttgggaaaaccaaggatttgtctaacaaggggcagggaacttagttaaagaagctccattttctctctctttttccccagcctgcggatatggtttgaattagaagttaaagaaatttgctaaaatgaaacaccatgtgaactctttggaatcgcttcacatccaactctctgacctttgatatcctttctattgcctctgggccttgttagagtgagggatgtttttcagtttctatataagcaatggaagcaaacatgttttaaaataatgcaataaaagcacccatcttatgaaagggacaattatttgaagactgttgaccttacaagaattggacaaggatttggcatcttgaaagtgtgctttgatactgaagagttgttctagaaatgccactatgtcattactctgtcagttactcttcaagacacaatagtaatgcattgttttaaatcttgcttggcccatctgaatgtggctttcattttttcatttttggaaatgtatttcaggaaggatatatatggttattaaataacatttatatttcataggagctcaaataatgtttaatcaaatgtttattaatgtaaactaagaaggcatcacagagataaaactaatataagctaagaaaacatcagataaattacagtttcaggatctgtattttacagacaaggatactaagactcagagggttaaggggcttcctcaaggtcacacacctagttgggacagagctggggctggaatgtaggtcttccatctccgattgcccttctctttccattccagcatgctatatagctcatattaatttaatattaattgtggaaatagtgtaatatataatcaaaggcagactcatttttaaaaatggttaatttacttataaaactataaactttgtatttttctgattcacttttccaatgtcacattagatttatttcaagttgtgtgaatgttattgctggtatttctgatgtgaatgaaatagactcaattccactctccctgctggtctatcagaaaaagccaaagacagcatctaatatttacacctagttttaatgtgcagcctcacttacataaaccaatttgcacagtaaatttcccattattttaagtaatagttaattagtaatgccaaacctgaggaggaggggcctgaaaaggtgacacttttaatataagttaactgagattaaggattttatttccttttcctttcagactggatgtatttttgtgcataaaaaagacaaagaggaagaaaggtttagagattttgaaaataatgtgcatgtataaaaaaattaaatcaacctccccaaacctcgaattccatgtgatttttttctcactatctctattttattagttccatctctgtacttactttaagcttttggacttcaggtggaacaattttgggcgcataaggagataaatgaccttgtgtgagatttgagatttatgtaggtgacatttttttgactaaaggttactttcagatcatggggcagtacccctgtgtggatgaacatatgaagactgttgatttcggatatccttaagcttgaaaacttgaggaagaatgttttattttctccttctatggtctgagctcagttctaatatgcatggtcttaggctttatcctcttcttatgactcctgtataataatagcaaagatctatttataaaagtagcttggagaatttttaaatacaaggaattttgattaaattgaagagctcgttgtgtgtgtatgtttattttaatgagaaaatagttttaaaataaagaatgcctccagtccttgaatttatgcctgctcctttccaaagcactttgcccatttttgtgaagtctcattttacaatcctcaggcttactccatactcacgccggaggcaaccttcagagagcttattcaagtgaagataaaataaaaatctttcctttgaaatagtccaataataaggcaaaatcaggcttctaaaaagagatttccctcttgacatatatgattcatgttggcgatgttttgcctgataattgtggcaggcagtccaagggcaaatgaagggcaaagtacagagggctgggcataagagacaggaggaccttatgggctgcccagaggtctcctctaaagagacagtctctagggataagaacatcacgcacctcatgaggacatgtccaggatcaagccccaccagtgaggacctaggtgccaatctgaacagcccttactaagggacagtgatcagagagggtctaaggagaacagaggttcaggccatagaggtggtgtggttggaatgtttattctagaaattattcataggcacaatcgaggctgtcaaacttggtaaagaatggaaactcattctacaggcctggttttagcctgcagcaggcaggcagcagggtatgagtggagaacaaaacactgtgaacagcatttcaggatactggagagaggagcaggtatacacagaaatggtactaaagtgtgcatttgggctgggcacagtggctcacacctgtaatctcagcactttggaaggcaaaggcaggtggatcacctgaggtcaggagtttgagactagcctggccaacatggcgaaaccctgtctctactaaaaactcaaaaattatccgagtgtggtggtacacacgtgtaatcccagcagctcaggaggctgaggcaggagaatcgcttgaacccaggaagcagaggttgcagtgaggccagatcgtgccactgcactccaccctgggtgacagagtgagattcaagaaagaaagaaagaaagaaaaagagagagagacacccagagagagacagagacagagacacagacagaagtaaggaaagaatggaatggaatggaatggaaaggaaaggaaaggggaaagggaaagaagaatgaaggaaggaaggatggaaggaaggaaggaagggaagaaagaaagggaaggaaagggaaggaaagggaagggaaggaagggaaagaaagaagtcactgcgctccagcctgggtgacagagacagactgtcagaaagagaggaagagaggaatgaaggaaggaaggaaggaaagggaaggaaagggaaggaaaggaaagggaagggaagggaagggaagaagtcactgcactccagcctgggtgacagagagagactctgtcagaaagagagaaagaggacgagaggaaggaaggaaggaaggaaggaaagaaagaaggaaggattaagtgtgtgtttgtgtaagagaagagtccattgtcctttctgccttgatttgttttgggggttggttgggagctcctccacagagtaaaatattcattcattcattcattcattcattcattgtttactgctatatgctggacactatagtagcaagcaaggccccagccttcacagaggtcatcatgtagtgatgatacagataaacaaatagctgtttaccaggtagggtggtgagttcttcaaagggggaagcacaaggtgcttaaatgaaaatacagagtggtgcctggcccagtttctttaaataataaccagtaagtttaggggagtaaataaccagtaagtaaataaccagtaagttagtgaatgagaagaaaagagaaatgtgcaaaatgctcagtaccggggggcaaggaatcaattctgataaatacagagaggagaatgtaaaaggaaaggtggtgagggaagatgctgctttccagtgcagctgagggcacgtttcttctagaatccttgtgttttaacataatctttctcctcagctcatttgtcaattgcagttccttaaatttaaaggaatttgctggttgactcttacccaatattttttcctgagttcttaggagaaatattagcattcatagcttgtagttaacagggagcataaaggtttgggccaaaagaggtaactgcttgaagttatttaagtgactgtgaagtctgcactgcagattaaagggatgttgtgttggctgagggtttggttatgactcagtcaccctttatttactttcttcaagttgcctgtcattcttaactggtttcttcttacttaactcttaaggatgaagcttgaaaaaaaatggttgagaaaattaccatttacttcaggctctcagtatctactcttggtcttggatggaaagcaagtactggccttcagagtctccataggcttggttgtccatggacttcctgagaaaagcgtgcattctagacaaatggactgtctttcttacccaagctttagttccgaatacctagccagcttcttttcctggtaaattgggctgggctggataaggatttaaagaccattttcctcttcccccttttttcctttttgctggagacttgatctaaggctgttttctcaaaccttagcttacattgcaatcacctggctagctggatacaccgtggattcctggaccccaccagcagactttctgatttaggtctggatgggggttgagattttgcatttctaagaagtcccaggtgatgtctgctgtcggggtaccatactttaagaaccaataatctaaggcaaatccagggacctaaagattctctagtctttcccctatgctcccagcttgagttcccatcttggctaaaaagaaataactcaaagagtattcctgcaaagaagaaacttaagctgaggaagaggtcaacctaagcctccattctcatagtccccactctggaaccccaggactttttaaagactagggtcctctgtgaccaggaagccctgggttaagaaccccttgaaagatccaggagagaccagtatggaatctgtgacctctacctaaaactatacttaatttgtgcatgtttcccttttgttttctatgttccaagaccttctcagaactactactgttagatcaaaaagggctgaactctccctgaaaattgttgcatatggctagcacctcctactaagggagaagttgttgctttcctgcgcggtaaagtatagacatccaccatgtattctgttagttctgtacttgaaaacagtgacaagttctacttttgagagagggaaaaaactgctactatacagtctttcatttacaaatatcccagggtgctctaatcctcttatttctcagaacttttatattctttagggctgatgataactctgtttatgttaaattctcagtagtaataaaataccctctgctctttgctgcccttagtaagaacagaaatactttatttcagaggcataaaagataagaaacaagatgacttttgtataaggtgtaaggaagggatccagtttcagctttctacatatggctagccagttttcccagcaccatttattaaatagggaatcctttccccatttcttgtttttgtcaggtttgtcaaggatcagatggttgtagatatgcggcattatttctgagggctctgttctgttctgttggtctacatctctgttttggtaccagtaccatgctgttttggttactgtagccttgtagtacagtttgaactcaggtagcgtgatgcctccagctttgttcttttggcttagacctaaaaccataaaaactgtagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactagcatcaaagtgaacaggcaacctacagaatgggagaaaatttttgcaatctgctcatctgacaaagagctaatatccagaatctacaacgaactcaaacaaatctataagaaaaaaacaaacagccccatcaaaaagtgggcgaaggatgtgaacagacacttctcaaaagacgacatttatgcagccaaaaaacacatgaaaaaatgctcatcatccctggccatcagagaaatgcaaatcaaaaccacaattgagataccatctcacaccagttagaatggcgaccattaaaaagtcaggaaacaacaggtgctggagaggatgtggagaaataggaacacttttacactgttgtgggactgtaaactagttcaaccattgtggaagtcagtgtggcgattcctcagggatctagaactagaaataccatttgacacagcaatcccattactgggtatatacccaaaggattataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattttcaacaaactattgcaaggacaaaaaaccaaacaccgcatgttctcacttataggtgggaattgaacaatgagaacacatggacacaggaaggggaacatcacacacaggggcctgttgtggggttgggggagggggaagggatagcattaggagatatacctaatgttaaatgacaagttgatgggtgcagcacaccaacatggcacatgtatacatatgtaactaacctgcacgttgtgcacatgtaccctaaaacttaaagtataataataacaaaaaagaaacaagatgacttttactctggagcatatttataatatgtcaaaaacaaattctactaaaatagatttattattcatgaaagagaaaaacccagttagattatatattcctttcctcaggcttctatagcccgcacccccccccacaccatatatatatttttttgctaaaggttgatatatcttgcatgctatcaaaaaaatttctttctagcggtcacttctgtaattcactactataaaaatgattaatatgtgtgtacacgtgttctcactcataagtgggagccaagctatgaagatgcaaagggataggaataatatggtggactctggggactcaggggaaagggtcagagtggggtgagggataaaagattacacattgggtacaatgtatactgcttgggtgatgggtgcacaaaatctcagtaatcaccactaaataacttattcaggtaaccaaacaccacctgttctccagaaacctattgaaatttaaaaaagattaatatacaaactatcttctgtttctgaaagatcaaaatactgttaagccaggggtggatttactaagcacttaagaacatgacccctcagaggacatcacgtgtagataggccccacttctgccactgagccctcctgtaccattattgctccctagcttgaaccattctaaagttgaatgacaagggattatcaggctggaaaacctcagtcatggacaactatgtacttttaatacgatttcagctccttgatgtgttctagaggattttggagggctggcataggaactcagatgtcatttccaagggaattgctacaggcaaacaaccaacatccaaacaatcttttgaaacagctcagttattctcttaggaagttgttatacttcgttgtattctaatttctttgaaactgattattgcagattgaattaaattgccagggctcagaacacaatacctgaaaacatggcaccttgacatactgagtattttgagataaaggaaattgagaaaactgcagaagctggaaggtcaatctctgaccttctttcctgagacaccttcatgtgacaggtgtcccactttatgcctggagggaaggaatgataacacaaagataccaagaagaatgtgaagagacctttctcagttccccccagttcaagaccattatatcgtacccacttttgtctaatcatgcttctatatgactatccattctttatcaaaactaaacatagaaatatacgattatctcaatttctgtctttgtttctgaaggctcctgtgtcacataaaacttacattaaataaatttgtatgtctctcttgttaacctgtcttttgttatagagggtctcagacatgaactttgtgatggatgaggaaagatattactttttcttccctagaatatattgacagttattcattatatttaaattaagctggatctctaaatactccaggcaactaagcatattttagacatgttttgtaaaatcctgatagattgaaacctataacacgatcacaaatgtcatctaatacatttataaacctggatcttcaccccaggtaactaaacatattttagacatgttttttaaaatcttgatgtaatggaaccaatagcatgatcacaaatatcacctaataaatttataaaggcagtacactttaatatttttattcatctatttgtaattattaaattttaaggaagttacacttgcccctcaattatgattaatattgaggtacgagaggcagggacaaatagcgaatgcttgctttctgtttttattttattcctgtgcaatttgtgttcttttaatacactccaggaaattgtttttaatcatgtgatgctttataatagataaatcatagcaaaggccatagatttcttgtagcccagaattcattaaagtctaattccagtaccatcacaatcagttttttcccaaatataagtattgcagaggtttcagttaacgttcattttagtcagtatattaagtaactccttactaagtaatgaataaggatcagtcataactgggatgtgtgaaggctcccattgtacagggaaggttttaaattctgaaaggggagaacaacgttttacagctttatgtatttatctcttcctgttatttgttcttgccaggatttctgctagaaaacatagacattattttaagactaatttatatgaaaagaaacaagttttaaaattgtatcctccatttgctttagaaaatattttttctggaatataaaaattacagtcactatgaatattttaaaatacagggaagtattaaagaaaagaaaattctaaaattacatcagctagctgtaactactatttgttttggtatatgtcttgctagtttttcccgttgtaaaacagtgtacatatgtaagcaatatgtgtataatatataacataaaaatttggatcagactcgtgtaattttatagcctgtggttattttttttcttaactgtatgttaagagcatttgtctttgcttcacaagagttgtgaatatttttagaaactcttctaaatttgctattgttaagcaaataactattcctttaaagtactatttttaatgggtacagtatttaagtactagagtgtgtttaatcaattgcttagtgatgattatataaggccaatatttttctaccataaacagcacaacagtattcttgtgcatagattttgtacacatttacataggataaatcctacttgtacaattactagataaaagagtatggatatttcaaggctatagaaatgtattacaaaattcttttttaccagatatgccctcaccccatccatcaacagcattgcatattatcatatttttcttcctgtactctttgtatgttttttgaaaaggttatttaatggcttaataaaaatggaggtatttttgcaaatggggaagttatccctaatgatacaatatattaatgtcaaattagattcttactggaggtaaagccatttatttaaaagccctggatgatctgatgacagcttgttgatatgtttttagaaatataaggatatcttatttaaagattgaagagcaaggcactgaaatatgtgtgatagattcaactgatttacttgtggtcagtggaaattttatcccaactctctatgttctggaaaacaactttggttgtgccatcatgaggtcacttaaggtcatgggttatttggtttaatgggatttgtatggttggatggggaagggattaatttgttatggaaatttttttgtcataaggttgaagttaaaagttgcacttaataaaatttataactgagtcatggtgcatttattcacttgaaagctatatgttatcaagtagaagcaaatgctttttcagatgaattcattttttcacaaataggaataaaaaatgaagaacaccttgtttggcttcgggggagctgcaggatttgaagtttgtatttattgctgagatgcaaaattgttacaagacatttggaacctggggaagagtatgcagaaataatgtcattagtcctcaaaggggctttggaacagaaggacaggaatgatctgaattcatttctaggtgaagtttattctgtacttttctctctgtcttcctctgatgattcagttgaacacacatgttgaatgaccattcccttcaaatcagagcagtctgtactgcattccaaacttatttggcaactttttagttcttttaagaaaggtgttcagcttcagggggcccaatatatgcattttctgggctactataaaaaattagcacaaactagtggctgaaagtaaccaaaatttattctgtcacagttctcgaggccagacgtctgacatcaaggtattttcagggccacatttcctccaggctgtggggaagaacccattcctggcctatttcaccttctggtggctgccaactcttcttgaactgtggctacatcactctaatctctgcctccgtagtcgcatttcctcctcctcttctgcttgtgtcaaaacttcccctgctccccttttgtaaggacatttagggcccacctggatgatccagaataatctccccatctcaagatctttcgcttaatctcatctgctaagtccctttttgccctgtaaggtaacattcgcgagttgcagcagttaggaggtgggtatcttttgggggccatttattcagcctgccatacccaggtaccttagatatgcctggtttcacatactgccctctgttcactctctaccagaacgtgaggcacatgtccagagacaaaaaattccttgtgaaagtattgacctaaactggtctaggttgggggtggtggtgagggagggtgagcagcactgactctaaagttgatccagcacatctgagataggtggtctggtaattcctgaagaccaccttataggtctagcaaggaagacaagacagcaggtttaaagactcaggacagagtaggccaagaaaaccaaatctcttccttggttcaccccaaccgaatggatagaaggccatatttatgggtaatgcacatgtcctacttgaatatttggcccctcgacagcccacctcagcccccttgtgttcctcctaactctgccagtttcttattatcatctttaggaggagcttttgccacttgctctggaacaagaccttctaggactccccttctttcttgtcccccgcttccaaagtttcttgcagtccagggagtttttcctctgccctagtgcaatagctaatccgatccagttgcacaaggatttagaacaatgcgactatttaaaagccttctggcctccttccagtaactgctcaatgtgtttacactgcaagaggtttcaggctgtctattctttgacaatgtaaagtctcttccacttcccgtgttcctcaaagagaaggtggatcctttcctgtgggctctgcatggtgagatgatgccattctaggaggtggaggagacaattaaaccttgaaatatcttgtaagtgaggccttggaaggcaagctagagaatttgagaagaggaacttttggcatggtacaatcaaagcctttttttttttcaagccagttagttggctgtgggttgggatttgagataattgcaataagaatgtagttatagggtggccagttcctcccctcttttaaaaagaagtaactgtccctttaacattctctgcagtcactgggactataatgtgtaccttcgtttgttcccattttaaatcaattatctggatcaaactgtagtgaaacaggattggctgggtcaacattttctagtctgtaggtcatcattgtaccatgtgtgtaaaataacccagctagtgcccctgatgccaggccctaggaagttttccacagatagcacaaagaacagcctcgaccacagccaccagtttcaaattgggaacactcaggatactccaacatcattttgccagaatacttcttaccttgttctgaaccccaatgctatgaaggaataagcaatgaaatgaactttcacctccactgcagaagagattaaggtcaaaattaccctcctccttcacctccaaagttcttcatatagtgagactattgtgatgaaattagtacccaaggtagagatgaatattttagtagttaagaatagtagtgaggtctgagaaacatcatatactgggtactcatgttgattctaggagaaccagagttaaaccaatggaagatatgcaaactgtaaaaagctttttttttttatttttatttttgatataaactttttgtatccaaagcctcttactgatttaaaatgaaaccaaagggatgaattaaaagggatggttgtcaggagtgagacaatcatagaacacataaaattctgcagaaaagagatgttttgcccaccattcttcacagcctggcaaactgggatggccaccatgttgttttttaatctatttttcaagctaacacttagctccctgtagttggttattaaggggggtctgtgggtctatttttctctgcagatctgttttatagcatagaaggcatgaatgcacatcatctacctcagaagcttgtttctaagcttcttgggtagaagctatgtggttatgtgtgtacatacatgctatattcaccaagctatgcaaaaggtttcaaagtcaaacttatttcttctgtgtaactgatagaaggctttgtatacttcgattatcaactccacattccccctaccctcagcctttggtaaccactgttctgctctctgcttttatgagttcaactgttatagattccacatgtaagtgagcacatggatatttgtctttctgtatttggcttatttcacttagcataatgttctccagttccatccatgttgtcacaaatgacagaatttcttcccttttttaaggctgaataatatttcactgtgtataatacaccacattttctctatgcattcatttgttgtgggatacttgggttgattccataacttggatattgtgaatagtgctgcattgaacatgggagtgcagatatctctttgacctactgatttcagatctttccagtaaatacccagaagtgggattgctggatcatttagttcctcaaaaaactaaaattccatttttagttttttgaggcacctccatactgtttttgacaatggctgtagtaatttaagccaaatgtattttaactttgaaagatatatactttttatttagcttttaaaatattctgattaaagttatatacaatattctcttagaatattcacattctcattctttaattatatcccacttttcattgtaaatgttgtgagtttgtgctgcagccacctcctcctcctcatcctcccttctgcccccacctaaatctccctctctctgtgtctctcactcttgctctaagtacttgccaaatatatatccaattcagaaaacaattaacttttgcttttactgatcattgttttactatttttttttttttggctacatattacatatctaggttttggtttgtaatgctctcatcttttctttctaaaaagtttataatttctgcttaactcaagaatgattaaggggtgtatgtatgtgtgtgtgggggggtgtgaatgtttaatttccatgtatatagatgttgtacactctctgtcattaatttatatgtttccttgttgttgtcaatgagcatgaccacaatattttctgccttttgaaaaatgctgaaatttcctctagggcctaatcgtgatcggattttgagattgtcacatgtgtgtgggtagccagggtgcaaagagggaaagaaaaaaaaatgtatttagagagagaataaatatattaagagagagaataaatatcattaagtactgttatttaaattgtgttactttgagttatttaagttgttgtactaaattattaagtatgatattcagatcttcgagattcttacttgtcttcttattctgttattctgagaatcattgtctcctgtttgtgactttgctaatttctccgtgtactttgtcaattttcaaatgttgtgatgctgcgtgctcacatgcttagatattaatggcagttaatgtgatgtattattactctgcctctgctttttctcttgaagtctgtttgtctcatgttgttgttacacctgttttctttttttcttagcacgtgcctatggtatcttttttcattcctgcgttttcttttttattttcttttttttttaattttagttctatcttttttttaattatactttaagttttagggtacatgtgcacaacgagcaggttagttacatatgtatacatgtgccatgttggtgtgctgcacccagtaactcgtcatttaacattaggtatctctccaaatgctatcccgcccccctccccccaacatccctgcattttcaaacttcttagatagttttcaaaatatttctgtaaacaaccataattttacctaatccgaaaacatcttttataagtgaatttaaccaattcgtatttactatgcttagtgatgtgtcattttattttgtgtttcctacttataatatgttcctgtcttctctccattctttatctggttactttttaaaagaggctcgagtttcttttgctatttctcccctgctaatcatttgggagttatgtttttttaattttaattttctataggagaactcttaaattcatagcacccatatttaaacttctattttcctactgatgtctagagtttttagtatctctgttcccttcccaaaatggttttacttccctttgtctcatactttgttcctccaaccacttcactggccacaactcatatattgatataatctaggatttgggttggctaatttttaaatatattttttcttttctacttttttggcatagtacaataaaacttaagattaagcctattgtttctttttactttatttttcttaacattatttcccatctctctcttatttctctatttattttcccctgacagagtatataatacattaaatttttcagagtagattactaaatctttctgattacttacaagtctgtaaataactacatttttctcctaaaagttgaaacagtattgaacacagaattttaaatccaaatttattttccacagaacttcaaaattgtcttactgcatttagtgttgtggatgatgtacctgatatcagtctcatcgtcatttacctctagcttatcttttctcttcctgcatctttgagagatttcatcatttctgcatattttgtgtcttcagtgtcaccatgaggtatatttgggggtgtatatctttttcccccatttatactacgtggaatcagtggattttttcactttgaggactcaaatattcaggtttcagaaacgttcttctactgttactttatttccatccctccattgtctccatataaggttggtaaacctttcctttctattttctatatctctaactttttcacccaggctggagtgcagtgatgcaatctttgttcactgcaatccccgtctcctgggttcaagcaattctccctgccttagcctcccgagtagctgggattacaggtgcctgccatcacatccagctaatttttgtattttttagtagagatggggtttcgccatgttggccaggctggtcttgaactcctgacctcaggtgatccaccccctccccccaccccggcctctcaaaatgctgggattacaggcgtgagccactgagcccggcgtggtgttgcatttttaagaatcccttggctcaacacttcatctgagttttctttacaattcagctcatctattaagttttatttcaacaatcttgttttaaatttctagtatctgtggttaattatattttaggaacagaatatactctctcttccctctgaaaaaatcagtatgctgaagtcaggtcctgtttttcctgctcaccctctttccttgggtgtaagttttacttgatgtgtttggtgttcttccatgttctttgcattgcttaactatttggtgactcattgttgtatgctcccctgtcatgcaagatgtttgggttgtagttattgcatacataccatggtgcatgttgccaacaaggatgggtaaaaggaacgctgagttcttcctagttgcagggagccactctgaacagtgcctagcctctctttaaatgtcctactcactgtctataataaaactgttgcaggacttttccttagttcagctaaaaacagggttctttgtcccacagccatgaaaattcaagctcacaggcaatttaaatggcgagtaagacagggtttcattgggtaaaaaggaagaaaatggggcaacagggactcttgcaagcccagaatccctgctagagggcttcattctaggccactggaatcccaagttccacacagaaggaggaggggccagactcctctctgctacaaacattgtgaacaccccgaggccccacctcagtgggcaggctggttggagtttctccagggaccccctatgagctggctgtctcaaaatcagaagttctcttgttccccacgtggcccaaggggtgaggaacaaaggggtaggggaaagggagcctaagagagggctaaagagaggaccaagagctataaaaaattctggctattcctacgtgattctgcaacttataccctgtgggctcctcctgcccatatgttcaccttcaagcccatagtgcccttagctatttacagcaggcctctcttatgtattgattttggtctacggtttccttattttatctgttgccttcagattttaaaaaaagaatacacacacacacacacacacacacacacacacacacacacacacacacacacatcttgttattttgtaggatttggagagggaatggaaacttcccaaatgatcacctctggtatttcttgattatgatatctccaggtttagagaaaagaaagcaagttgggggtcagacaaagggaagaagaaaaaaacgtattccacatatttaaagtaaatcttctgcaaacacagaaatgcgaagtgattaaccatcctcaattgttttttcattttatatactaacgagctattctttttcatttttaggtcttgaatataatcatggccaaaccttatgaatttaactggcagaaggaagttccctcctttttgcaagaaggagcagtttttgacagatacgaggaggtaaagaagtgttattaatcttttctctcaaaacattctaataattattaaattttaattacagtattgagtaaatattctttgacataagtaagaacatctttaggatttataggttggagttgttgaaaagaggcaagttatgagctagagtaataatgataatgatactataaatttttgagcgctcactatgtgccagatgaccttctaaacattttatgtgtattatttgtttaattttttacaacaaccttacaaggttgttgctattaatattctcagtttacagatgggttttatatagtaacagtttttgcttaatgcagtgcttttggcagtcattctacatttaactttgtatgtgttataaatgtaatagtgattgaactttgtgccagtcattgctttgctcatttcattgatataaaccattttgaccaaagctttgcatgcctctgattctatcatttattgtctgtgcccttgcaaggtggtgatgactccagactttctatagagcaggggctttgggccaccaatctgttcagaatggctgggtaggtgaattaaagcctcatttgcattgtaaatgcatgatttttcttctgttgtacttgaatttgaggtgacttgggaaggagtgtataatgaaattgatgtttcctttaccaagaagttgaaagtaaaacatattaaaacttcatttagagtcagagttggttcctttcaaaatcaatgaaatgtatgaagtggctaattcgctgatcttcccagagatccagattgtcagatgcagaaactaggtcttctgtgagctgacatagcttaatacttgttgacttgatatttctgcagggtgcatctctagatttacaggatagtcactttttaagtaaacaaaattgcaaatgctaaggatggacctaaacatggttactattccttgtttgaattaaaatattgaagtaatagctgttcatatgtctgaaattaaaataacagtgaactgcattctgctataagatgaaacagaataatattctgccatccagagacaagcactgttaattcttatgcagttttcttctagtcttttttcatatttgtttttcttttttttctctctcccatggttgagatcatagagtaatatttttaaaatataaagcagatcccatttctcctgtgtttaaaatgcttccatcacttcccattgtagcgtaaagggaagttcacagaatgaaatacaaggccttctataatttggctcctgcttaattacctcaccttcatttctctccagtttccaacatacagcgtatgttcaactatagcaaaccacttacagtttcccccataaactattctactacatggtttgtttatgctactccctcttcctgaaatgtatttattccaactggtttgattggtgaactcctctcatctcagaacccagatgagaaatgtccacttctgtgatatcttccttgacccattgaatgaataagaggcgataacttattttttgccaccactaacctatccttgcatattttacactgccttcacattttatttaatgtttctttctctccaactatgttctgagtttcttgaagtcagggatcatattttacttatctttttctctccagggactagcagaatacctgtaaccaccaaattctttgtggatgtctagcatctaaaatgattttagatccagttgattccaattcagactaataattcagagaaggtaattttgaagagattacatgcaatcattggttcagtatatctcctactgttatgtaagaaaaagctattggagaaaaaagtacttgacaacagtgaaatgtgatttgatgaaccagagattcatttgaatccttcttattgcttgtgttttttttgattattaatcatcacagctcatattaggaaatactgatcacctgtgcttctaaaggcatttgcttttcctctggattcctctacaaactaggcaaagttagaagaaaagaacccttgaacaagtattaaataaaatgtaactaagctttcaactctttcaagtgctattttactaggattttgagcaaaaacattttaactttataaagcaaacatgcgtcttcatgataacataccaaaccacaaagctgaagaatatttcaagctggatgacagccagtttaaaaaataattatttcccactcctataagactcagttctttagagccagagccatgaaaacatttaaggcaacaacatgtaagcagaaaaggttcgtttctatggttggtacatgaacagccatgagggattacagctgaaagccagtgcgaggaataagattagagaaacaaaacccaagcatccctaaagtgtcatagcaaaggtaccttttgtgaaggggcataaatgctgtcagcaccatatgataactaacgttatcatcatgaactcaaatagcaggtaaacataaaattgtattccatgtatttgtttaaagaaagcagctgggcacagtgtcttatgcctgtaatcccagcactttgggaggccagggtgggcagatcagtaggtcaggagattgagaccattctggctaacacagtgaaaccccatttctactaaaaatataaaaaaaaatagccaggtgtggtggcacatgcctatagtcccagctacttgggaggctgaggcaggagaatcgcttgaacccaagaggcagagggtgcagtgagccaagatcacgcccccacacaccaacctgggtgacaaagtgatgctgtgtctcaaaaaataaaaaaaaataaataaaaaaagggagcagggagtaagcagtcagtaggtgggggaaaaatgtttaataggcactgttttaaaaatagtcaataaatgtagtaagtgcaaatgcatttaaagtttattttattatttctgcattactgaagaattatttttgaggcagccagatttttacaaatgacctaagtggtaggctgtgattgtattgccatgacacttctaattctgtacttttctaactttacttgacttacacgttacttaaatgcaaaatatattttgtttcctaagtgatgcttaacattaaatctttaaaagacagattcgtctcttgtggaggagagaaatagcagtgtttttaaaaatacatgcaacccagatatctctaactcaaccagccccctgactttcctataatatccacatcaaagatctgaagaacccattccctggcaggtcagggccttcccagtctttcctagaattcctaggtgcttacccacttttgatgatgacttatgtcctcaaatgcttggctaccattcagtttccaggactgttgactactccaatttgtttccttccctaaacccactttaacatcaaattccagaaatacaaggatgttgtataaagtagactttttactgaagatttagtggcagcagaggagaattgcatcatacaccacaccaagacaactttaagattaaaaatcggagatcatgctgaataagtttcattagccagcccaaccaggagtgtctctcttttttcttctttgtccctctcctccatcaagattcctgttcctgtttcctttattttattttaatcacactcagagtcctttttcacttttccagatacttttttcttaactgtcaaacattttctgtctctcaatctaaagaagaaaacttcaaaattcaagtccctcctcatcctggagctgtttggctcccctttcacctcaaactctcctactcagactctcctgagatcctcccttttgcataagcctgaaagtcaaagtatgtccttaaaacacacaaaatctaaaaagagctttattcttaagaaggagactgccatcatagataagtgttcaccaacagaactttccacaatgatagaaatggtctacatttgtgttgccgttatggcagccacatgtggctgttcagcatttgaaatgtggctactgggactgagggacttaagtttttaatcttacataatttaaattcaaattcatataggtacatgggcctagtggctttcttattggatggcatagataatcaactcaaactacaaccagattttaaaattccattctcccttcttgacactaagaagcattctcagtgcattccgttggaatctccagaattcatcagccagttcttcttaggggcagccagagcaggggttcaaatgttttatggatgactcacctcagccactgacctcgtctttcccacatcataaatcccagctcgggctaccccttcttcttgcccatgggactttcttgtatctgagtccagctgcctagatggagtcccttttcctagcaaagtcttggtcttcttggtctttatactagcctccccaccttccaccctacacacacacacacacacacacacacacacacacacacacacacgcacgcactcacacacacgtggtggaggaaaactgagacaattattgcaggtgtcaggatcaaaggagtatcaaagtgcagggtcaatacaaacctaaagtcaggcacagtgggacaggctgactttggcctctttccaaggtggttctgaaatcaaattgtgagcagccacaccatgaagctcagaaaagctcaagcagcctacaccccacaggctgttcatcagcaaagcaaagcgctttccaaatacaattttcaaaagacttaaaaacacaagcctcatataaagtattttgattaaaagatatatttaactaatcagggaggacattagcaggatgataaagctagttccaagagcacttgaggaagagaattttacgtaggaaaggaaaggaaaagtgaagtaagttttgtcaattagatacaaaactggctaatgtcctataaggcaataaaactctaacctattatagatttgcctttttctactggacacaagtcatctacatcattatagaataacagcagaaaaatgctatctattaaacttcgaagaatctatgtcccaaacaacagtaaatagtaggtcaaaccaaaaatacatttttctatagaagtaaatcattcttaggtatgcctcttcaatcatgctttgatgtaacaatgaaaagagggatggccatctttgcatattatttttaagcttgagataatttaaattcaattataaaacaatgtccagatatacctgtatttacactaaaagatacttacagtcatcaaaatgataataatcataataaattagtttttcaactgttataatcaacctattagtttttcaacttttataatcaacctaagggtagagaaaacatttaattatttttgaccaagcataacaaaaaagctgttacctttatctatttaaagtaagggtgccagacagatgctggaaattagaagggacttggagaaacagaggaaagtccagaggctttatactctcagcaagagggaaggttggtagttgatgtacaatagaggcttgcagatatgatttaaagtataaaagtagccaatcacaaaccaaaaataaaataatttcaaatttggagttgggggagaaaaagtagtgaaaatgcgttaagtggagttaaattgctgtgtttttattccaagaaaccgatttctgcatattcctggtggataattagtttagttactggctgtcttgccatgagtcctgttttcttaagctcctgtctctattagagttggacatatggaacagaaacctgttggtgccactttattatgcactgcagtaagtactggcttcatagtttggacggcagctgtactcaccgctataccaccaccaccactggctgggcttctcagttttaaactctaggctttcagcatgtggccctgaagccctttcactctcacccctccactttcttccacttgcatattgtgatgagaaaggtggtagaatgatctccttgtggtgtgagaggagaggaaggggcagcagggctgggggactggccccagaagcctcaatgaggaggcccgtttcaggctgagtcttgataggtgagtcagtcaaccactcaaagcacagctaagaggaagggagaggccagggcttctgcaagggcatgagtatgacagcacattctattgagggggtaaggggattattcagctagggcagagggtagggcagtggagtacaggggtgaaggcacagagatggccagtgtccacaccatcaatgggtttactttccagcccagggcattggcatttgattcagaaagctctagggaacctttgatggggtttcagcagggcagtgatcagttctggatgaccagtgacaagtggatgtggctggattccttgtgggagtggtctggagggtagtgttgggcttgaaggacttaatggacagtcagtcacacatatggagaaatacgggaggattttgagtgtaggaataaatgagaagatttttctaacctggtggatgtagagtatgtgagagaataagtgtagaatgaggttggaatttctagcacgggaactggacagctctgatgcaaggtggagagaatgccagagaagggggtacatgtatggatgcatttatattgtttctttctgaaatgacgaagaaccaaaagcaaaagtgatatcttctgtagtacctaagaagcattttgtatataatcacattaatactagttaaaaatacattgaatagaaagggaagaacgtaataaatgatccaagaggatgaacacatgggcgcatcttcctctctcagtcctcttctctcagggtgattgttgctgcctgatgggatgaaggaatgaggaccccaagaccctcacagccacaggcttccttcactcaccctcttatgtgggtgatactgcattcctcagggtagaggaattttttttttttttttgagacggaatttcgtgcttgttacccaagctggagtgcaatggcacaatctcggctcactgcaacctccgcctcctgggttcaagcaattctcctgcctcagcctcccaagtatctgggattacaagcatgtgccaccatgcccggctaacttttgtatttttagtagagatgtggtgaaaccccgtctacataaacagaaagtctatttacacagaaaggtttgaggaaaaagaacctctgacagaatattctgaattataattaggggtaagatcgtaaatgtgtatacttatatgagtctttcacacactctgtatattgtatgtgaattatcatattggaatcattaggctacaacaagctatatagcaacttaatgatgataaacaatcttgagtacagttggccctttaacaattcggaaatattttaaagacattacaacttaatccatggtgcgaaccactgctctagaaggctgagataaagcaatgaacaagacaaacaaagtctcagtcctttgggagtgtatggtccagcggcaggagaccaacaataaaccaataagcatagaaatgaatggcttccagcagtgttcaatactcttatgttactaaaaggagtgatagagggatcagagagacaggcagacattgaggagtaggggaggggacattgctgtgggttgggtggtcagggcaggccctattcaggaggtggcatttgaagttgtagctgaatgataagaagtagctagattggccaggtgcggtggctcacacctataatcccagcactttggtaggctgaggcgggcacatcacctgagatcaggagttcgagaccagcctggtcaacatggcaaaatcccatctctactaaaaatataaaaattagccaggcatggtggtgcgcgcctgtagtcccagcaactcaggaggctaaggcacaaaaatcgcttgaacctggaaggcagaggttgcggtgagctgaaattgcaccactacactccagcactccagcctgggtgacagagcgagattctgtctaaaaaaaaattaaaaaaaaagagccagtttggccaagaactaagggaaaagcattccaagacatggaaacagcaaatgctaggctctgaggcaaacatagtcttggcatgtcgaaagaagagcaccaagggtggagtgagcatcatggtcagggcatggtaagaggagaattctgagaagcaggcagaagcccctcatgtggagcagtagttctctcaaagtgtggtccccaagccagcatcatcagcaccacccagaaccttattagagatgcgcattctcaggcccatcccacggacctatggaatcagaaactccaggaactggcccaggcgtatgtgcattaacaagcccttcaaggaagtccggtgcacacttaagtacgagaataaatggtgtagaaccaggccgaggtgtttggatttcgttctgattgctatgggaagccattttcaacagggactggcatgatctgatttatattttggagacagttactctggaggccgtacaaaggatgattcgtaggcgggggccaaaaggttggagaagaccaggactttaaggaaggtgagctagaggcttaatccttccttttcctgactatgtctccatgggcgattttcttaatatctctgtgccagaaaaataggatatgttaaggtggatgggtcgaagaatatcagttgttctccttaggattctacgagtctgcacacacttttcttgtcagcacagctgtgtgacttcttcctgatgtgagaagaaagccaaggccaggcatctgagcaccacctcagttggcccgaacactgaaacaacccaaagcagcaaaaactaagatcagccagatttttgcaaagaaaaacccaaaacaacattcaggcctgttccttcctctagaccagcctttgaaataacagtgctgataatattatctggtctctcatgctcccaaagctcagagctcattgtcatccaagcatgagacctttaaggaaaggtctgtattgtaggtcatctcatgctgaaaagtcatagaactgggtcagcatactttttctgtaagggaccacatattaaatagtttagattttatgagtcctgcagcctctgttacagctattcaactttgtcattgtagcccaatagcagccatagaacataatatgtaaaaaaatgagcaggcacttggattagaagacaaacaatgccacatagaaatgagtaacaaattggttttgatggtaatggtagtaatgaaataattctagtttcaagtaattatttttactcctcgtgttcttttactactgtgttgtatttttaatttagtcaccctctatttctcttccttatcttgatagatcattgtatcagtttatcaccttttgctgcatacataacagactgctcacctttcttttctaagatgctctcatttttgtggggtagggcaggggcttgctcttctcattttcatgtctcttccctctctgaagtttctttgggcttgcttttatttcttcacaaaagtagaagataactctatttcctggaggaatggaagcatctcccccatgaaatagtgtctcagtcagtttcatggaaaatggtaatccttgagatccatgcttcaaggatgcaagaaggacgtcttattcatggaaaaatgtgagatgcatccattaggaaactagacagggaaatctggggtcccactagatttacaaggagcttgtggaaacaacacaagacaggaagaaagtatggaaaaaatatgggcaattaaattaaaatataagtgtaagcacctaggggttcttgctgccagctgcacaaagaaagaacatggcattgtagtaaagaaagagtttgggcaggcgtggtggctcacgcctgtaatcccaacactttgggaggcaaagatgggcagatcacttgaggtcaggagttggagaccggcctggccaacatggtgaaaccctgcctttactaaaaatacaaaaattagctgggcttggttgcaggcacctgtaatcccagctgaaaatacaaaaattagctgggcttggttgcaggcacctgtaatcccagctgctcgggaggctgaagcagaagaatcacttgaaccctgggacacagattgcagtgagcccagattgcgctattgcactccagcctgggtgacagtgacagagtaagattctgtctcaaaaaaaaaataaataaaaataaaagagtttaatagagacaaggccagccacaccacttgagagatgagttagtattcaagtcatcttgtccaaagctgctagtttaggggttttttaaaggcagtttgagggaagaggaggtgcggggtctaggcttctgctgattggatggggcagggatgaaatcatgctgaatcgcttctgggtggggccataggagtggggttggcaagtccaggtgggtccaggtggagacatgggtgtgaggcatgcaaaaaaaacctgaaaagatatctcaaaaggccagtcttagtttctacaatggcaatgttatttgcagaagtaactggggacattgcatgtcttctaacatccagaataatggctgacagtcatatatgtctgcaccttagcaggactcaggccctcctctcaaacagaagtggttggtttttgggcaatgcctgttatcatttaaactgtagcctaaacatctcccaaagttaccttcatccaaaagcccaggaataattaaggaaaaggcaaggtgggaggtgggttagcttagctaactgttataatttttctcactgatacaatttttgcaaaggcagtttcataaggaactagctgaggatctacttaggtctctcaagtactactgtactatgctaaagaattaaacacaatggctaaaattacagtgctgattctctattgcttcttctcaacctgcagtataaagagaaaaatgctcaatattagctacctcaagccgtgtctgtgggccgcaggtgaacaggagggtgttggccagggcatccttttaattagggttgatgagtgcagtcttgcagatcatcaggctagtggtgaagagaccctaaggacatcctggtttcattctctttgcacacctctttggaattgcactctcttaatgcatgtggtgtagccattgaattaacagagttcattcaagtgtggacaaatgaacagtcagatgaaatatacagcacatgttaaaatgaattcttttttctgttgagcagtctagggagaagaaatttttttaaaaaatcaagttaataattttgaagtcccttctcgattgataaaattgcacttctttaaacctgtgcaatttcatgccactgaattccctattcctgaaaattttcagaaattatttttgtcattacttgttttggttgtttttgagagggtgctgtattagtgagggttctccagagaaacagagccaatgggatatatagagatatataggtaggaagagatttattatgaaggattggcttacacaattatgaaggctgagaaatcttatatcgtctgtctataagctagaggcctaggaaaacgagtagggcagttccagttcaaacctgaagggccagagaaccaggggagccaatggtgtgtaagtgtcagttgagtccaaaggccccagaaccaggggcatcagtatccaagttgaatgtcccagatcaagacagagtgaattcattcttcctccaccattttgttcagttcaagccctccgtggattggatggtgccctcctgtattcggcagatcttctttattcattccatcaattcaaacacaaatctcttccagaaacagcctcacagacacacccggaagtaatatttcatcagccatcagccttagcccagtcaagttgacatataaaattaatcatgacaggtgttttttagcacagacagtagtaaatcactactactttgagcactcactaggtgctggaccttgcacttgacaaatggtataaatgatcaggaaagtatcctgatctagaccctaagagagaggattcttggatctcgcccaagaaagaattagaggtgagtgcacagagtaaagtgaaagcaagtttattaagaaagtaaagaaacagaagaatcgctattccataaacagagcagccctgacagatgctggttagctatttttatggttatttcttgatcatatgctaaacaagtggtggattattcatgagttttccaggaaaggggaagtaattcctggaactgagggttcctcccctttttagactatatagggtaacttccggacattgccgtggcatttgtaaactgtcaaggcagtggtaagaatgtcttttagcatgctaatgcattcatatgaacatataatgagcagtgaagacaaccagaggtcactttcttctagccatcctagttttggcagcttttggccggcttccttagtgcatcctgttttatcagtggggtctttgtaacctgtgtcttgtgctgacctcctctctcatcctgtaactaagaatgcctaacctcctgggaatgtagcctagtaggtctcagcctcgttttacccagccctgttcaagatggagtggttctggctccagtgcctctgatttaagcattatttcacttaagcctcgaaacaaccctgttttaagtaggtctttttagcttccttttgcagtttacaaaactgaggattaaaatggttaagcatgttgcttgaggtttcacaggctggttacagacttagcagaaaaatggcctgccagctagcctacagtggatctccaagtatggtttcagacagcatcagcaacatttgtgagcttgctagaaatgcagattattaggccccaccccagacctacagaatcagaaactctggggggagggtccagcaatctgtgttttaagagccctctcagtgattctgatgatgcagctcaagtttgagaacctaggcctagggaaaggtaaggaattgtagacttactagaaggaaacaaaattagatccatttaaagttctttacagctaatcttcctcaaacaggcaacacagagaaaagggtgaagactgttgaataaaagagacttctttatctaggctgaacatattagatttattgaacccttgacacagtgcaaagtacttgacatcagtcatctctttaaaccctcaggtggtggtgagggctaaatgagattttccacagtttacagatgaggaaagagaagcttaggtcacttaagaattgcttgttaatcaacatgtagtacgtgatggagctagcgtccagaactaatgtattgctaaagagaacatacacaggtcacacagctttatgacccagaatggctgtcagcagagaaacatgtttttgaagatatatatgatgtataaaatacataattaaaaagtctttctaaagttcattaataggctggaaccaaagacctgtttaactttttactcaccgtttgcattacttattctagaccataagtattatactactaagtctaggtgtctttagtctagttctcttagggaaatgagaatgggaagactgtatttttcatataatttcccccacattccccaaggaaagtgtttaccagggcttttttaggttttttgttttttgtttttttgagacagacggagtctcactgtgttaccaggctagagtgccgtggcatgctctgggctcactgaaacctctgccccccaagttcaagcgattcttctgcctcagcctcccaagtacctgggactacaggtgcgcaccaccatgcccagctaatttttgtatttttagtagagacggggtttcatcatgttggccaggctggtctcgaacttttgacctcatgatctgcctgcctcagcctcccaaagtgctggtattacaggcgtgagagccactatgcctggcctttcttttttttctttttctttttttttttttgatacaggacctcactctgtcacctaggctggagtgcaatggcacaatcatagcttactgcaacctctaactcctgggcttaagcaattctcctgcctcagcctccctcccgagtagctgagattacaggcagagccaccacacccaggtaattttttttttttttttttttttgtagagacagggtctcactatgttgaccaggcaggtcttgaactactgggctcaagtgagcctcctgctttggtctcccagagtactgggattataggcatgagccactgtgcctggcccctagtctttaatttttgaggggggagaaaaactaggtaaaacatactatatggaaagattataatattttctttcaattgatggacatagacataaaatattgtcagcgagaaagcctatctttttaatatttattttgataaactaacaaggagcatataatttataaaatactttctcttaaagccataaatagtaagcacttgctccgaaatgctgctttgtcaagaacgttaattgaagcagatgagcagagtcagtatagcttcccaggtccagcctgcattccctttctactgcagagttacgctgaggacagcatgctggcacctccacggctcttctgctgtcaacttttcttctcccaagtacctgaaagggcaggtgatcctcttaactttgtagacatgtgaaaaggagactagtttttgaatgctcaccaaaagccaagttgccaggatattgtttgcaaatacagaaagggtttttgtactaagtggtatttaaggcaaaatctttgccaaagaactctatccaaaagcttgaaatacacatagttggttaagggaatgcatttggagttaaacagaaataggttcagttttggctttgctactcaagagatgtgaccatgagtcagtcttaacacccaccaagcactaagccagagcttccttgtttgaaaaatgggagtgataatacctacctcgcattgccatcataaggaataagtaagatggattttttaaaaatggaagtcagattatgcccttcttttggtttaaacctttaatgggtttctacctcattccaagtaatttccaaagttctttctgtgtcctgcaagtcccctacatgacctaccatttcgctgtcccattgatattccctgagcattctaggcacactctgacctcagggcctttacacttgctgttctccctctggactactctcctctgtacagtcctcatggttcacttcctcacttcattctgtttctgctaaaatatcacattctccaagaggccttcttactcacctacacacacaggctcctgacccttctggatgttttatttgttacatttatcactacctgataacttactcttttttgttcattgctgaagtccttctagaagataagccctgagagtagactttgtttcctgctgtatccccaccagggaattaattcatcactcaacatatttcataagtacctactatgatccagcaattccttagttacttatctgagactgaaattcattgatatttccatggttcctaatttttaaggaattttaaagccccaaagaactggaactgaaaatgtcactttggaatgtggagaaaggttaagccagagacactatctgtggcagctatggaggtgtgtcgcttaaatctcccttcaagagacagctgccccaggagtcccctcattggacagttttgctgcaggggcttcagcaccctcaaaatgtccctgcccaggctgtactgaacatggcaagctgctacaaccgggcctttcctgcccaagtgaggctcctctggtgggcgttctgtgctctgcagctgcaatccagcaatgttctcagctgtactgcaagctgagacaattcctccccagttctccctgctccctcctctcctctctcaggtgtttgttctgaggtctggtttggaggctctccctgtcactcggtttctctcccctttctctttcacaggcatttgccctaatgaattgctcacatttccaattctgtcttgcctgtaatctcagctactcaggagggaggctgaggcaggagaattgcttaagcccaggagttagaggttgcagtaagctatgattgtgccattgcactccagcctaggtgatagagtgaggtcctgtctcaaaaaaaaaaaaagaaagaaatttaaaaaagaaaggccaggcatagtggctctcacgcctggccaacatggtgaaaccctgtctctactaaaaatacaaaaattagctgggcatggtggcatgcacctgtagtcccaggtacttgggaggctgagggaggagaatcgcttgaactcgggaggcagaggttgcagtgagcccagatcatgccacagcactccagcctggtgacacagtgagactccgtctgtctcaaaaacaacaacaacaacaacaacaaatcctaaaaaagccctggtaaatactttccttggggaatgtgggggaaataatatgaaaaatacaatcttcccattctcatttccctaagaaatgtcttgggggtttgtttctagatggagaagcccttccctcagggtaagaggtcctcaggataagcctccaggactctgctgccatttcctgaggccgactctgagctcactgcagaattctctaggtggtagcagtggttcttgtgtgatgttccagtaattgctgcacttattttagacacaataaaaagtgacagagccagcattgaccctaagagccagtggggactatgtatcttcaaggcctaaatataagctatttcagaagacaaaagtccaactggagtgacgtatcatgcagctcttgtggaaaaaaaaaagcattttcaaaagctgcattatttaaatgagaaatgcatatatttaaagggaagttccataaaagtcatttgagattccttttctttcaatgactgtattcagcattgtctattatctccatatatcaatagtttaaaatattttttcatagacctgccttttcagaaacatcttctatgtcactgtatttttaattacttgctcagtgtaatttattatgctggaactaattgtgttttaattagaaatgctttgctaaagagaagaacttatcagtttgcggcggtgtttccggtgcaactacaaagcacgtctcctgtttttcttaggatttttttataaggggacagccacataatgtgtttttaatatttgttgtaaatatttattaagaatcctgtttacttgcctccataactctaagttgttcctctttaatttttccttattttagttgctaaggcaactgttttgactactgtgacagttttcctgcccaagaaagttactttgagtgaccacccactcctcttgaaaacacattttgctttctccttccttctgcactctgagaggtagttgttgaatattttaggaataatttcttcacctcttttctggcaagagtcagggaaccctcccagaatctgagcatccagattttgcctcacaatcctcacagcagagacacttcagggagggaaaattacaaacctagacagatccggagtgttcagccattcaaactggcctgcctcacaaatcaagtcccaaagatttaacatctatatcgtcaagtaaaagataaagtgggaatccctagctattagtgaccataaagtcaatcgttagaaacagtttggcctctcccaggtggctaatctgggcatttcatttctcccccagattcaatcatagttaagctgattaaattctcaaagaaccaaggatatttctgagaccttgtatctaagttctttcaggctgctataacaaaataccatacactcggcagctataaacaacacatttatccctcacacttctggaggctgcgatgcttaacatcaaggtgctggtagattcggtgtctgataagagcccatttcccgattccaagatgacacgttcttgctgtgtcttcacacggtgggtgaaaggggcagccgtctctctggattcttttataagggcactaatcccatttatctcccaaaggcccccacttcctaattccatcacatttgggattaggatttcagcataggaatttttggtggggtagagcacaaacattcagaccataggaccttggtaagcaccatcaggccaaattttattttattttttaaatatataatatgagagatcagaaaagatggtgtaccttcctttgtttcttttcaatagccttcatccactcttccaagccaggtcacttagaaagttgatgatgttctttattcctgaggtaagaataaaatgaaaggggtggattaaatctttctacttgacaccagaataagcgttctctgtatctcactgtcattgctggaatgagcactttaaatgctcatggttgattactgagggagagacgttttcatttttgttcctattggttttgaaatgaaagatagacagcaggtttaccaccttttgaagttgctgaataactcacttcattgccctcttgtcatctgagaacgtgctctgtcgtgtcagggaggtgcagggcagagtctccccaaccaggaatgacctcttctgttcactataccccaacatgcacttgaaaataaaaactgtgttgtgatggctcgtctgtggcagcagcttcttggcctgattgtagactgaggccagcttaggcagagtgggatggaggagttggagcaggaacaaacagaagatgaccttctgtgcagaaaccacattttcaacaagtctaagtcaacccagagttacgaactctgggtttcccttatgcttagctttgtattctagctcactggaaatagacatgcactaataccattgctctttttaaagatctgtgtaacagaaatggattccctgtcaaaatgtatttgtatttctgcctcatattatatattatctgcatcctcttgggtgacttgcctcacctcagttaggaaaagttttctcatctgtaaggtagggatggtggtgtttacctcatttgtctttgatggttaataataatcagtactagcaacattataatgattattattactatgttttatattaataatcaatactgggccaggtgcagtggctcatgcttatgatcccagtgctttgggaggctgaggcaggaggactgcttgaagccaggagttcgagttcagcctggacaacatagcgaaactctgtctctacaaaaaaaaatttttttttttaattagccagccatgatagtgaatgcctgtagtcctagctactcatgaggctgaggcaggaggattgcttgagcgcaggagtttgaggctgcggtgctatgattgtaccaggagtttgaagctggagtactatgattgtaccactgcactccagcccggatgacagcaaaattctgtctcttaaaaaaaaatcaatactggccgggcgcggtggctcccgcctgtagtctcagcactttgggtggccgaggtgggtggatcacgaggtcaggagattgagaccatcctggctaacacagacaaaccccatctctactaaaaatacaaaaaattagccagacgtggtggtgggcgcctgtagtcccagctactcgggaggctgaggcaggagtatggcgtgaacccagaaggcagaggttgcagtgagctgggatcatgcccctgcactccagcctgggtgacagagcgagactccatctcgaaaaaaaaataataataaaacaaaattaaaaaatcaatactaatttacttagttcagactatgtgtcaagtgctctaatgcccagaaataacctgtgagataggtattgtggttgatgttgttgtctctgtttttagagatgaagaaatgaatatctaaccacatttggatcaggttcatctaaaaccctaaagcctatgtaaaatacccaattgtttctgctgctggtgagttggtttttatgcttacatgtttctctcaccttccacaggaagctgtaatgtgaaatatgtaccaccagataaaataacggaagagggatttagattgaagggaaaaaagtaaacaagggagagtacatcaaatgaggggtaaatttagcaggcagcaactcaacaagcagcgaaaatgatctgtaaagttgaaagaggtgagcctcagatttgcttctggtgttcctggtggctaaagcaatgtagaaaacacaagttgttgtagggttcacagtgtccattagattgtaaggaaagcaacaggtcagtaggaacagagtttttcctggtcctaggatctgaaaaaaaattcttacagaattcttacaaaatacactcccccataaaaaactgtaataagtacagaatgtttcagtagtacagttgttcagttatctatgtggtaggattcacggggaatccataagaaatgcagtaattaaaaccaaaacacttcagaaacccatctgatcctttgtgatgattgctggcatcagtggcaaggagaatagcagaggcttcttcaggtatgactgctgagcagttacctgagccgactgctgagcagttacctgagcccactcctgaacactgtcagtctttcatgtgtcagcctcaaagcaggtgtagcatattgttcaaaacatttgatctgcatgcctcaatgtcctcacttgtaaaataggtataaatagtgaagcagcgttgtttgtctggggtaatacccgaggttcgttgtcccacagccatggaaagctaggacgtggacacatcagagtgaggttaagagtggaagtttaatagacaaaagaaagagaagagctctctgcacagaaagggctcctggagaaaatgggttgccacttccgcagtgaaatgcagaaagtttaataaatgaacttaaggagggggtatgtgatttacacaggggatgaaagatcggttggaggaggcatgccatttgcaagtgtgcaaagaagctggccactccaccctaatcttttattatgcagatggttattctagctggctggtgccatgttgcctcgtccttattgtacacgtggtgacaaagaaaagggaagatggagcctccgtgttgaacatacctggcttccaggtagccttctcttggcgcagctgccagcattcacctgtacaagcttccagcttgtttatctatgtctgtagctcggtttttcaggctgctctttgttagaaaagaaatgatttgggggctacttttattaaaagggaagccttgccgaagactccttgtactgacactatctgcctaataatttctttctagctcctatatcaataataaaaatggtacctccctcataggaatgttgggaggataataagttaatgtagagaaagtacttagagcgttgcctggctcttaggaagcactgtgtatgttacctagcaatagtaggcatattactaggtgccacaggccttttgaattgctcatcaggagactagaacggcatctccctgttggattccagctgagcatcagttactggtggaagggggaaaggtctatatttaacaacttaacccaataggaacatctgtccaaagaatcaaaggccatcaaaaggaatgcaggagctacacatgctgttattttgtctgacagattttttcacaaggtaatacttgtagcacatagcaagggtctgtgatggagcagctacagccgtgccctctggctcctcatgtggaatgtgagctgagaggcccagtgtcctttatctcctgggatcttaaagcagataggagaggcacaaatggaatgaacattctatatccttccaagcaagagaccaagctcatgagggtaaaagcaacttaataaggacccatgcccatctattacatcagtccataaatcattctgatggcaggatgttatcactgagggctttagtttaacttgaaaaaaataaaaatttgtggttctgagagaggcggtgtttgtgcagaatcacaaaggatctgctaggtatgaagcttaaagcatttccctggaataaggagaggaaataaataagccataaagcatctcttgggctctgagctttcaggatctgatagaaagctagacctcttggttaattccaaaccagactccacctgctttcccagtctgaaggccacacccatcattctccctggtttatgaggtctctttggtggtagtcacgcataatgtgatttaaattgaatgagatcctttatggcctcttcctcagactcctctttgtttctctccaaccttgacaaggtctttttaacttcctctccattcttatcaaaccaggaagcaaggagggtgagtctcatatgtacctagtggagtctacctaggcagtgttcgtttattgaccgtccaacaatcttctggcgataggcagaggggccctgcttggtcaagtttgcccaagtcagacaggcatgggctttggaatcagagaagctggcttgaatttcaggtttgttactatttgactgtggctttgaataatttagtctcctctgaacctttttccccccttctctctgaaaccgcattggccaatatggtaaccactaaccacattgtggctgtttaaatgaaaaattaattaaaataaaaaattcagcacttggttgcattacccacatttcaagtgctccctgtggctcatggtgaacgtattgggcagaacccatctggcacatttccatcatcacggtaaatccgttggacaatgttgatctagtctaaaaccttgcagagttatcatgagatttatgtgagatagtatttgtgaaatacctcacaacaagagccctaaaattgtagctattttctcataagtacgaccatttagtcagcatttactttgtcccaggtacttagacattctcaatattaattctttgaaagccctgtgagtcggtatcagttttcccagtttacagctaggaaaagtgaaatatggcaaggttaagcagaataactgcaagattctccagcagttgcctggtgaggaggctgacatgcaaacccaggaaccaaccactacaaggcctggatctcaaaaccactgtggactgccacctcttctgaaggttttctttcccagaaaacgcagttttgtgatggaatgtgaatgcctactccatttcacatttctctacgtcctaatgtatctgtccagtgacaaacacagaaaagcccctggccaactcatgtttaaataaggtagagttaaagcttttatgatctggtccaaaatagctgtccctagctggtaataagacttgactatgccctatttgaagatgccaactccacagtataagatacagacatttgcagttaacttaggaagtgatggcgagagagagggcaagagagaaagggtaagaaataactacaactcacaattaaaataaaatcagctaccacttagctgtatccccatccaaggaatttctccacttcaatcagagtatttggcctgctgaactctctgacattccttatgaggggattaaactttattgaacagaatcactttaaaaattgaaataaaggaaaaatgtttaatgttagttgatttgaaagtaacttgaatctttgaaaaataggttgtgatattgattaatgttgaaacagcatgtgtgagggaaaatatactaaaaataacacacaagtgaaaaacatactctatctttgataagagagggaagtgtctctgtaagcctgtagtggcacaaacccctcagagtggggatctctgagccagaaatagcttctagcaatggtgatctccagcaaaagtgattctagactctcaaacagaatgccctctggcctctgcttaagtagtttcacaaaaggtgttcctgtccctttctagccttgctctctagtggcctaagagttgggctggatgagctaacgtgtccttgagctctaaggcgtgactgatgaattttaactaatatgagaattaaaattctgcccaccccccaaggaagttctcttatggtttgtttctttaccagaaaattctgttaccatttaactgcaaaacaaatagattcccaaaggagaaacattccagctttcttttatgatctcccctgcagggcccagatctggaggaggatttttctgacaatgggacttcacaatagcctggcctcaatctggtcagggagccatagcccactttcaggtcaggagggattcatgtgaaatttaaaactgctgttagggaaaaaagaatagacatgatgtgtctttactcaccagagggtagggttattatgtttgttagtaggaggtggtgagaaaccaaattagattgtgttttagttcctttcagctgattacctctcatccctcagatttgctctgtgaattttcatgggtggtttgaagcatttggtccaagaacctttcagccacagttgatgagctgattgtgggttttgtcgtgagcctggtctttagtgtcagctgggtttcattctaagatccccctggagaatttctattctgataattgcttctcttaacaactgatacgtttttattttatgagctggatgggcacctggtaaatattttttttcccttttttgcttttgttgctggggagcccagagccaagttgctatcctgctataactgtgtaggaccttatgacaggcatttcagagagctgccttttactctggccttagtttactattccactttatttttcttctctttgcccagatttctcatcctattttgaaaatgatttcttcacagtgtcaaacagtgctcctggttcaataggaattcccaggacgtgcctcaaagtcacccccaacctcgaagatgagtttgtatgcattacaaaaagggactcctgcctttaggcagacggcctcaaccagtgcccttgtaattgcacttctatccttggcagtcttccaaggacttccttgttgggttctgggcctgatgcagccccctcaatttgagcaacttcttgtttatttgttttacatattggcctgctgcaaaatcttttatttaaaaaaattcattttttcatttatttttaagttaatttgttagttttatggtgcttttgatgtgctaggtgctagaacacaaaggtaaacaagactgcttcaaggactctgccctcttggaggttgttgcattctggtgtgggagtcagtcagtaaatcaaggatcagggagagcctctctgaggaggggataatgaagacaaggtctgtagaatgaagaggagcctgatgcaccaagggcagtagaaagagacttctgagcaagaggaactgcaagtgcaaaggccctgatgctagagagagcttgaggggttgcaggaaaagagtttttatggttgtgaacaagaaatagaaggaagaacagagagtggcatgagataaaatttgaaggatcccagatcgttcaggaccttttcggccaggtaaggagttgggattttatcctaaatatgataggaatccattgaatggttttaataaattcattcaaagtttaaagaatcaatctggctcctatgggcagcagaaaaagcagaagtgagaagatcaatccatgggagagataatattggtttgggccaaggtgggtggtgatggagagggagtaaagtgggtgtgtattcgaaatattatagaagaagacttgctactgaaagtgagaggaaaagatgagggaaaattaaggatgactcttagtttcaataagtgaccagatgctagtgacatttatggaactaaggaagtactgtgatggagaaacttggaggggagagaataaagagttcagttatggacatacttatttcaagacatcctagtggagatgtcaaatagcaaatatttgaactcacagaggagaggatggggctgctcttacaaatttgagggtcatcaggaaatagatgatattgtagacacaagattgaatgaaatctaggaacacagtggaaatgagaattcccagaaccaagtcctgaggactatgtaaaagttgagtacagaaggaaaaggcgggaaattagactaaggtaatggagcacaaccaggattggagagtgtttcaagaaggaaggaataatcaaactctcagagatcaactcaggtgaggaaaggaaggtgtgcactcctattttgcagcatgctggactggccagagaagttttagagggtgatagaaatggaagccagatagagttgctcagatggtatgaagagaggtaatggaaacagtgaatatttctaagatattatgtcctgaagaggatcagggacatggggtagtaagtggggtagtaagtaaccattgagaaggaaatataagattaaacgtcactgttgactatccatttgaggtttataatcttgaatttaaactaaagccagacagttccattttgtgattttcaccaccaagtttggtgataaagtatgcataaaatagacttcgttttttggccaagaaaacactaaatgagacatggaagttgcgaaccacctgtgagggagtgattgcaatattgggctgctttggaaataagctagataaggatggaagtaaaaggaggagggaactggtgcgtagtgagagattggcagggataatcaaaagggatatttgactttgcaaagaagtcaaatataggaggggagaactgtagagctaggggctagaaggaccagatggaattccaagagtgagatattaggaattgaaatgtccaggtggtaatggcaagctctaggggtactcaggggggaaggaagaaaagaattttgtatttaaggaggccaaggaagtgaaagttcactctcaaaataagttggaaacccattcttatttattatttgtatttcatgaatcatctcaaatccttacttggaattaggtgatagggtgcacataagaatgatagtggctgattctttgtggatctactctgtaaacaccattttacgatgtacttttgtacactgtgtaccaaaattcttcattgccgtcaggatattcattgggatatatttggaaatgggctaattcttatgtcttgattagttgataattctcatttttttagtcagtaacaacataagacccgccatggccttttgggtaatagctaatgcttttcaggtggcacggaagacccttgcaatgaaacaactcttctatacatgtcccatcacaccccctgtcattctcttgaagtgctctagccacacaaacaaatttctaatgtgaggtcaatagctgctcactctgcctggcatgaagattcatctaaagtatcaacttctgggttaagccttttctaaaaggttgaactgtccaaaaatgccattttgaagggtcaaaaaatgtcatatactggcactttcatattgttaataatttgctaccactattacaagtctgaaccatgcattgttggtagagctattacttgctgaattggaattctgtgttatgtgctttatgttcaccatctcatttaattccagcaataaacccaaaaggtaggtggaactacttccacttgttagacaaggattctgaaatttagaaagggtctttctgggagagagtacataacaaatggtggaactgggttttaactcctaaagcaaaaattataccatgccctttcctttggtcttattcatggcaatgacagcagtacagagcacacgcctgatacagagttggaatacataaatacatacagtaatacttcatctgccagaaaactacccaaattgaaggctgctttgttcagggacccctaggactactttatgatggcctagtatcttggcattggatttaccttgataaatgttgttgttcccctgtaatttagaaagataaattttaacaggtgaaactaagagtctgaacggcccttaaaaccttaatcctgtaattactatttatttgttttaaggcactgccttgatccatgtttgccagacaggttcctaattgctggcattgaaatgatctaggaagccagtttcttcagctcatgaaaagaacatgtagatttgttgaagtgtgaatgctaagtattggtgtaatgcagtcagagggcacaggacatctatgttcatttcccaaatgccctttttctttcattcacatggatttttcctctcattcctaagcacagtggtgctctaataagacaagaagtcagttggcaagtgtaacacagatgctctgatgccttgaatttggctaatattgcttcttcattcaaacgtcattctgtagctttccctgagtttctggtgtcaaaattcaaagcaatggttgtcaaactttcgtgtgtgttcgaatcttctagagggcttgttggaacacagattgctgggtcacatccccccagactctgactcagtccatctggactggggcctcatattctgcaattcagtaaagctcccagctgatgttgatgctgctggtctagtgactacactttagctctaggggctgttcaagatgcgctttacaggacaccaaatgaggttagataaaaaagcaaaaatctcagcaaatatctgaatgctagattttacagacaaaaaaaaaaaagaaaaaaaacacaaaacaaaaaccagtgacttaaaaaataatgtatctcctgatttttgacatcagtgggctagaacttgggaatccttcttccaagatattaaggaaactttcttctctatgactttcatgctttcagtcagtatgctttgttcttaaacctatcctagagcaagatgttttattaaattgatcagttttacaatacaaaattgaaagcaaagagttttcaaaatgaaaacattccataatacaataagaattgtggatattacatacaaaagagtgatttctaatttgtttagaagctcagcaatattttcatttttattagattcaaaatggtgtgagtcatgaagatcaacacatttctttttgacaggaatcctttgtgtttgaacccaactgcctcttcaaagtggatgagtttggcttctttctgacatggagaagtgaaggcaaggtatggcccaagaagagcaagttgttctttctgctttgtggtttaagccattttgtttctcaacaagtagactgagtgctgttgatgaaccctacccttattcattcattcaagatttttaaaaatgtgcctacatgtgccaggcattgaagtatacagtgatgattaaggacattatcctcatagattccagtctaggagcaatgtcaggcattaaaaaataagttacaagtcattgaatgttgtgaaagagaacactggattgtcaaagagcttaatttaatcttgggagttagaaagaaatctgccagaagaagagatgctcaagctgaaatctaaaaggtacattaaaagtgtgttcatctcattataccctgggacttaattcgatgtatggtacagtgtccacatttaatgaacaattgagctgaatttaagaaaagaattaaagttatataaaaattagcatttttctcacatttcatgtacacacatgtatttaatgattattaacaatgttttatatataaaagtaacagattttagaaacatttttatattcagcattgcacatatatatgtctatatgtatgtatatatatatatgtgaaatggaatacttggggtcttgattatttctgattatttacaataattattgttacatggttttaattccctcttcaagctgactgtaatcagcactgccttcatcatcagaaatttttgccaagcagtttgcctgtatcataggtatggcataatttaagctcattgctgtgttgtattctctctcttcaggaaggacaggtgctagaatgctccctcatcaacagtattcggtcgggagccataccaaaggtacctgtgattggtatttgcttttctaaacacggatttacttatattggaaatggccatggcttctagagataaaaaactcactctttgtatccaggctacttaaaacatttgatctcagttttgagaatagcatgtggttgctggttgtggtaatgtcacatttattcacatgaaacctctgtgactctcctctggtgagagagaggctttgtggacaagcagaccctaataaaaggctcttctatccaattgccatattccaggtcctccaataactacaatcaaaactctaaacaaagaccctcatatctagtttctaaatcaaaaatttaggccagacacagtggctcacacctcccagcactgtgggaggcagagggaggcagatcccttgagcccaggagtttgagaccagcctgggcaacatagtgcaaccctgtctctacaaaaattacaaaaattagggtgtgttagcatgtgcctgtagtctcaactactcaggaggctgcggtgggaggatccattgagcctgggaggcagatgttgcagtgagctgagaatgcaccactgttcaccagcctgggtgacagagcagagactctgtacctcccccaaccaaaaaatttgtaatacctttcttatcagttgatttcaaggaatatatagtgttacaaatttcacctctacaggttttagaataatgctaggtgtctgggcccttatgtttatttttacattaaatgtggtttctttttaccacgtttcttcctccatgctctgtgatgtaacttatttttttttctatctgtgtacctctatacaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaaggtagcttcagttaaatggcctccttctcttccccaccatgtatatatgttgtgtgtttaattttatgcgtgctatatttttatatacttaaattgtatggtaatttaaaagttagcattgctttgctgacatgtttctgtagaaaatcagcaattaaaatacccttttagcatgtcactcctgtgggccaacaacccaaatacctactacgatatgttgtagggatactagtccagcacttctccaacttgagtgtataccagaatcccctgagctcttgttaaaatgcagattctgattcaataggtctgaggtggggacaagattctccttttctaacaagctcccaggtggcatggatactactcatctgacaactacagtttgagtgacaaaggtctagatcagtaccacccagtagaaatgcaatgtgagccacatatataatttaaattgttcttgtagctgggttttaaaagtaaaaagatacaggtaaaattaattttaataaaatattttatttaacccagtagacctaaaatattgtcattttaataggagatcaatataaaatttattagtgacatattttacattcttttgctcatactaagtcttagaaatctgatgtgtattttcaaatcagactaaccacattttaggtgttcagtagctgcatatggctaatggccaccatactgggtgggcagtacgggtctggatggttaagaaatccaaaccccccctcccaataagttattaaaatattgggttaagatcagtcttttaataccatatccagcataccattgccctggcaagtgagtctcaaagagacttctcgaagaagtagaaagcctcgtaaatattttgtctgctaatcatgtgtttacagggtgattttacctctgtacagagctcccattatctttctgtaatgtgtgtgaaaaggactaagccttcactttccatggcagaaacatgggtttgggggaatggggaggcattttgtcttctcattaaccctataattggaaactcagtgtaggttgaatgagagagggttccaacaagtggaaactcagtgtaggttgaatttctaatatcattagaaatattgaattttagagctaacaggaaatgtacagggaagatcatttgaggacactgagattacaaaacttaaccatgaatccaggataacttatggcagaattgagttctgttgacccctaaaccatccaagctccattaccctcactcacaaagtatggtcctcattccagaagtacagacccctcctgggagcttgttacacatttgagtctcaggcccacccagatgttctgatcctgaatcttcatttttgacaagatgctccaggtgactcggatgtgtggtgaagtttgagaactcctgttttgtagctctggaggcagaagtggatgctcgatgtcacataagagtgtttggttctgtccttattgtggtggttttatgctatcgttcaggtcacctcactttgggagaacagattttgcagtgccttcaagttcttttattactcttctgagatcaactccttctctaattaccaattcatattacaagaaacaggatgatgcagtatgagctcaagtattggggctttggggccacattgcctgggttcaaatccttgctcgtccccttcccagctatgtgaagcagatatacgctggacctctctgtgcctcattttcttcatctgtaaaatgggaacagtactagaatatctgctcttaggatgattgtgaggcttacatgagttatgacgtgggaagcactttgtgtactgcctttcttattgaaagcccttaatatgtgttagctattaggatgacagaggccaagaattttagagttcgaaatggaccttaggaagggcttctcacctcatttttcagatgagaaaaatgaagctagagaggtaaaggaactctgagaccacacagcaagctgggccagagtccaacctaaaaccaggtcttctcatgccctatatgctgcacccactttgctctgtgccctgagcaaatacagtcctggggagatggctcaaatcagtaaatcccataatgtttttgctttccataatttggttgctgttagtcttggcccattctaagaaccacgttctgaaacatacccttgagtagattatggatgtgtactgttggcccttgaacaatgtgggggttagagctaccatacccctgtgcagtcgaaaatccatgtataacttttgactcccccaaaacttaatagcctactgttaactgaaagacttatgataatattaacagtcaattcacatactttttgtatggtatatgtattacctattgtattcttacaataaagtaagctagagaaaaagcaaatgttaataagaaaatcataaggaagaaaaaatatattattcatgaattgaaagtggatcatcataaaagtctttatcctcatcatcctcacgttgagtaagcagaggaggaagaagaggaagaggttggtcttggtgtctcaggggtggcagaggtggaggaggtggaagtggagtcaggagaggcaggcacattggtgtaacttttactgaaaaaaaatccatgtataagtgggcccacatagttcaaacccatgttgttccatgaccagtgatatatgtttgagggttgggggtggggggatgtatacttcaagggaagatttgaaggttttctcctagtattattgccattgaaatttaagagcagctagccagttaagaactaaaaaataattctgtattggattttttattcaaactcaatactatttgagcctgctcttactgaagaaactaagtgtttcagcttctgggaactattacatcgaatttcattaatagcataatatataaataaatataaatctcattgtccaaactggacagtgcattgtcctttcggttgattgacactggagaaaatattgagtacatttttccaccaaatatacctgcatgtggatactcttgcccccttccttatctcaaaacttaaaataaccatatttaccaccttcagcattgacaacattttctccatcaccaccgttttatttctattcctctatatgtgtttctattcctaatagaacacacaagccatcaaagtgaaagtctttatatgaaatacacatagatataattacctcagttcgaaatgatggcaggatacataaatcaaattgggccaatgagaaatgtagagatttcccagggtacatgaaatagtgtttgtgactcactgagtggttctactcaaacgtgagtatagcctaggagcctagaatcagggggccatgaaatatactaacagccctcttacttagcccatgcaatgagaaggtgcatttttggtcagtttatcacaaaagtcaattcgagcaagtaatcattttttaaaattaattcatatataccttaaacactgtaacttaaggcatataaatgttgttctattgttgactaatcttttaatgttagggacaagccttttcattaattgtggatctgttgcgtggcttttatgttttggggttttttttttttttccccctgtactttactctgaatgcctcagatagccagtttggtttctttaaggtggatctgagactaaggacactcattgggcagagtgcaatggaatgcaaaatcctacagttctgtgacttttttccctaatcttttagttatcttgtctacatggaatttgagaaaaatatttttggcaacttgcctttaaagaaatcttcccaaaatattcagctagagaaacaacaatgccctttctttccacaagatcgtgtcattggtttacgcaatttttatgacaactgacaataaataggtttgaaaacaaaagtaacccatggtagacatgtaaggtgagagtaaaagagtacaaaatattggaaagtggcttgctggctgggagagtccagcactccctgggcaatctgtgtattttgtttgtcttataaacacctgatgagtcttggtctgacaagtgaaatgtaagttaagtgagtttctagtacagaacttgcttatgagtatcctatgagattcatgagtctttttttttttaattcctaggctcttattacacttaagatctgaccatttggaataattcacttaacccaacatttaatctaggcaaaagggtaaactttgaacttagtgtcttttataccaaggaccatgttccatgtggaggaagctttcctgactttcagcaagccattttcccttctgtattcttctacttctcaaagagggtctctgatagtttttttttcatattcaagtgggtgctttaagagtcaataaaatattatctgaaacctgagtttctcagggttgaattttaaataaatacaaaatactttccagtgcatatgactctgaaaatatgattgtgcttttttcagtaaaagataacagcattgttaagagacaccttggtagctcaccttgtcttttcttcagcttctctctctgctttgagagtaaatacgtttgtgttgccactcttacctatttaggagatttgtgctcagttctatatacctttctcctctaccggtaagtcccaaatcaaagctttcaactcttctcacctgcttctcccacagtcattttcatctcaacaaatgtgctctcagttgcagagaccattctcagttgcagagaccatgaacaccttcctcttgtgtcctatgttagtctgttcacaaatactgtttgctctaccctcagcaggtatccagaatccagctgctcctcaccaacgtcatcacgacacagtggcccaggccaatggtccaggccaatatcatttcttccctattgtgccccaagaggtatctaactggtctcttttccttagccttgcccattttggtctagtctaaaaacagcagctggagggatgtttttaaaatgtaattcagatcacatcactccactgctcagaaccctccaaggccctgctagatatcatccccacctcccttcccctttctaccttaatctctctctttcctcctacgcattttcttccagcctctgggacttggcatttgctgttccttctgtctgtatcgtgctctttcccagttacacacagagctttctcccccacagccctcacgtgtctgctggaaaattgtcttagcaggagctccccatttcaccagccttcggcacttcctcactccttttcctgctctgtgtttcttcttagcacgacttacttaccataatatccatttattcatttattttcttcctctgtctgcaggacggcactgttctgttcactgctgtatctgcaacatctagaactgtcagtgcccgacacttagtgagtgctcaataaaaacctattctattgaggtatttatgttgactaaatgaattccaacccaagtgataaaggtgtataaaccttaatgttgtgcaactcaagtttgtacagttcagttgttagaacagacaggaagatgatcctttgacaacaagactgagaaaatgtgattcaatgatagtctaaaggaaagacagaactctgggatcccgtgtgttatttttagagccacatttcaggatgtaatagcgctgctgctaagaatccatgacgagactggaggttttgaccctggtgtcctggcctctttccagtttggatcattatgtcctgcttacctaaatccttcctgtcgttacagttagagaatttagctttcatttcctctcctaaacaactgcctgttaaaaagaattactaacaaattgctgtcatatttaccccaaacctagtacacctttcgctaataggcgagtcttatacatcataaagcttaaaacagttaagaataaatgcagcctactaaaaaaaaacaaaaacaaaaaatttacccagtgtgatggcagatgcctgtaatcccagctacaccagaggctgagtcaggagaactgcttgaacccaggaggtggaggttgcagtgagccgagattgcaccactgcactccagcctgggcgacaagagtgaaactccatctcaaaaaaagaataaatacagccaaatgaaggtattttcccatttttttctaaactgaaataaagctcttttttttttcctggaatcattctcatctttttgctcactgttttacaaggcactatagaaataattgaatatgagcattctaataagttaatttcattagaaaagcaactttagttcctctcatgttttcttttgttttttcctcgctcagaatacaactagcttggaaggattttggtgtctagcaaagttgaaggcagttcagatgtctttcattaataagttacagctggcactgcacagcaaactgaaatcacagtcactagacgtaagatggaaatgcaggcctcattcaacatctccataaataaatctgttattctataccaagttgaattttcctttgattacaaaaaataagctgttattatgacgttcaaaatgcaaatattgggattgagtttagaccagactgctcattatactttatgcaggtttgtaaatatttggcaaacttcataaattatgccttgtaatcaagtcatcaaataagcatgtaaataactactatagaaattaaattacaaaaatattatgtattcttttgtgtacaaaaagataaagtcaggttatttgttaccagtaataaaatattattttaacaaattgggctgaaagtcaaaattgctttgctaaacttgaattgtgttgagtgaaagacttactgcaatggttccagaagaaggaatttattctttgtttcactaaaaaaaaaattgattctctatttaaattgagtcctcctggctttgctaacatcctgcaaagcctccaagccctgcaaccagttcctctactgatatttaaccacagcattaccccaagggatcagaggcttcagcctcgtctggggacttcttagaaaggctattgcatttcttaaaattcagttttaattatactgtataggccagtggctctcaatacctgagaacttattagagatgcagattcccaggccctgccccaccctactgaatcagaaagctaggatttcagcggccttccaagtgattcttatgcacactcaagttagagaatcactgctaagcagaaaagctcaatcactaacatttatatcctgctttacttgcagaggccttaaagaacttacattaacttagtggtctgatgcccaggctcaactgagctgatgcctgctgaatactaaagcagctaaattgtaaatctgaactgcctattgatcacccaaaccccagtatactaattaataaaagcttcttcaccacattgcttcaacagtttttgaggctcaaatgtgggatgagtgtgtaggtctctgtgttaatttttgttttgttttgggtttctttaacgtttccaagactgaaagttgacattttcttgttaattgtttttcttgaagctcttctgagttcattggaaacaaatcaatgagggggggcattaagctgtccggagtgcagagctgtgaatcagaacaaataattgagtgcatattcttaagtttaaatgtcccatcccacctaagagttttctttttgccaaataaggataatgggttttattgttatttctattgctgggttgagtttacggaccaccagtctctgccttacatgggctgtggtcatcagagaatctgtggagctggtgaaatcagtctcctggggcctcccatgaccacctttttcctctgtggctccttcttccttgcctgccagttctcatttgctcttgcaagaccatctctcctagcagctgctacctcagtgtctcatccgtgatggcgctctctgaactctgaattatttatttgtgcatcaccaaaagtgatagttcctttagaccagattttgtgaactcagatgcctgtgggagccagggaaatgatgtgaatagctgaaaacatgtcaggcaaagacaaatacgggagggtgtggactttagcaagttggagtgcacatacgctgttgaggggggcactttcacttatttccagctagttttccaactaccaaaacatgggcctgaggtttctagattgttttcatgtccatttaatactaacgtggattttttacatgaaatctcttgatattaaaatgttggcaactcattttttaaacattgtgcaaaatgacaaacatgtctgtggatcatttagaaccatagctatagacatcaggcaccatgtagcattaacacacttgcactaaagtgaatgctaatattgacttattgtgttcaccttattggcattttaaatgaaagatacctgtttgttcctttatttcttcattcagctattcatccaggaatatttttttgatgaaacctgaacttggacaaatcatttcaattatattaatctttttaatcctcatttgttaaagaaaggaattgcaccatgtgtcctttgaagtcactttctcttataagacttaaggaaggactggctgggcatggtggctcacacctgtaatcccagcagtttgggaggctgaggcaggtggatcatgaggtcaagagatcgagaccatcctggctaacatggtgaaaccctgtctctactaaatacaaaaattagccaggcgtggtggcccatgcctgtagttccagctactcaggagactgaggcaggagaatcgcttgaacccaagaggtggaggttgtagtgagccaagatcacgccactgcactccagcgtggcaacagagtgagactccatctcaaaaacaaaacaaacaaacaaaaaaacttaaggaagcactctctttgcaaaataaagtgtaccaggagccaaggatggtccaggttagttgctttgacaggacacttgtgtacacatggaaatccctagataagcttaacctggactacatcatcatgacaccaggagtcagctactaggataggaggctttgtggttggagaggtgacagaagtcattctgggtacttcctgtggacattaaaggttgagagatcctgagatagaatgcaagaaaatcagttgttctcggcttcaatcagttacacaagaaggaaagatctgagaaacattcagtgtggaatccagaggttttgttcctgggtaaagttagagaagctaaaatagagaccagattctgattctgattaactgggagtacgatgatacagctaatcagaaattgagggtctggttactttggatcagggagaaaaaggaacaatgaatttgtttaaatttttttctctgaggaacctgttagttgcatgacctgctatgggtgatgcaataggacagagatcatatactacttaggatccttaggggcttgtccatggggcgagctctgttctgtctctgtggcacatctctaggcctctgaaatcctgaaaaggtctacgtttgtttgtttgtttgtttgtttttgaaactccctactttcataaggaattaagtgtggatttttagctggcatttttcttagtgctggacttacttaaaagctcctggtcaaaatgattcttcaggaacatgcagctgaagctagaggatatttgctgttgttttcggggaattttgtcacctgtatcagtgaagttatttctttggatgagagtatcaaagatgaaagaggcctcaagcctccgcttagctcccaggttctctgcagctgcactgaccatgttgacaaggtcatttaaacatttgcatggacagtgtgtttttatactgttgactggtatttcctgaatgctaaaggaatgttgctcatgatagaggatgtagttgcatgacattctatgcagaaagtacaggatagtaaaaaaaaaaaaagaaaagaaaagaaaaagaaactaaaaatcccctagagtgtatttccccttctgtgtcttttcttaattcaagtgaaatttatgtaacataaaattaaccattttaaagtgaacaattcagtgccatttagtacattcaccatgttgagcaagcaccacttctacctactttcaaaacattttcatcaccctcaaaggaaactgcatgcccaataagcgggttcctccccatcccctctccccacagcgctgataaccactctaatgagtctttttattccccacacactttcctttttatatgcagttggactcatgctgtttaatatactgcattttattatatgaattttcctgtttaaattaaaactttttcttaggtttcaatgtaaccgcaaatccccatgatctgtgaggtggattttcatgggcgctcagctcttgctgttttagaaatcatccagcctccttcacagttgtgtttgaaatgctgtgctcttcatggggcacatggttttcagtgctggagcctttctcaccactgcatttcatgaacttgacaggtttcataagaagagactgtagacccagcccagagaagctcattttgtcctagttgcaagtgttatcaaatgactccaccaagggaatgcaaaatgaattactctaattgcactagaagcataatgtgaagtttgtatttcaccttttggcccctgggagagaaaaatgtcactgactttaaattgcttttccattttccacatagccccagtttccagtgccagcaaaaaattgccattggaaacataatgtatgctgacatgggcctacatgtatttgtatgttttctcatctgtgtggcaaaattaaaaactggatggcatgaagaagtgggcagaatcccttgtattacatgagactttgttgcctccaagctctatgatctggagccagtaatttaatgatcataatctggggtcggcaggtgcaggccatgggctgaacacaacccttagcctaattttgtatgtcctgtgaactaagaatggcttttacatttttgaagcgatgtttaaaaaataaatttaaaaaaaaaacaggaaaactagacaacatggaactatgtgtgcccctgaagcctaaaatatttattatctggctcttaatggaaaagatttgctggtctctaataataatactaataatagtagcagcagcagcaggaaaatagtttatattgtatgtcagacactgttcaaagtgcttgatatgtattatctcatttaactctcacaagtctgtgggataggtattatgattatcctcattttacaaataaagatgcccagagaggttgagtaacttgacttttcaaggccatacgtccagtaagtggtgttttgagcccaggcagtggctctctctagtgctctagatcctgaattctaccaccaccctgtgctgcaattcacagttggcttctttttctttttctctttttttttctgaggcagagtctcactctgtcccccaaggctgtaatacagtggtgtgttctcagctcaccacaacctctgcctcccgggttcaagttattcttgtgccttggcctcccaagtacctgggattacaggtgcatgccaccacgcccagctaattattgtatttttagtagagaccgggtttcaccatgttgaccaggctggtctcaaactcctggcctcaagtgatccacccacctcggcctcccaaagtgttgggttacaggcgtgagccaccgtgcacagccagttggctgatttagcttatctgtataaaaactggggcagggagtggggggaacagcctctttcacctgtaacactgtgtgatgttaatgtactttttaggcaaatgttttaagatcattatctgtgggagctatagtcatacagtagtacttcccgaattagtggcctgaaaaaaggattccttaaaaaagtccacatataaagggggttctttggtcagctaagcatgagaaagcctttagacaggtttctttatggtagtgctttcagaagaagtatttcttttttttttttttggaggagctgggtctcagatatatttgagtcttagtgctttactctttttttttaagttttagggtacatatgcacaacgtgcaggttagttacatatgtatacatgtgccatgttggtgtgctgcacccatcaacagaagaagtattattcttatgtggatctcagcaaggaagaaagctattcagctgtttcctaaactttttttttaattttttgatgagacaccattaacatctttcagaaccagtgtggcactgaataaaagtcagtaaattatatcatagaggcattattcagctcaatatttttctagaagtatcaaaacaatgatgtaatctaaggattcatttattcatatttaccataaatattctatttattttccctgtttttccacttccacttgtcttcactcctcactgttttctgctgtgtgtggggagactttaccttaaaagacagagaaccaggtaatgaaactcaagcccaccgatttagattccttttagtagctcttatattgaaagtcctatttagtttatagaattacctatagatttgatttgcttgaactaaattggtggatgctgcctagttaagagttagacaaaggcttcttgattgattatattgatctcagactaagcaggtatgattgtcatcaagttgaaatactatttactttggcatgacttaatttgccaacattgtcaacaggtacctgtcaggaagaatgtgaccgataaatacaggccatcaactaaagaaacaactctatgaacaccttttaattcaccagctgtttactcatcccataccaacagaatttcacaaatttgactgagttgagtccaaaagtaatgctgtcaaaaaactgatggttgctgactggcttaagatgatgcttttggttttctcaacattttaaaatccctccattcttctagagctttccatttggatgccaaataatgttacataaaataaaccaaaaatcttattttatttttgaaagatttctggggatgtaggaatgtagttggtctgtggactttcaggcactaaagaacatcatgtgttgtatatctaaatcagaagcacaagtgaatataggcattaatgtaagtatactctatgtatacatttttccctcctgatcttttgtgtccataacagtatatttattgtagtagatatttggaaatagatgcagttatttgtgacaagattctatagatccaataggacattgctacagggtatctattaatatatagaatcaggcttaggcaatgcaaaaattgtgtctaaggaatgctaacaaagccatttggtatggaagtttgggactgcagcttctgaacagcacaggtgtcctcttttttcttgtgactatttagaggctctttttgacctaactggccagtgttgtcaagataaccagcaaggctgatagactgttttgactctctgggagtgactaaattaattttgtctaggaatgtataaatattatcctcacccattcaattatctctttcaaacatagccacccatactcatagatggcagcttatttcttgcacaaatactcattcaccatgctctgagggtaatttaagaatcatatgatttaattttgtctaggaatgtataaatattatcctcacccattcagttctatctttcaaatacagcctcccatgctaatagatggcagcttcttttttgctcacatactcattcagcatgctctgagggtgatttaaaaatcatatgacacttaatatatttcttctttcactttcatcaattttactctgtagcttcagactgtcaagaaaaagaggccccagttgctctctttttccccctttcaattcttctcttttagaatttgaaaactttatgaggattattattgacttcccaagggcttttgaaattaatgttgggttgtctttttaatttttgtgggggcaaaagtcctgttgctttttagccaccagtttcagaagtaggttgctgtcagtcattatcacaggctcactgatgtagctttctatcctgggtttatcaactggacttgtgtaggatggcagcttagctcctttattatgcaggaaagtcttcactgtcttttttcttgcactcatctttcttgcagcaacagttcatggtgaattgccctcttgtcccatgggcatgtgggcgtttccaacactgacattgatatcttgtgacactaacacttagtacctgcacttgtctgtccttggtggagccaggagaaatcagctgacatgaaagagagaacttgtttaatttttacttcttaacatgatttagaagttggtctgttatacaaacaaacattagtggttttgttcctttttaattttaggctggatttagtgtcctagatgaatacctttgaaagataaaatgttcatttgtcaagtcctgcctgtaccatcagcttctccactctccacctctgccactggggttttataattcccaggcctcagacctggaccaaatgctgtgggaatggggactcaggctttgggaacgctggcccttagcctctggctcctcctgctgctctgctggctctggccttggtccttaggtctggactggacagttggtggcccaagtcatgttctgatataccccaattttaagaagtagacctctgtctggtttctgtactggcccaagtcatgttctgatcatgtaccccaattctaaaaagtagacctgtgtctggtttctgtactgaatcatctggtaagagttatcccaagaagcccagatcttccagaccagaactatctcaagcaggaggagctgtaacttccaacagtcttcctctgggccagctccctgctgcctgatgagatcctggaaatcaccagctcctgaatttcctgtggctgtgaaatatcctcttacccaacctccctgcagctgcctgcattgcttttatgttgcctgtaactttctttcaaatacttcaacacatgcagtggggtgtgtgtgaattttcatccaaaaccagggaatgagaatttaaaattttaaatgctcaccctaaaggtagttagttagcgtttgaaaaatttgaatcaaagcttaaagatcaatcattatatataaattatagctcaataaaattaattcaaaataaaataaaacaagcctaccctccagtggccacctacacacccccttcagttaattttctctctcattagcaccaggtgctctgatactagcctcctggagtggtttctacatgatagacacctggaggcttgttaaaatgcagattactgggccctgcccccaagttgctgattctgtagatttgggatagggcctgagaatgggcacttccggtaaattcctatgagatgctcaacccgctgatcaagggaaccacacttgagaacctctggcataatgcagactggaactaccttttctttggtggagttcttcatggtattcaagatatgcaatttgtgtagaaataaggtacaagccctggtatccttgtgagcctagggcacaggaatctggcaagcccaaatgcctgcctggtatctgttggaagcttgttagaaatgcagaatctcagtgcagatgccaggcttactaaatccaactctgtggttcacaaatgcccccaggtgatccaaatgcacattaaagtttgagaaacacctgcccaaaccaaatttagttcacatcatctagttcaattgtcctcaactataggttcacgttagagttacctgcagtgtttaaaaaagcagattgaaagacagcccaagtacattctaattattagttagaatctctagggtgagacccaggcttctgaaatgtcttataattcccccaggtgattctaatgtaccacaggtgctgggaactaccagtctagtctctctaagtgctatccgcatagttcttttaacagtgtactagctggaaatgtcttccctttagcctgccctcaaagttaaatactgacaatttaatgccaactaaaccttctcctaattcaaatgaaatgatttcatttgccatgctttttaaaatttttttattttttatattttgtattattattattattatacttcacgttttagggtacatgtgcacaatgtgcaggttagttacatatgtatacatgtaccatgctggtgtgctgcacccattaactcgtcatttagcattaggtatatctcctaatgctgtccctcccccatcccctgaccccacaacagtccccagagtgtgatgtcccccttcctgtgtccatgtgttctcattgttcaattcccatctatgagtgagaacattcggtgtttggttttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgaggaatcaccacactgacttccacaatggttgaactagtccacagtcccaccaacagtgcaaaagtgttcccacccctccacatcctctccagcacctgttgtttcctgactgtttaatgattgccattctaactggtgtgagatggtatctcattgtggttttgatttgcatttctctgatggccagtgatgatgaacattttttcatgtgtcttttggctgcataaatgtcttcttttgagaagtgtttgttcatatcctttgcccactttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgccatgtttttatagactcataagaggaaacatgttggtggtgatttatctacagtccctatttattttagaatctgaggcactggctatatttcatggcaagctaaaactcaaatgccttcatgaaactaaatttctagcttaagatgaaggtgtagttcctgcactgaatagccttcatctgtagatttgtgaaatgttgcagttttacatctaagcaccttataaggaattctatcttagacaagattagatcctgtggcaatctttatttgaaaagcttcatagtttgctccaagtgcatggaaatgtgtcttatttctcttgaatgccctttaggtcttaacagaattcacagtgccaaggagtcaaaaactatatttcaaattatatacattcctgacatattatttgagcagattaaaactgatggatagagcaatttaggcaccttgaaagtagctacttgaaaaatgccaactttttcttatctccattcacttaaacaaaaatgggccaggtgcagtggctcatgcctgtaatcccagcactttaggaggccgaagcagatacatagcttgagcccaggagtttgagaccaacctgggcaacatggccagaccccatctctgcaaaaaataccaaaattggctgggtgtggtggctcacacttgtggtctcagcttctgggaggctgaggtgggaaaatcatctggacccagggaggtcaaggcagcagtgagccttgattgtggccactgcactccagcctgggcaacagaacaaaaccctgtctcaaaacaaatagaaaagtaaaacaagaaaacaacaaaattaattgatctagatttgtgagttgtcgataccaagaagttcccatgttttaaatatttcagatggccccgtcattgattattctcacagctcagatatagggaagatgaaagctgctgcctatagcatcttgcatcctcttgcttccacatacaagaaatgtgaacttcaatcccctaaaaaggtcagagtttccattctagtgaacacatttgttcagcccaggtggggtgggacatgacaaaaaccaagagtgggtctagaaccatggggctcttcccagggctatcactatgagatagaatatcctgtgtgtagtcactctcagaaacagcagctcccttaggaaactgctgtgtcctgaatgcttgtgtcccaccaaaattaataaactgaaatcctaccctctaaggtgatggcattagaggatggggcctttgggaggtgattaggtcatgagtgtggagccctcaggaagaggattagtgtccttattttaaaaaggtaccagatagcccccttgccctttccactgcatgaggacatagctagaaggcactacctatgaactagaaagctgccactgaatctgttggcgccttgatcttggattctccagcccccagaactgtgagaaataaatttctgttgcttataagctacccatatattgtattttgttgtgtgtcaaacaaagacaaaaaccaaactcacatcttatatgggcagtggaaggagaactccaagttgaggggggctgctcttttagacctatgattctcaaattctaatgtgcacaccagtcatctggggatcatgctaaaatgcagattctgattccatggttctgggatgagacctgggactctgcattcctaacaagctcccagatgatgttgatgctgttggtcttggggccctttgagtagtaagggtttgcaacagtgcttcttaaatgtgtgtgtgcaaaagaatcacagggaaggctgattaaaacgtggattcctatttcccatcctgaagattgattcagccggaggcctgataatttgcattttaacaagttcccaggtgatcctgatgctgctggtccccagactacattttaataacaagcctctagttaacttttgaacaacttaattaagataccttcactagtagcctcttctgtgaaaacagagagccaaacatcaaaagatgaaggaggatgctactgagtccctttggagaaaattacatcacaaacttggagagtgccacagggtctctgttcatttttccattgacaatatgcttctttgactaaagacgaaaaataattcttcaggatcaaaacctagagataagattggaaccctaagattggaagtagtgctgcctgatgaataataggactagttattttaggatgacgggccagcctgtgcctagtgaaagcttagaaatgccaatagcagactgagcacggtggctcacgcctgtagttccagcactttgggaggccaaggcggacagatcatctgaggtcaggagttcaacacaccctggccgacatggtcaaaccccctctctactaagagtacaaaaaaaaaattagccgagagtggtggtgggcacccacaatcccatctactcatgaggctgaggaaggagaatcgcttgaacctgggaggtagaggttgcagtgaaccgagatcccaccactgcactccaacctgggcgacagagcaagactccatctcaaaaaaacaacaaaaaaaggaaataccgaaagcaaaatgttattggtggccaattcttaatatacgtcatgagatttggggtgatgtttacttcttactgtgtatttctttgctttacactttcctatgaagcatatttaaatattgttttcataaactgggggaaaaaccctaaccaatatttttaaaagaaaaaagtaaaatatatgctcagtgtaagttcatagtatttttggtttgtgtttgttgtatctgtgtctctctacgtttgtattttcatgggaaagggattatttttgtctatgtcagtcctaatgttcccggggcaaaggtgatagatgggtaagagcaaggtctaaacatatgcctggaagttggacagggcctggggtggtgaaaataaatttaaggagtcccagaggagaggtcaaaagctccaggagagaattagaggcagcttctctttctctccttgccctccaaacaattcagcacaagccctcaagtcccttgaagagtctttctttcccccttcttcttagaagggctgaaacacactttaagttaacttaggaatggttagaaaaggttaaaaaaatgggagaacagtagcaattaacaagctgctagggaaacagggaaaccgtgctgatccgaacatcagagccgacctcctgtggtctggttccctagcacccaggctcaggcttcggcttggggtggccggaccagaaggaaagtgccccgtgtggcagaagtcatctcaggagcgtgtcgccatccagccaatgacttgtgttccaaggactggaaaatgcgcttcctggacactatgtagatgattaccacacgagcttattttcagcaattcaagaaagaatccaattcgtggtttattgcttctgttagtctggaaatggtcaaacaagttgataggcatctagttcacgcctggcgtaactttccaacaaaactccagggctctactgacacctgctggcatttcatctactttatgttaaaaaaaccccaacaagacaaagaatcattaatatttttcctgcagtcctttgcccttgttatgttacttgtactttacctgaacgataatagaaggggcctttaccatgtcgtgaggagagaagtgtgggcaagccattgggtgaaaataaaaatccccaacacgaagaatgtaccacagagctcttgttgcctgtctgccctgcaccagctgctctgtgaccttaggcaaggccattgacctcactttcatcattgcaagaagaaagaggcagcaaccttccctcccagttccctttagggcttctgaggatgctggtggcatttcctactaactaaagcatgggccctgtcactggagtgatggccttaaaggtcactctcactgacctttccatcacaataaacaagattccttgccagcgttgtatgttcaaaagatgaatgaaagttatttaagcctcttcaaagtgcaccatctctgtaatttatttcgacaaacaactaaattagaatgatcagaaaaagcccagtgaacagtctcagaaattgtccactttttttttttttgtctaggaaactatggactttgttttgtgttttagaacatgtagtaagcctgcaggttgagaaaatgcatcccagttaatgccaacccaattatttgtgctttttctgtctattcttgggaaactctgtgtgggcctgtggtttgttaggtcaataacaggatatttgatagtctgcagggagttatagtccatatttagcctgacagaggaagtgagttctgctgatgaaaaataattgaggcatttctttaattctactatttcatttcttcatcttccttcagaatcctgaccccactatgatgcttgctgaggctttcgatgctatttacagctctgcttttgctagtcacaaaagaaaatttacctcttataacccctaagtcttccctcagaaaactgttaggtgtgaccaggatcagcaaaaactgttagattcacatccattagtttggctactacttaaaaaaagaaacaaacaaacaaaaaaacccagaaaatatcaagtgttgttgaggatgtagacaaattagaaccctgagcaaaagggttcccttgttgcatttgcagtcctttgttggtgggggaaaaatggtatggccacgatgaaaaacagtatggtatttcctttaaaaattaaaaaatagaattactatatgatccagaagttccacatctggttatttatccataaataagaattgaaagcagtaacttatttgtgtatcaatattcatagcagacatgcaattcacaatggacagggagtccatcagaggtgaatggatgagtgtattattcagcctttaaaagggaagaaattccgacacatggtagagcatggatgaactttgaggactttatgctaagtgaagaaagccagtcacaaaatgacaaattctgtatggttccatttatatgaggcacctagcatagtcagaatcacagagacagaaaggagaatggtattaatatttatcaatggctgggaggagggggagatggggagttatttaatggatatggagtttcagttttgcaagatgaaaagagttctggagatggctggttatgttggttgcataacaacatgaatgtacttactgccactgaatttttcatttaaaaatggtgaaggtgataaatgttatgttatgtccatttttaacacaattaaaattaaaagaaaggttaaacagcaaaaaacaaaacaaaaccatactctgttagaacgcagtcatcacctttgcccttacagagattaaattgcttgactttttaaaacctggttctactgggcagtgctgtccaacagtcccatctgtgatgatggaaattatctgcactgtctgagccatcaaccccatgttgatgtttaagcatgtaaaatgtgattagtgcaaatgagacactgaactttatatttattaaatttaaatagccatatgtgtctagtggataccatactagacagtgcatatagagtatacgtctatattactatctattccaagatatttttccttcctcagcactaagccgcaaatctaagcagtcaggctgtaaacctaagaaggtaaggaatcagcttatgtgtgggccaccgttctatttaacccaaatgtcaatttgctacgaagtgttttgccgagggtatgattcttctatggcattcattggcatcagtttttggacccaagggcagagttggccttaattcatgggctgagcttttctagtaaatgcccttttagagacccaaattcctctactgccatgcacaatttcccttcacttgtccttgtaaaacagtggagtgatggtatgaactacaagtgaggtccaagtccttatacagaaattatgtgagcacatcgctgtttgctctgatcaccctggcaatgaaagaatgtttttctttttaaggctttgctggaaaacataggtaagataagtaacaaactcttagattgaaaggatcacacaataaaattgatgaacccctattcatttatcctctaaagtgaaaatagttaaatatgtcatgtattttataatgctggttggaaataattaagattgccagcaactgaaaaagggcttatatttaaacaagctgcaaatagaaagcttcacaagtcagtcagtgggcaacattcctttgtggcagcccagagtttaatggcacaatagatggcacatttgtcttcatggaaagaatgaaagctgtttattaaagaataaaatatgagcctgcaaaatatagatggctgtgtgacaggaaagggacaaaagaagagtttgtgtttttattacacaaaatggatacaatctatctaataaaaactgctctatttgactccagcagatttgctcaccaagaatattttttctttctctttcagcaatgggtagaaggcctgagatcaatcatacacaacttcagggccaacaacgtcagtccaatgacatgcctcaagaaacagtgagtgttgtttgcattactcgtttttcttggcagttatcaaacaaatggtcagatgaagagatgaaggctaggtggttccttcctccaaattcctgcttgcctttccctccatgctcctgaccttggagttgaccaacacacacctgtactcttcataccacgtagaaaggcatgcatgataaacccatagcccaaaacctatatgaaaagaatagttgatggtcaaaggacactggaacctcagtcactctgtatgctgtcagttgtgggtactggcttttgtgtccccagattgagttttctgatagacagctctgcatgtctggagccatcgctgagtgctggggtaattctatcctctgctgcataaaactgagaaatgaggagtgtgaccaagagacgcacttgccaatgcacctgaaaaagaagcctcagccccaagtgcagtgctccttgtttagcacaccgtcagggatccaaagttacctctgaatttttttctgtaggattcagttatttaaagatttgatcaaggatccaatggtgatttccaaatttattttttccatgaaagaaggaattactccagcttacagtatctgaaatccagaggagtactacagtggtagatttaaaccctacccaagttaacctttcaaggtgacatgaaaatcacccacaaaggaatcctagccaaagtcaaatgtcagccagtttgaaaagcagtgatccgtgaaggtgggggccatctgccttcacagggccattggcaggcagttgtgaggtgccaaggggaaccatgttgagaaattgcagggataagcctgtatctctcaaaattatgccccagcaccaagagtgtgattcatcatactcacttggcaatgggccaagaggttagtcctaaaggtactgtcatgtcttatcttctggtcattgtggcaggtgcttacaggtgtggtctctaggctataaatcccggcttcaccatggcaaattcttacacttgtgcctcactgtcctcatctgtgaatcaaaattaccatgcagatgaaattggaaagtattctttattcaatactacttatcttgttatggtatccctccaattttctttcacccttttagtggaggaaagttatttagtcttatctatttctatgtgttgtgcagctgcttcttcttttcctctgcagttgccctggcatgtgtttttaaagagaaacccagtggatattctgatgttatgacttcaggcactgatagtcctaaagggtcaaaaacttttagaaggcttgcttatacctgagtgacacaaatatctctatctgacatgagatctaacaacatcctgcccagatccctttatgaagctggtgttcacccagccatcatctgccatgagaatgggctcaccaagggctcagacctgtccacttcttcagagcattgccctctgctgaaggggagcttccattcctggaagattatactcttccctcctccaggaggaagtccacagccaatgatgagctgcaacagggtacagaaggccatccctcttgccgccaagtctggcacaaatcacatgagttcaagctaaatcaagctccatctgaaaccacaactttgtttaactcttttttctgctcagtcttctctcactctcttcatccctaaaacatcccgttattaaagtagttagtggtgcttctacgaaacttaagacagaaactttactaaatcatcatgttctgcaaattgttagcacattattgattggaaacaggaagaatgggagtcattagctaagaaaagtcctagctccaaagtacagataaatgttctgagtctcctaaaagcctggggaaagcaaggaatttttcaccatcaatttgagttgatgaactagtcttaccactggaaattaaggaggcgcccatgtgatcagtacttggcagcactaggagctgggagtgatgagtcctcatgaattctcaagacaaggctggctgctgtcaccgtgcagttgcatttcccaccaccttaatatattattacagagcaataatcgagcagaccaatcacaaataagtaccaacaatgtgttttgctcaatggaggcacccagtcatctcatttagctagggttgccagataaaatagaggacacttagttaaatatgaattttagataagaaacaaaaatattttagtataagtatatcctatggaatgtttggagcatacttacagtaaaagaaaattacctgttgtttttctgaaattcaagtttaactgagagctctatatatttatgtgctaaatctgacaaccctaaattcatcttatagcacataattgtctgattttcagaaccaatgttcttgatttaaatgaactttcttttaaagttcttaacagaattgaagctgctccctctaagaaacattaaggcaatgttattgctattgttttgcagctggatgaaattggcatttatgaccaacacaaatggtaaaattccagttaggaggtaagtaatcattcctatctgctgtccgtgtcccgggtcaacgcttgtcatcccaaaccaaagagagaacccttcacaagtatttgtgtgttaaatgctttaaagatatttctggaatcttagtttcaattgctttgacaaatgctatattcagtttgtaaaaatcatttatggaagtaaaactgcatttttttggtcaaaataggtggcaaaagaggtactttgacaatttaaagaacatcagaaaatgtagaactattttttaaaatcggcaaataagtggtttttaggatttatgtttcttttgcttatttgccatgagaaactgttagctaaacttaaagaagattttattgtgcacctactgtggaagggtgtggaccgtgtcttgagaagtgtgatgcctctgaacagagcattttcattctgggctttgctgctcctctggtgctcagggcagatggggatacttctctggcttcgtgctgcctactctctacatgtactgtaactgacaccacacactctgtggagctatcctttccacctttgccctgatgcaggtaacaatgacaaagaataaaaaggcttgaggcagggcatggtggctcatacctgtaatcccagcactttgggaggccgcagcgggtggatcacaggtcaggagatcaacaccatccctgctaacacagtgaaactccgtctctactaaaaatacaaaaagaaaaaaaaaattagccgggtgtggtggcaggcacctgtagtcccagctactgggaggctgaggcaggagaatggcatggaacctggaggcagagcttgcagtgagtcgagatggcaccactgcactccagcctgggtgacagagtgagactccatctcaaaaaaaaaaaaaaaaaaaaaagacttgagtggaatcaagaataaagaaaacatggacaggatacatcctccacatgtgttctttaatacttaagtggacagatttcaccctctgaggattccccatgcatccctcttttctgcttctcacttccttccaggggttagggtttacacatggtctctgggtacagttggaaactctttccacagtagtgatgggaattctttaccaaactcttcagtacctttttggttggtgtttgttttaagcattcatggaaattccagaagctgggctgggccccagggcatctgcttttcacatgaagacaggcatgtatctggattcgtgaacctaagcccacaaccagaatcaaacatgggttccccagatgccaactctctcttccagggttctccagactcaggttcatgttcacttctctggacaccactttagcaaatacgcaaatcaacaaataataacaaacaaaacccagaactactgggtggaatcctgtcttagaattgatctgtctttcagaaataaccaggtcaccgagtgcgtagcatctgtgtggatgcattgagcagtggcatgtgctgtggctcctggcatttctgactctcctttgcctccttccctgcccagctgcttcattctgctctgcagcttccattctgcatccctgtgagactatctccatactcccttgacattactcttttcatatttaacagaattgtcccagaagacctcatttttctcaatcttgtatattaaacaatcacgacctaaagtatccatgtgaccacttaaatatcgagaaaatgtaaagcacagaagtcatgaagaccttagacaattttttttaaatttaactctttattgagggcttgttgagtcatggacctcatgcatttgttgtggtctttccaaatctatctgtaggattctctgcttttatttaataacttgctagcaagtcaacttttagtctgctttagaagattgaaaaaagccctgttagcagccttgactgatggttgttggcagatactttatgcttatccttatttaaaatcctttgctcagttgagtaatagcagaacaattattttaatgtatcccagtaccctacagctattgcatttttatttaaaatcagagagcacaaagcagtgtgaagaatagaaatgtaggttggatgtgtttttacatgccttactatcctgctttttcttccaagatgaggttcaggaaatgggcaaagtagagacacatagattgtgatcaaagcacttctaaccagcagtcttggtttcatttgtatgtatcctatgaatcaagtcattgtcatacaagctttgaagtcgtttctgattccagtgatttttatctaacatgttcacatacaaaattattaccacctttttgtagaaatagcttagatattttggcatcttctttagctctctttgacatggactccatggtgcttgccagtattaacaggtgtttgacacaagacggctgtgatttgggggcagtttgttagagttgatggagaattgataccatgccagaaaaaaaatcagataactctattggtgaatgagctgccaagagttagttggaaattgttgtgtatgttttaatggatatgaagagtaaacacttttaaaatgttattcactatcattctgaagtttctaaaatggaaactattagtgtactgtccataatattaaaagagatctggcttcatagtgattacatagcttgggaatggttcctgctctttagcattaaaccaaaatttaatatccaggaagttgcaggaataacacatgaagaaagtcttaccttttgtctccctcttctcttgtcttgctgtttacataacccatgcagtctgcctttctctcaaattcacaaatttacactcagtttatcctcccactcagaccaaagttttggaaatagcaattctcttttgccaccttccctcctctctcgtaacctggagtgaacaccaatgactagaaaattgggaagtgagtagccagacagtagttgtgggcaggggctggaagagatcccaaacaaaacggctgtgttaaagaaggctgagagccgcaggtgccgtcttggaagcatccctatataatcagcccaaccatgtcctgaaggcccagcagcccacgaagaaggtatgattctgctggggcagttgccccatccttcactcaagagttctctgtaactttcagaacacggtgttaaaaccatcgtgtagattgcagaccctgtttcagctagcaaagagtgggactcccttagtttctaggatcgttgctgttttagccacttgcgaagtcccccggaatagaatttaaccaggactctaataggactggacacaactcaggggtgtttgcttttgtagcatttcttttggggaatgggggtggtttagtttgattcaacaaaaactcattgagtaccagttagctatgaggcactaagcttatgtgaacatggggctatatagagatttgagtaaatcacattccctttgtaaatgctctatgttcccatgaaacacagccacgatattatctcccttcttggccccctccatctcccttccccttgagacattcttctactttctatttgttggcacctggccaaaccctagccaaaagattcaatttctgtgtaggaaacagaagctattggtacccaggttctgtttcaccagaaaggctcagtctccacacccgctgatttcatgcccacgttgatcagttttcatctcgttatgccaggcatgtccaaacctaacagaggcttcagttagctgggatacccctgagattgctatgcaaagattgttctcctgagagcaaatgccagatcctgccagagtcttactagctaggttaacacaaactttttatgaaataatagtcaccctgaacagctactttcccctaaattaaaaaggctacaaaatttttgtcttaccccaaatttaatgtataaaaattacctgaactctagagatgaaaaatgtaaacatagcaccctctatactaggaatcttaaccatttattgatgtcacacacatattctctcccatatttgtagatttgttaaagagaattcacaggcctccttatatttgaatacaactgtctcaagaactcttaaaaatgtacttcttgaagtattcttggacctggcatgaaacaataaagctgtgaatgaacacataattcatttacctacagctacttcttagtctattttgggaagtcctactctgccactgaagtggtgctttctcccactcaggaagaggaactgtcagcactctcattcagaacttgccttctacttagcacggatggcggaaagtacaaaaacgctgggcatgagatgctgttaaaaatccttctgtgctcacaggggaggcattccaaagccagccctcatggatagaagtaaaactccatcctcaagtcaagctggacttctgaatgtcgagttaaaatgaaattatcatggtaacacattacctgggcttccaatcagggagcgattgaaggctccttggtggctaaggtatggctcagagccaagtgtggtgttccagggtaccaagtcctctgctcaatagctttcattctgagtggcaccaacacatttataatggagagtctctcctaacttttatcatcaccaggaagtgtgttcatcaaggtgttatctattctactagccttgatgctcactgttctagttaaaaggctatccaaaaatactatgtcttggggtactactgagatttgttgaaacattggataattgttccccttccccctcacccaacccatcatgttgacagtaaagtcccttatccttgaggcagctgacatttcagaggggctcaagggtgcttagcttgaaaacaagaacaaaatatgtctgatcacgcccgtgtcaactgtggttaagtgtgggaaccaggataaggacaactgaaggcatggattgagttgtaaggggccgcctccttttccctaggcccagttattgtcaacatgagggtttgttctagagctactgtcttatctgccacattcctttttcataagaaggcaatttggtagcatcagaatttatcattgtttttgtccaaaaatgtgtgtcccaggccaggcgctgtggctcatgcctgtaatcctagcactttgggaggccgaggtgggtggatcacctgaggtcaggagtttgagaccagcctcaccaatatgatgaaaccccgtctctactaaaaatacaaaaaattagccaggtgtggtggcgtgcacctgtagtcccagctacttgggaggctgaggcgggagaattgcttgaacctgggatgcagaggttgcagtgagctgagatagcgccactgcactccagcctaggtgacagagtgagactctgtctcaaaaaataaaaaataaaaaataaatgtgtgtccctccagtgccgcttgccccttgttctcccaagcaccagggggacccctggtcttagattcaagttgcatcactagactaaccagctctgggaaccagagggacactggaggaactagtttgggaaatgaaaaacatctgcaatgagaggtaattttattctcctcttccttttaccctagtctcactctccatagtaggacctggatctttgcatcagagaaaacataatgaacaataactggaatgtgtgtttctttcttttctgccctagtattactagaacatttgcatcgggaaaaacagaaaaggtgatctttcaagcactcaaggagttaggtcttcccagtggaaaggtatgcattaacttaataatgtatttctaaaaccattttgtttatttatcttctcatatgtaatgagctagattatttatattaaactgatctaaattagatttggaattatatgtcagtgacatatagtacagttaattttcttttctttcttcttcctccctctcccttcctctctccctccctcctttccttcctcccttccttccttttgttgcctgggcattttaacctaaatctctaaaaatgtaaatagtttgcttcaaatgatttttgtcacctttcttaagaaaaggaaatgaaggccagcttgctgtgttacacagtttttattttagagaagctcaccaacactgcctcaaccaggcacaacattagcatgaataattaactaataaattcaattctacaagatggctatgcaatattttgtgaagcatctctccccgcaccatttgtattcatggcccttcaaatttaaaataattgaaattaatttattgacttgaagaaagattgaagcctggtactattttaataagtcctatttgaaatataaatttcagtttgaaaagtaaaatcttacatggttaccctaagcccgttcacatggtcttgcaaaaattcacaaaataagcataattaaaccttgggcttgatttattcagcatccctcaggcaggcacttttctccctcaaggtgagttggaggaaatatttatattcgttctttggggtatttcccagagcaaggccagctgtagccaggtgttcgcacacacagaatctggcagcatgataactagaaacactgatgtacacgcactgttttttagtgagatggcctggcagtgcctggaagttggcctcctggcttctgtcagcaggaatcagagatgaagaccctgagtccaagtggtcttcactgtgcttcatgaccctgtagcttctcaccctccaagggaaaaacggttctgtgattcataacatgattttattccttacagaatgatgaaattgagcccacagcattttcttatgaaaagttctatgaactgacacaaaagatttgtcctcggacagatatagaagatcttttcaaaaaaatgtaagttccacttatgaggaagtgccatataaatattatcactgtccttttcgattttttaaaacgtttttgtcctattttaatagagtatgttggtagcatctaggaatatctagtcagggttacatttttaaccccatactttatcagtgtaaaagttcactctgagtttttgagaaacttttacgtatattaattgcagcacctggaacttttttttgcattggctttactaactacctacaattttaacctgctcctttaggtattaacccattatgtgaactaactagattcaatttggaatgttaatatgtttttgaaaagttgattcattccaattatttcaaatggatgacttacatgttgtttttgaaataatatcttttgaaaacggtaaaaaaaaaaaaaaattgcagactttttctgtgacctagtgggagtgttttccttctgttgttgttgttgttgttgttttatttttctccctttatgaacagtctctggccattttaagaattcaccactacttcagggttagaaaataagtttagaattatcatcaacaaatgtcaacatgtaaatcgtacatactgtagcatcatatacaaaaacttactttttctaataaatttcttttcagcaatggagacaaaactgattatttaacggtagaccaattagtgagctttctaaatgaagtaagctttttcatacattaactccataaagtctgtgtgcagtggcttgccttctctggtgtcctcattgcatgcctgcatcatatgcccttattcgctttgcttctgacctgctgatctttccattatggctttaccaggtgcaaaaatcagctgccgccctgtgtgttcatgtgctttcttcacattggctttgcacaccactttttgttggtttctggctgttacatgtagctctggttctgtgtgtatgtgtgaattgtataatatattcatttaagtaaatgtgtctgtgtttttgcaagatgatatttaaggtactttttttctattgatctcattaaatagaaagagaatggattgagtttactacactgtagttggattctccattgctaactttatctcatacctttgcatggactggaaagctttatttttgtcttttaatggattgcatgtaagaaaaatatgttggctcaaatagaatattttgacaacaagcaaaacacttgagttcctgggtgaaaatacattgagttttaggctaataggattgcaggttaaatttgtactttttctttttataacaagctcagagctaattttagaatgtgattaacttaacaaccaaaactgatagatagaattgcttaagcacaagagaaaaatattttcgaacaaaaaaagtttgcaacttttattacaactaaaatgaactacttttttcttcacacatacaaaaaaagttttcccttcagtgaaacccatcaagactcttgttaatccaaaatggaaaattcacttttttttctaacacattaataagagtttgagtgaaggatggacagtatgcttttgtttcaaaataatttaagttaatcattataccatataaagagaaaatgcaagaaaagatggtatcatgccagataaaacgtattatcttaagaaaagataaaaaggcagaccttaatttgccacttcatagagacaaattacatcttcttttcttccgttgtgaaggttcagtggcttcaaatttataaaggtcgcactttagaaactatgttaactaaagtgtaaatgcactgatgcaagaaagagaaaatcctaccccacatatcagacagatgcctctaaaataatccttcgtgtacaatacaatgtttattttactcgaaaacatttcaaatttttccactccactggtttttagtcatataaatacaatgttcataatctttacccagatactatccacgttcttatgccacagctgctcagaagttaaattgctttgttttgtttctttaaccccttccccttcttctgccttttgttttttggtttcttgttttgttttgttttatatcccttggcttcttcatgcactttggttcagtgatcatcttaggtttggtgaggtgaagagggaagacggtttagtgtaaaggagaaaatctaccacatcttcagtttgccacttccaagacaaggcctcttgtgttctttgggatgaagccctctcttaaacattacagagaccttaatactgcatttcactgttaaagaatgaagcaactcttaggtcttgaggataagtgcagtatttataggctcttatctaatgcatttccttttatgggttgtttttgttggtgctcccaacagtcactcctgtaattcttagacataacatttaattttttaaaaatatcatcatccatactttcttgttctgccattcagattctttctttaagtatttattatttgtcaaccttttatccctcacaattacagtagacaatagtattcttttttttaatagtgtttccttctatttgatgtcttcttaacattaaggaagtaccttaaattttggggtgtgactgatggaatcggtgtgattctagatttctttaggtcataggaactgtaagactactcaggaaagtctatagcctttatttttaatccaagtgtctgccctgaatttattccttttctatcctagtgaactcaactggaagaactagacaaaaacatgaatgtcggcttgaagaagccttgtcaaacatagagaacattctgcctgttccttgcactccctcttttgagtcctaccctggcccctcttatctctccaaaatcaaaaacaccccttgggcagaacaacttcaatactcataacaaaaggagacagacagagctcactcaagaaagaatgggcattggaatgtaagggtcaattactccaagagtttaaacctaaacattttcaaaatgccttagccacatagtctcaacaagccagtattcaacactgcattggaagcccctgtgaaggttccttgtgaaggttcaatggcttcaaatttataaagcttgcactttagaaactctgttaactgaagtgtaaatgcactgatgcaagaaagagcaagtactaccccacatatcagacagatgcctctacttttaaataatcctttgagtatgatacgatgtttattttacttgaaaatatttcaagtttttccactccactggttcatataatgagacaaaaaaataaacaagtcccatgaacactggaaaggacaaggtcctagtctcatttgcagatgttgattgtctactctgatataaacaattccacggaaaaactgtttgaagtaattagagagttcagcaaggtaaccagagaaacaatgagcaaagcaaaaacctggagacacacatacactgccattaaccaggtagaatagatagtaggaaaacataaatcccatttatattagcaaaagacatgctggttcctaccaccttccagctggttaatcctttcactctttctatgaaagtttttattcatatactaatgtgtatcttcagggggctgcaaggagaggagagactatatatatagtccatttactgctttggtcaccctgtagggtgacctcctccctatccatgcaatcaacactgactagattttcagtagtagctttagacctgactcctcattggcttctcagtatttccttgttcgttgctccccaaagtgtgatccatggaccagcagcatcggcaccccttgggagcttattagaaatgctcagtcttgggtcccacccagacctgctgagtcagagtctgaatttaacaagatctccaggtgatttatctgcacattcaagtttgtaaagcaccatcctagtggattactggattcctccttggaatgtttagtgtgagtgggaagaatatgagagcgacatataccttctgttattctccattaagaatttagccataggaatccaccactcagagctaaaattttgccacatctatgtctcttagtctcatccaatggactgagggaaatcttctttgcctataatatgaaaatagcaaactagagtccaggagggatagcagaggcacttaatgtgagctgccacgtggtgagacactactactggctcaattgcttgtatgtggcaagactagataaaacctcttggctttggttagttttacctccctttccctattcctaatgagaagcaaaattgatttttagttttaccttcattctttgtttgacttcttacaaagatgataactagggtcctgcagaattgggagatgggtggagggcaggagagagggataaaaacaaggaagagagggaaaaggccttaggtggccacaggaatcaaggagtagctttactttcttgttgctggtaatcttcccccttcctcacacatatcataggatcacatcagggctcaacctgacttttttctttttgcagatgaaagaatattttaaaaggacccatgatctctttccttttacaagatctttatgctttaaatgcacaggcaaagagagagaaggagggtatttagtcttatgagtaagcttatccttgccaattattccttctatatttttaaaatattatttatgtcaacattcatctctcccagtgctacttggattgaagccagacgatgcctcttctcagcaccagtaaggacgtaatactggagttctcttcatctcctccttacttacttggacacagttctgtgacctatttttggaagtcatttagaatctcattttacaaagcactggataccatggggtgaataacctgagtaacttgtttccccaaatcctggctgaaaactgatggttcctcagagatgtgaaacattcacctcactgtgcttgtgtctctgtggaactctactgcagccttattactgtgagatcagctggaagtgatccttctcctcttgtttttccatatgaaaatgatagttttctgactctaatgcaaatcttatatttgtttccttgcctttggattacccagattgatttgtgttacctttttgaagcatgaagattttagggagagctgaagattgttatctagtgggagcagaagcaaaaacaaatgcaatttcgcattgtctgcacttcatgcttatttgctgcgaatgtaattttcagaataggggattatgatacatccattttagggcttggttttcctggctttgttttgccataggcaggatggtctaatgaatgtcataccctctgactaaattttaatagtgtttaattgggaggacatctgaaacactgaacatgcttctatccttgtgagacttaggtacttttctttttactgatgtgcaaatatgttaaaatgcatacctttatatgttaggtaaagtgattcttatacttgagcacatcagaattactcagaagtcttatgaaaaacacagattaataggttccaccccagagatcagcagattcagtagatctagggagggacctgagaagctgcatttctagcaagttgacaggtgttggtgaggctgatgctgccatccacagatcacacttcaggtagtaccttgtcagaataaacacatgtatgtatattttaaaatgcacaaaaatgtctgagttctgtctcctttcctaattttatctcttctctctcctgtagctgaatcccttttttctctcattttttaattcatatggatttgcctcatcatctccatgagttcaaaatatttaccaacaaacatatttttaaatttaaaaaacttaattttaataaggaagataaataaagtggccacctatgaacataacagtgctggggtctaaaaaggacctttttcatcctttatccatcttctaccatgatattatttatggagatgtgagaagggatgtgcctagaaagatgggtttgttgttgttgtcagtttgtttgtttttaaaacaatgcattctcaccagaaagacggagctccttgtttccttgagtagtgggctccattgcacgatggcatcaatttcctaaacaaggtgtagcatgccttcacttgcctggcattccatggtccacctcacaatcctcttccctgcatatcccataacttttgttcttggtggcctcgaggcctgctgttaacataacagtttctgttgtagcatatgcatgaatgttagctgttgtgagccataatttcttagattacaacagaagcatgcttcattgggataaattgatgaaatttgatattgattccttatgagttaatgctcttaactcggtgggggaggaggggacccagaaaaggctgggccccatatgcatgaggaaatgacatccaagtgctctgttggccaaaagcattcattctgtgtatagctcacttttccaatgcccattccaaagcaaatagggaagggaaatccatatgaacttttaacagttgctttttaaatacctttccaacaatgtttttcagtccgtgcatatatttgggtaaagagttgtcaccaaggtcctatttattgaccaggttttgctcacacctgcttatctgtcattattccaaacttccattgaggtttgctttatttattcacttattcattatttttgtaagggctgaccagggacacagtgctgtcctctaatcctcagtgaacagaaaggaagtttagtggacccactgccaacacacatacacacacaaacacacactattggagctgagtaagttagtaaactgggtttttcatcattgccatgaagttaggatgataccattgcagggacagcattgctcctggtgcctcatgtcatagcaggagctccttaggtgtcaatttgaaaacaataatgtcaccaacctcttaagtcccgtaatcattcatggactctctgcccagagaattctatattgtttatagcttgtaaatatgcttgtactgattaattttcatcattacaattggttcgttttgaaaaaaatagttactcaagaaaatgaaatttgttgagtgcccaagaaatcatggattgatgtagaaaggtgttatgaaaaagagatgatgtttgcctgtgtaacattaggctttttgttgttattgcttttggggtttttgaggggtgcacttaaattagtatattacctatttgaactattttggggggttggtgtttgctttttaaaaatattttgacctcacgttttatagatattcatgccaaatgtcttccctgttgtgtgggaactggaagacagtacaattgacatgcacactttattatgtatccttcaacttttgaaggggaaaaaatgtattctctctctctctctagttcagggagagtaacccaaaagtattcccaaatgtggactttttgaagtatactttaaggagaaaggcaggaaggcagtgaggtcctatctttgtaattataaacatgacagtctagatatattttgttttataaattataaacttagtaatgtctaatgcctcaaggccaagaaatatcaacctaaatggagttattttcttatcatagcatcaacgagatcctcgattgaatgaaattttatttccattttatgatgccaaaagggcaatgcagatcattgagatgtatgaacctgatgaagatttgaagaaaaaaggtaataaacatgaaaaaaggacttaaaaaaaaaaacaagaaaagatgcaacttttaaagccttggtttatttaaaggtatctgtaaatgctttgcaactccctgagccatggattgatgactatttttttttcctgctcttaagttcgtataaattttacctttcatcagaattagtcaatcctgactgaagtatactgttacatttattgtattattaaatacattatagtgatgtttccccatgtactttcttgtattagattttagtattgcatattgcttgaaatattaaaacaaccaatacagtctctacttgcaatccttgaaaataatttttgtcatataaaaacttataccttttctttttctcccttttgttttgccaagccaaataaatttaatacgtgatttgatgtgcagtaaccctcatttgacctctggtatgaaagataaatacaattgatatgaaattaaatagtcaggaatcgccttagctaattgctggacctttgtccctttcaaagaagctttggaaacaaagggttgttcgcacaaatatttgtcaaaggaaaggcatggggagaaattttaaaatcagtcccacagcagtgagaaatgcctgcggaacatgggagggagagctgggggtacctgagctagagcctttggcgttatgtctcagtggagaatgtaaagagatgaaagttcaagttccataggtcccgtatgtccgtgaatctcaaggtctcagtttcctcctttttaaaatctatttttttctttgtatctaatgccagtgagtgtggttgaatggtctgtatgttatctggaccctctttttaggtatacctggccctctacactccatgatttcacccctgatatttttccaagcccaatagttttccctttagttgtagttgtacagtttacactttctgctatggctgaagatacctattttaagcaagaatgcttcattccttccctctctgtcaatattctgaatatcataatttatttcacattgcttatgattacagcaaagggaggtacagcttggtagaaaatctaacacttcgcattggcaggaggtgatatgattcttgtcacttccctgtgaccttgagctaggaactggcctcctgggcctcagtttccctgcttgtaaggtggtggggctcatgcagtaatttggctagtatttcccttccctaccttcattctttgaagtttgtagagggctgaccgggtgccaagcactgtgccagatgctaggaattcaaaacaataagaaatgtccccagccttgaaggcagttgcgatctgttcaaggagaaagacaagtgattcaacaattccttggcagtgtgataaatgtcatgattgaggtgtgtccttgtttatttccaaattccttctaagttttaaaggtctatgaagtgaccattgacacatctaaaaagggtagcttgaccatttcacaagtgatggaaattttaacgtctgtcattttcaagtgtgggtgagaatggagtacaaagccattcttataaacttctggtaagaccctacattggtacaaccatcttggggaatattttggcaatagtttataaagtgaaaaatatgcctcttatacagcccagcattttcacttctaggtatgtaccctagagaatctctcatctatttcccaaactctggataccagagcggcacagttctcagatctctgctccacctatattcactctgtacctgagctcatccaagccaatggctttacatttcttctattaaactctccagtcctaacctccagcttacactacagacttgtagtagaactctccatctggatgttgaatgggcatttccaatgtatatatacaacatatttcgatccttcctacccctagatatgttcctttcaaagcctataaaatagtaccgttatttacccagtcaaaaccactgggctcatgttggacttgtttcattctttcacatcatgtctggttcatttgcaaaacctgtaagatccagcctcaaaagaaatcctaaataaatcacttctcaccatctccaacattactgactatccaaaccttcatcatccctctccaggcaatgccttctccttcctactcagtgccctacaatttatggtccacacagcagccagagtaaaccttttaaaaccaaatctaatcatgttattccaccctttgaaaccctccaaaggcttcccaacacatttagaataaaatctaaaatacttagtgaggactaaagcccaagtgatgtagcctttggctccatctccaatctcacttcaagctacctttttccttggtcacttgctctgtcttgctgtcattgaatgatgttggcacgcatacatctgcatcaaggtctttgcacttgatgatccttctgcctggactggtgtttcctgggtgtgcacgtggcttgctcctcacacatgtacgtgacctcagaagggctttcactggcccatatttaacacagcatcctgccatgcttcatcaccttcctccctgctttctctgtccttctagtacctctttgacattatatttatttgtttacttatttgtttctgtcactcataatatgagagtttcatgaaggcagggcttacctgtttcttctatcactgcatctatcctggtgcctctaaaagtacttgctctttagaatgaatgaaggtgcccaaggaaagaggtatacaaatttctactttcatttataattagaaatgacctaactatccatcaaccaaataatggataataaattatgatatattcatatatggacttctgtaccttcagtgaaaaataaatgaacaagatctacctacatagctggtatataaagataaaaatagcaagttgcaaatgcacacagtgggatagtttttacataaaattaaaaacagcccaaactacccgttgtttggataaatgcatatgtagtaaggttgcagaaccattttggaggtaaacaccaaaactaggatactagttatctatctggtatggaatggaattgaggtggggtatacaggatgctgcagtggcatcagaaattatgtattcttttacatgtaagtcaaataatcaaaaatgtaaatcaaataaggcaaaatgttgagatctgaccacactggtgtaggcccgtggctattcattatgctatcatctgaacacttctgtattagcttgaaatcagttcataacttgcaagttcttaaataaaacaaaaacttgaagctgtcgatgcatcaaccatttataagttgcataaatactgattgttgctcctgtagttaccacgtgggctctaccccatgtcagaaaggtgtgatcgaaatgaagggtggcttttggggccacgtttcaatgaccactgtatactcttctcaccagtcccataacctgacttttagataaaattgaaaactgaattgtttaaactcagaagcaccatcatctccaagaaaaatcccttttccaattcagtgagaacaatgtcttataattaatacattttccatttttaaagagcacctctcgtatctattctcatttcccattatgaagatcttggaagtcagataggtccagtctttttccccaattgacagaagaagaagctgagatctaggagccaaaggagtgagtagcaagagcagaacttgatacaggccccctggacccctggtcaccataactcccagtgctgtgtttctgaacttgggggaccatgtacatctgccatcatggatgtaaaagcagaataccacctgtttgtggaattcattatgttacttataatgtgcaactctcttatttcattcaagttctgacagatgaaagttcttgggaaagagactgtgaagacgtttttactcttataatttaagctgcctcagcttccatgaataaaacatgagatatgcatcttcagagctacaagtgctactaagatgttctttttcccctaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcaggtgaggaactcaagatggcaatttgttttttgtgtgtgatgcccttcagtttaatttacttttctctgaaaaacaggaaatagtaatcaggatgaaaaggaaatttgtttattccctttaatggattatcatggtcatttaacgttgagaaaagaaggacagtatctctttcggaaaaatcttcagtcatccaaaagactttactgtgaaaagacttttctttactgtaaatttaaaatatgcctccaaaaccacaaaaaagaaaacatgcatattgtaagaaggcgtgttgagttttttgttgattataggtacttgttactagcaccatgctctaaccaattgagctaactggccattgattataggcacttgtaaattagctttttttttttttttttagtatttattgatcattcttgggtgtttctcagtttctcagagagggggatgtggcagggtcataggataatagtggagagaaggtcagcagataaacacgtgaacaaaggtctctggttttcctaggcagaggtccctgccgccttcggcagtgtttgtgtccctgggtacttgagattagggagtggtgatgactcttaactagcatgctgccttctagcatctgtttaacaaagcacatcttgtaccgcccttaatccatttaaccctgagttgacacaccacatgtttcagagagcacggggttgggggtaagattatagattaacagcatcccaaggcagaagaatttttcttagtacagaacaaaatggtgtctcctatgtcaacttcttactacacagacacagtaacaatctgatctctctttcttttccccacatttcccccttttcttttcgacaaaaccgccatcgtcatcatggcccgttctcgatggtcactgtctctttggagctgttgggtacacttcccagatggggcggcctggcagaggtgctcctcacctcccagatgatgggcggccaggcagaggtgctccccacctcccagacggggcggccgggcagaggcgctcctcacctcccagatggggtggcggctgggcagaggcgctcctcacttcccagtcgtggcggctgggcaaaggcgcttctcacatcccagacggggtggcggccgggcaaaggctctcctcacttctcagacggggcggctggcagaggcgctcctcacatcccagatggggtggcggccgggcagaggcgctcctcacctcccagatggggtggtggccgggcagaggcgctcctcacctcccagacggggcagccgggcagaggcgctcctcgcttcccagacggggcggccgggcagaggtgctcctcgcttcccagacggggcagccgggcagaggggctccccacatcccagacgatgggcagccaggcagagatgctccccacttcctagacggggtggcggccgggcagaggctgtaatcttagcacttcgggaggccaaggcaggcggctggaaggtggaggttgtggcgagccgagatcacgccactacactccagcctgggcaacactgagcattgagtgagcgagactccgtctgcaatcccagcaccccgggaggccgaggctggcagaccactcgaggtcaggagccggagaccagccccgtcaacagggcgataccccatctcctccaaaaatagaaaaaccagtcaggcgtggtggcgcacacccgcaatcccaggcacttggcaggccgaggcaggagaaccacggaagtccggggcagggaggctgcagcgagccgagaccacggcagtatagtccagcctcggcaacggagggagaccgaagaaaggagggagggggagggggagagggagagggagagggtaaattagctttatttgatgtaaaagttcaaaaatttagttctctgagagtagaaattattaaaatcgtttttgttttatagaaactggcaaatatttgagatttaaaatatggcaaaaatgatgaaagtgaaaaataagaaatgtagttacattatgtttttttcttggttataaattaaacaatactttatttttttaattcatttttttttggatatggaaatatgttaaaagaaattaactgtcttactacttccatttgcaaacttcctctgaatacctgagtatgaatcactaaacattttctgaaatggccaaagtaacattatccagcctatcaaaattaaaagtaatttttttaatttattttattttattattattatactttaagttttagggtacatatgcacaacgtgcaggtttgttatatatgtatacatgcgccatgttggtgtcctgcacccattaactcgtcatttagcattagatatatctcctaatgctatccctcccccctccccccaccccacaacagtcccatgtcatctaaaacccagcccacattcatatttccccagttgtccccaaccaaattgtccttttttttttttttaattgggacagagtcttactttgttgcccaggctggagtgcagtggcatgatgtcagctcactggaacctcccctcctgggttcaagcaattctcatgccttagcctcccaggtagctgggattacagcctcccaagtagccatcacacctggctaatttttgtatttttagtagagatggggtttcaccatgttggccaggctggtctccaactcctgacctcaagtgatccgccttcctaggacacaccacgcccggcccccaaattgtcctttattgcgttttgtcacaagtaggatttcatccagaaccatgatgcttgttatatttcttaagtctcttaatctcactcagacaatccccttttgataataccaaccagatgaggaatataatgtggttttaacctgtatatgccatgaaataatcaggttacttaatttattcaattttctgttctggaagaaaacaacttattttgatgtctttcttttaatttgtatgaacactatttcattgtaaagtttcaatattgtaacttcactatatccctagatgtgttgaacttgactgctgggatggaaaaggtgaagaccaagaaccaataataactcatggaaaagcaatgtgtacagatatcctttttaaggtaactttaaaaataattacacagacttttccaaactctgtgaaaatgcaggaaatagggagatggagaagagaaaacaaatgattcattttctcaagcattatgccttcatattcccttcttccagtcttgaggaaaaagtcaagacaaagatcttttccactgaacgtccccttcatgatactgttcttgctttcaaatggtgactgtgttacataacaaggtttctctggcagagtttacctagttttacttaccttagaaacagtgtctccttttgttatctacttatttgcttatttactttacattattcctaaaggacttcaaggtggcataaaaagataaatagaatacaggaataaaatagattgtaaatagggcctacaagaataagaaaggccgggcgtggtggctcacgcctgtaatcccagcactttgggaagccgaggcagggagatcacctgagatcaggagttggagaccagcctgaccaacatggggaaaccctgtctctaccaaaaatgcaaaattagctgggcatggtggcacatgcctgtaatctcagctactcaggaggctgaggcaggagaatggcttgaacccgagaggtggaggttgcagtgagccgagattacactgttgcattctagcctggacaacaagagtgaaactccatctcaataaataaataagtaaataataagataatgaggttagacaaatcaaaagaatgaaattctgtggtttgcaaatgtcagctgcagctgtctgtcggtttggtataactcaggatagatattacaacaccaggagcagcggttctcaactccacctacatgtgaaacatcaccatgggtattttcaaaaacataggtgctgctgggcgtggtggctcatgcctataatcccaacactttgggaggtggaggcaggtggatcacttgacgtcaggagttcaagatcagcctggccaacatggtgaaaccctgtctgtactaaaaatacaaaaattagctggtgtggtggcatgcacctgtaatcccagctgaggcagagtcaggagaattgcttgaacacaggaggcagaggttgcagtgaaaccagatcatgccattgctctccagcctcagcaacagagcgagactctgtctcaaaaaaaacacacatacacacacacgcagatgtctagatgctatgcatagtatttctcttagccaagatattggagagttttgaccagcaatgaattcaagataatacttcttgatatgtaccaagagtatattcaagtgggaagccatgaatttgcatagccaggaagaataactaaatgactacctcagccacaaggaatgcctcaataaaatatttcaagattatctaaccttgggctttatcatgtcaaatggatttgcctagataactattgtgaaatatttttctgattaactgaatgatgagatttgccctgtgattagctacaaaccagtaagaatttggggatttttaccaaatatgatgctccggttgtagaagtgctggtttgaagcctttctttctaaagctaagcagagacggggccaaccatctcttaaagcctctcctatttcatggagaatagtgaaagggaagattatgtttagctccttcaaatgttgttttctgtaattaagttctgtgttacagatggggggtcaagaacacttctatgtttcacttacatgttgcttgaccaacgagaaccccttcccccggccttgtaaccaggctaataggaaacaagggatactgcaaatgtcactttagtacacagaggtctacatcaagttaatgaagtatagcccaagactgatttccaaacacagaggaaagtcagtgaaagcctccagcagtcctgaggttactacccacacttttctgcatgaggtggggaggagtcatacagtggtcgggagtgaaaacctctgtgccagagatcacctgctcctcaagaagaaaggtggactctgaactcctggcctggcagattaacaagccacagactggcatgccatttaggtgaaatctcttgtaagttaatagcaccataattctggagaagtaaaagatagcttaaaaaattgtcattaaccattaactgcaccctggctataaccacagggaactcaacctttagaggtgtcaaggtagatgggggctccaggtctgaattgctggaattgactttctgaaagactcaattaatagtctctgaatagttttgggtgccttaatttttttgctcttttctctcattaacgtttttttttgtttttaaaggatgtaattcaagccatcaaggaaactgcatttgtcacatcagaatatcctgtaattctctcctttgaaaatcactgcaggtataatgatccattctgccacaagtctctatgtggtattgtttcctaacccctaatgcccactcctgctctacaactttttaaatagctgaatagtttgttttgtgaagtactaagttcaaataattctccagcaagggcacctactcttatgcaaagcaaaaaacaacaaaaaaaggaaaaaacgacaaaaaaccacccttgtccccccaaaccaaatcattttaatgtgtttcagaaatacttgttccaaataaaagttcagagattgggacaccttacttaaagttccattgagctggaagatttgacagtatatttgaaatcagatttgatgaacttgaaagacattttttattcttctttccagctcttagttttggaacagaatctccttctccttcttttaaaattataccagttaaagtttttgatacatctcacattagcattaagaggacaataatgcattttgccaagtgagaatctttaattgcctagtaatgggtgtttcttattcttggacggttaatgggtgtttgaatttacaaatgccacttttttctctccagcaaatatcaacagtacaagatgtccaaatattgcgaagatctatttggggatctcctgttgaaacaagcacttgaatcacatccagtatgtatttttaacaaaccatatttctagcatgaatggatttgttttgaaaatttctgaagggtcaagtagtactagaggactaatgctaaagatcttcatatttatttaaattctttggtacggaaagcttacatcatgcttcagagggatgtaaagagacacaaaataaacatctggttcaatttcatttggaggatctttgggtcttatggttttcagatctcagtcttaaagtttcataaagcacccaggccaagagtccagattcaggtcagttgttctcaaattcagttacatgttagaatcacctacaaaactgttaaaaacacctgtgccagggccccacttggagactgatttaattgatgcagggtcagccctgagcatggtgttttaaaagccctccaggtgaactgtatatgcacccggtattcagaacccatgggaggctcatgctgtggaaagtgccctggattgatgtcacgacatcctgaagttcatgttcctaactccaaaataaatcactgagtaatgttgcacatacatttttgaacttcatgttaaacctgctaatttcttcataaagcaaagaacattaacctgtgctccatagataggctttatgagatctgtgaattcattctaattgcatgcaatttttttgtatatactcattctagagagttaatcacatttttataaggatccatgacctccaagagattaagatccacaatcacaagatgttatgagctccaaggcagctaatgaaatcaaagtggaaagacctgctattgacagcagcacctgatgggctcaaacctggtagcatgaggtagtggcagaagaacatcacagcaaatgacagcaggaaggtgctttgtgctacatgtaaacactttatgaggttcttttcagaagtgtgtctatgggaactgaaaaaaaatatgagagacaaggatatctgtatcctttgtcccccttccttcttccctcgaacttgcagaagcagttgctgcaggtgacctgcccatatccttgcagtgcctcctgtttccctgaacactggcctgactttccactgccaacatccacagctttttgcctgagagtgagctctggtcactggagcctgctctgccacacatgaaagaccagcagtgccagggaattatcacccctatcccatgcttcatccctcccgaggtgggataaccctgagcacctgctcttctctgccttccagggtttcccagcaggatcgtgctccagctggctgcagtgataacacacccttgatgagctgcctgtcttctttttctcactttcccacacctctgttggagtttccttccaagtagacgacctggtgcaatactacttttctctgaggctgattttaagggaacccaaactaagaaacagctctgatttattttatttgtttttacctaggccctccatttatctttctgattaggttaaggtgattgcttttgtggaaagttcactgtattcttagtgaagtgatgtgcacatacttttaccagctgaagggtgtccaggttcttggcatcttgaacaaagaatcggacaaaatgcacaaacaaagcaagggaagaatgaagcaacaaaagcagagatttattgaaaatgaaagtacactccacagggtgggagcagcctgagcagaggggctcaagagccctgttacagaattttctggggtttaaataccctctagaggtttccattggttacttggtgtccggtctatgtaaatgaataggatgaagtaaagttataaagtcatttacttggtgtacatcctttgtaaatggagaggatatttcctgtcatagctgaagtgtttccatttgatttagttctaggaagtcagcatgaataggccttatattccctgcctcaagaccctattctcctttgaatacaggacaggtgtctggggaagcatgggtaatataaatgggaataagacctgctccaaaagctaaagagctttcaaccttgggagtgggagcaggacacaaatgtgaacacataactagaaaagaagatggcgtatggtgctttatttgttggaggtgtcctggtacaagagagatcactggggaatgggccagttataccacgctgctggaaggaaacagcatttcaacaaagggttttatttgaggcaagacagacatatgagtgcacagtgccttacatataataagtagtataaaagcaagttttgaaaatgaatggatgggtggaggggtgggtgggtgggcatatagagagatgggtggaggaatggggaatggaagactagatacaggacggttctgtagaccagaggtgatagcatacaggggcacctcctttgcagatataaatctaagcaaatgatgctgtagtcaagttcagattccaggaattggaacaactcccttcttgattcccttatcaaacctacaaaaccacaaaaccacaatctcaagtgttgagggttgggtcagcctactcagcagacaggcttactatacagcctgacacttggggggatctggggggcctctcacttgggaaagctaattctgaacccagccatcacaattgtcccttgcactttaccagatacttaaaaggtgcaaggccctctggggagcaggaacccctccccggcacatcccaggccagacccctgctccactggggaggttggagcagctctgcacacctctggaaactatgtggatttcaagtttgcagcactagtctaaggaaaagctcaatgggtgtgctaatttgggttggggagtgaaaacagaaggctgtgccgcctgccatctagtgggtgttgggttgcatcactcccaggcctcccaggctcctcctggactgggaaggagaatggagaagcacagcccttccttaattcagctctttctgtttctctctagcttgaaccaggcagggctttgccatcccccaatgacctcaaaagaaaaatactcataaaaaacaagcggctgaaacctgaagttgaaaaaagtaagtgaaacacacacatttataatggaagcatacataacatgtgtggacatttcagctgttgagaattcaatttattttaaaaccactgatttttgggggaagggtgtaggggtgatgttacaggtacttttcagagcaagattgccacatttccatttaaatttaatttccatatcaattaattcatgcagtaggaaaagcatatctatatattcaaatgccagaatttggagagggcccaaggaaaattgagaggaaagtagaagcattttagaatttctcaagatataaggaaccagcattttataattttatacactctaaagtcctcataagtttcccttttcagtttgccccgtgctctatacctatctagggatactaggtacatatgagtgtgtgactgtgtatatgtgaatagagagatctagagacaaatgattttatataaacatgtttccttttattctcccaggatgatttccttgaaaatattttctttcagagtatatcctagttcagtgaattaatggtatcaaatattggcatgattacacttcattttccccccaagtattctaaatgaaaaattttaaattatgttaatgacagtttattttattacaaaagcaataatgccatagaaaaatcaagacaatgaaaagtgtaagaaagtaacagcactaacatatattatacacgtattcatatactatagacacatgtacgtaatgtacatgtgtagatatatacccacatttttaacatgactgagatcatattaatgatactgagtttaaatttttaaaatttaaccaagtaagtatacttacatcagcaggatatacatctacatactaactttaatcctaatgtatgaaacactatatagaatttaatatatatgacatagaattgtatgcatttattatagcatgatgtaacgagtcccaagttgatggattttcactactataaacatgcttgaatgttattttgtatgtttgtgcaaccctctccttgaaatcaattggtgcaattagagttattcagccaaaacgtatatatattttatattgtgatatagtttgttatgctttcttttaggaaagttctaccaccttagactcttcaccagtcatatatgagagtgcctgtttcccaccaatatccttaatgctggctgttggccatttttaaatgtgtgtccaactcatagaaaaaaattggtaccttaggggtttttttatttgtgtgtcttcaataactccttttttgcatattactatttgtggtttgtccctatgtgttttcccatttttattattttgtttacctttatctttctgacttatagaaaaattatttagtcttattttgtatagtaggatataatccccattaaatcagttgcaaatattttttcctgaagttttgttgccaacctgcctattttctatcagttccccataactgttcgtaaaccttggtctgtgccagattctccaaattatgggcttttgttatctagccttaaatccttcacgaggactgaacctcctctcaaacttggtgaccagaattttgggcatttcacccatgtccccgcaattcttcatcatgtgtatataaggtggttgttgcaggtttcttacaaggtcgagaccaccaggaaatggcgagagagagatcactgctgaaccttagaaacatggtgccttggtgcctgaacattctatttcttctctcttttcacgtcctcctcagtgtcgatctcaaggcctagggtttgtatgttacctagcatctgtcaccatctctttgcgtgtttttgctaacagaacagctggaagctttgagaagcatgatggaagctggagaatctgcctccccagcaaacatcttagaggacgataatgaagaggagatcgaaagtggtgagctgtttgcttttattttaagttacatgctttgaaaatactttttaaataagaaaaccaggctgggcacagtggctcaagcccataatcccagcacttggggaggccaaggtgggaggattgcttgagcccaggagttcaagaccagcctgggcaacattttcgtagagatgagaccccatgtctacaaaaaataaaatattagccagacgtggtggcctgtgtctgtagtcccagctactggggaggctgaggcagtaggatcccttgagcccagaggttcaaggctgcagtgagctatatgtaatcctaccactgcactccaggctggacaacagactgaggccttgtttcaaaaataaatgagtaagaaaaccaggaatttctttcagaagacccttttatataataatgccgttttaattcctcatagtaatattttggtattcttggtattttgccaaacacttcccattttttctggctactaaattttaatggccttgtcatctcccttcctattggccattcagctattcagcagaaattcttagccagagaatccctgaagcacttgctgtagtaggcagaggaagcaatataaggcacattttgtaatccctttgtatagacaaaaacatgaacttgagtctgttaatgatgagagtagagaggcaaataatttaagagaccctcaggcaaatgattggtttgtctccacaaagtgaactagaaactaaaagccagtattaaaatttcaagttcaaattccttcaaataaccagctcaccagaattatctctgtgtagctagataattttaagaaggcagtcttgcttaaaatatttgagtatgtgctattaccttctcttttactttgatcacatagcaacaatcataatgttcagttgtaaatgggtcatttgagagtttggggatgattttagagaattatttgtttgttatgtttcatgagaattgatgaacgaaatgacaaggacttgtgttggttatacaatgccttggatttatatacaggcataccttggaaatattgcagattcagttctagaccactacaatgaagtaaatattgcaaaaaaattattcacaagaatttttgtttcccaatgcatacagaaattatttacactgtactgtaggctagtaagtgttcaataacagcattatgtccaaaaatgtaacttaattaaaaaatacctattgcttaaaaatgctgacaattatctaaacctgcatcatattgaaatctttttgtggagggtcttgccttgagtgatcagggaggcagttgccaaagattgggttggctgtggtaattttttaaaataagacaacaatgaagtttgctgcatcaattgacccttcttttcacaaaagatttctctgtagcatgcagtgccatttgatgacactttacccagagcagagcttctttcaaaattgaagccaatcctctcaaaccctgctgtgatgccttctcaactaggtttatgtaatattttaaatcctgtgttgtcatttcaacaatgctcacagtatctttacctggagtagattccatctcaagaaaccaccttctttgctcattcacaagaaacaactcctcatcggtttaagttttatcatgaaattgcagcaattcagccccatgttcaggctccttttcaaattctagttctcttactctttctaccacctctgcagtgacttcctccactgaagtcttgaacctctcagcgtcatccatgggagtctcccaaactcctatgaacgttgatatttttacctcttcccataaatcatgaatgttctttcttaatagcatctagaatggtgaacatcagaagcttttcagtttactttgcccagatccatcagaggacattctcttttaggaaagctagacatagagctaaaaatccaaaagttggaagaattaactaaccttattcaagactccttaataaagactcctgactgtggaacagactttataagtgattcagttgcatgtccagtccttgggtttgacattactcccagagaaaagtcataatgactgtactttcatttgttttatgtggcagggagggtctaagaggctaaagatatctgatactactcagttgatactcgttattatggtcatctgttactatgcaataaaccatccccaaatttaggggcttataacaacaccttatcattttctgtcataattctgtgggtcatgtgggcttaggttggtggttctcccttgggtttctcctgcttttgtcagcagatgacatctggggctgactggttcccttgggtgggttatcccggacggcttactcacatgctggcagtggatgctggctgaacgctgggagctccgctgggcctcactgaccatagtatccctgtggcctctctctgtgacttgggcttctcatagcacgatggctaagtcccccagatggaacatctaagagccagtgtctcaagaggcaggaagcagaagctgctaaattagttaagagctaggcctggaactggtgcagtatcacttcctctatgttttattcatcgaagcagtctcagggcccatccaagttcaagagggtgagtgagtgacaaggtcacgttgcataagagcacagaggagggcagatgatacggcagctgtctttggaaaatatagtcagccgtgatgcctactatattttttcacatgtttttgcaaataataaatctaaacaagatttaagaaaaatatatttatagaactgtgtttcaaatggtcaagaaaatactcctaagatacaaaaaagatgactattcagtaaaaccagttcctttaagttaaatttcatagatggtaattaaaatatgtaaggcattactgatacgataatccagtaaaacaaactgcagaaataatggaataaattaacaagaaaacaatgttaataataattactaccatcgttgtaccaacagtggaccaggcagcttacattatggccttatctaacctgtatacagcctgatgaaatgggtattattattattattattattatttttgagatggagtcttgctctgtcacccaggctggagtgcagtggcgcgatctcggctcactgcaagctctgcctctgaaatgggtattattacaccaatttttcagatgagaggactgaagcttagagaggtaacatattttgcacatgatcccacagcgggcaaccgattgcactaagattcaatcccagagctacctgattcaagtcaagacttttgtacgttacagtactgccctttcaattcacaggaatatggtgaaaacatagatatgcaaaaatacttttttaaaaaggagaaagaatagaacgaatgaaagtcaaagatgtgatgtttcctaaacacacacagtcatctgaaattagcatctgtatggcttcatgtattattcttaaaggtgctttcccaccatctacatccatatggtaattattcctccaggcagaaaaatatttgcctctagtgactcccatgttattccaaaatatacttgagatttgggttaagtcttaacagaaataaccacatgatttagtatccacgtaggaaagtacctaaggacagaatcatccacctagatggcacaaggctcctgtttcacctgttatgtgtgtgattcttaggttgcctcagtaatacttggctttggttctggtcaactagtcggctataattaccttagtgccactgtatgaatctactatctatgtgtggctagagtctctaatttaaatacatcaacacagcaggcaaggggaaaccaagcatagttcaataggggaggcctgcctggaggctgtagaaaatagaaaaggctttcagtcagtgaaagcaggtgcccaggcattaggctggatttagattcagaaggacatgtggctcccaggataggagacaagtagtggagaatatcaaaattgtatgtggttataggtgtgtctgtgcatatctgcacactcagaaagtgatcatgtattcatacaattctcttaaggtggttagtaagtctccaccacttgtttggggtatgccccttgccttcaagtggtttacatctgtattggcagtttagacataaattaaattaaatgaaatgaaattaataaattaaatgaaaatttaatagtgacatgagaagttttgaaatcttggttactgactgtaggtcatggaaacctagtcctggaagaactatgttaagaattcaagagacaggtagatccattatcttgctgtgtgatttcagacaagtcaaatcatatctctgcatctagttcctcgtttataagtaaagacagatgctggattagattattttaagatgtattccatttcctcaaatccttttcttcctgcctaagccttacaattacccacttgttgttgttgttgttgtttggattttgtttttttaatcgtctgcctctagaatatcccttcatcagaattgttagctccagaagaggaaggtggctgtttctttccctcaccctcctcctgtgcctggagagatacttcacaaaataaaacagtctatctagaaattctgaatccagatactaccagttgaaagataccactgttttattatgactaagaaagaaaaagtagtttccattcactggaaaaaaccgtcagttgaagaacacactgcaatatcagaaatattaaatcaaaaaaagtacatcttagaatcagtgaaatcatttttcatttactcctgttctttcattctcctttgtacttttaaacatgctttaaaaaaatctatctcattcttatgggtctactcatttcctttctgaatttctcagaaattattttagtgggtttttttgttttgtttttacagtaacgttccctcatgccctgtggtgtgaccatgtggatttatattgtcctcatcctgatgtctgtgggtttctcctgatcctggctagattttaggcaaattctttatctgggaattactgcaaatagtgattgtgtgaatccaaatctcacctcagcatgttgcacattttccagcaggtacttcttttttttccccacgaacatcctgggtggattctggcattcttgtcactttcctggaccaatgaacacagtgtgtgtacttcctttcacagactagaccacgctccagggacaccagctttatttggcacccacttccacttctcctcctacctgagcctgacaaatgagccctgagcctttgaaacctatgctaggtttgacaaatagtttgcaggagtagcacaatccttctgaggcctttcttttttctaccactccaagctataagtcattatgcccataaaattcaagtggacattttagtctctttcaaaattatccgatgtatttgttttcttgcatcttcttatttgctcttgatgtcatgaaagatcaaaacacctttttatgagttatagatattcctgcagtgtttgaggctttcatttttagaattagtatactagaatagaagtagccatccacttaaaaaaaatttattaagcatcaagcatttcaaaccacattttaggagcaggagaaataatacataacaagatgtgctccttgacgttgaataggtaagagtttagtgagagttttacttgaaaaaatactgcatatatcaatgtccccattttcttttagcatcctttttctctaaaagtgcttatgttctacccaagattgtgaacaaggtctgactacttggcagtggtttggtgtcatggattttccatttgtctttcacacagctgaccaagaggaggaagctcaccccgaattcaaatttggaaatgaactttctgctgatgacttgggtcacaaggaagctgttgcaaatagcgtcaagaaggtcagagtcccctttctttcatcactctcaagaggtagcagctgttatttatgaaattttggaaatgtgagaaccacaagagaataaagtaacctataattccccttctaaattgcttaggatacgagtctgtgctgggtgaccagaacttgacacatacacaatattaaatttaaaaggacatttaaattactcattagtcagggccagtgttaaccactacccatttggccagtgtcctctaaatattatcatttattgtgttattgcagctggggagggagaaaatgacagcatcccaggggtaagatttaatcttgaattcatcaggaaaatgacccctgaacatcccgagtctagccctcatttgagaactagtcctgctaattatataccttccccctaaagtacagtaagcataaaaatgtttccagatattcagccaaggaaaatagttattcatatacttaccttttgtcaggcatagtctaggccataatgacctaaaagtgtaaaacacacttgccttctgcccttaggcagctcatggccccctgtagtttagggaaagggatcggaaacagcaaacaagcaagtagtcaaataactatataattacaacttacggtgagtgcaattatgaacataaacacgcatgctgaagaataatgaagtagaaagaataaggaaaccagaacgcaaagggtcaagaggaattggccatgcacagaggttgatgaatcactttccatgcggagggaccacagtaacaacagcaagggctgtgagtagagtggcttgagtgagggtggagtgagacgagatgaggcaggtaggtgggaactgggtgatgtaggattttggaggccattatgagaaattcaaatattcagtgaaatgtgacactactgaaaaagtttagagaagggggcagtgtagcctgattcaagttttaaaagattgctgtggttgccatatggagactagtttaggaggaaacaggagtggaagcaggaaaagcagtgaggacaggctgctgctctaggccagacgagagtccccgatggtcaaaccagacaatgcatcagagaggactgagtggcttcaagacatattgagaaatgggacagcctactgatggatggaatgtgggaatgagagagaaagaagaagtgagatgaccctctagtgtccttgtttgaggaactgggtaggtgatggtaccatttactggcatggggaagaccgaaagagaaagaattcaggagtttcaaatgggatgactatttgagatgcctgtgaagtattcaaggggaggtgttcatatagcattgccatctgactctttctctgggttcatttcctaactgtctaactttgggtaagttacttaacctctgtgtaccttagtttcctcatctgcaaagtgaagacgataacacctatttcatggggtcactgtgaagagtggatggtttgtgacatgtcaagagcttagcgtggtgcctggtacatggtaactcctgtaaaggtattagttgctggtatattatcatccttttcatctttatcattgtcattatcctcatgatcactggcgtcattatcacgcgtatatagaagacaggttgagctagagatacaagttgggagttcaaaagatcgtatttgaaacaatggaaatactgagatgattcacaaggaaaggtggaaaagaaggcccaagtggagccctagttaaaagtggagccagaaaagaagagcaaggtatggctagagaagtaggagggaaattaggcagtgacaccaagaaaaccaggaaagagaacagtgttaacagaaggactgagtggttgactgtagaatatgttaaaaatcttagacaaattaaatttaacagagtttagttgagcaaaaaaaacaattcccaaattgggcaggacccaaaccagaagaggttcagagaaactccagtgcagccatgtggtggaagattttttggcagaaaaaggaaagtgacctacagaaaacagaagtgaggtacagaagcagctgtattggttacaggcttatttgccttatttgaacagaggttgaatagttggccacctttgattggctgaaactcagtgattggcacatgagtaggttccagtctgtttacacacccattcagtctacagtttactatgtgaaagtttatgaaaaaacctttagaataggtaaagagacacctttaggctaaacttaatttaacaaatgctactgactgattaagtaagaagactcaagagtgtcctttgggttgttagcatggaggtcgttggcaaccttaaagagacatttcagtggagtgccaggcagggtggtgacactggatcacacagatatgaatgactagagactatgcttttgagaagttttgatgtgaaggggagcaagaaatggactggtggccaagggcacctgaggagtcaagggagtgttttctttttcggatgaatgaatctggagtgtgtttgaaaacttggaagtggtgcagtagagaggaagagattagttttgcaggaaagagaggggataactgcctggaattccttgaggaggtggaagagggtgggattgctgtggtgcaaaggtgtggcccttcacaggagcaggaacacctgattagtgaagacagtggatgaagatgcaggtaggcagatacatttggtgataggaagaggggagagtatttgtctgatgagcaaagccaaaggaatattgcctttacacactatcttttctgatatagggaattgtgactactctgagaatattgaacatctattaagactcaagagtattgttttaatacaaaaattagccaggcgccatggtacgcgcctgtaatcccagctactcaggaagctgaggcaggagaactgcttgaacccaaaaggcggaggttgcagtgagccaagattgtgccactgcactccagcctgggcaacagagcaagactgtgtctcaaaaaaaaaaaaaaaaaaaaagttgctaaagccttcatcaatattgtcttagtgtcttagtcagttggtgctgctatcacaaaaataccattggcttaaacaactgaaaactatttgtcaccattctagagtctaagaagtctaagatcaaggttccacgcaatcagttcctaatgtggggggccttcttcgtgtttatgtcctcatgtggtggacagagaataaggaggcaagctctctcttggcttggccctcatgaccaaattacctcccaaaggccccatcttcaaatgccatcacatgagaattaaggtttcagtatatgaattggggacagtatggggggctgcaccagcaaacagtccataacaaatacccagacatgaatgctgagttactcaagagtgaccattcatgctgcttttcctaagccccatgactaaagcactaattaaataattataataaaacatctaagtaggtaaagactgtccacgaaggagggaaagagcattaagattagcccttctggtgcataaaacagtgaggccatccatggctttttgtcatcagtaatgtcccaccttagcaaataaatagaataacaagtttacctacacttatttaaatatctatgtatgtatggctaataaatttggaattttgccctttagagaagtaaacaaattatttcctttctctaattaggcttcagatgaccttgaacatgaaaacaacaaaaaggtaacaaaataattcccttgcacattttaaatcagatgcatctaatttaaaaaatcttcaaaggaaggaatcagttgtggtgaaaaaatgattaaatcctgataaaaatcacaaaactagggcagatgagtaagatgattttctaaaagtaggtatttaatgcagtaaggcattttcttcactggaattagagatttcattcctgcagtggaactacatgatcatcagcatattgaatttgaaaataaaaatgagtgaataggtcatcaaatccatattatagcataatagaaaggatgatcttagttcccactacattgacattctggaagatcactgattaattttacactgcataacttctaagagtattatttgatgttattagctattggccttattgtaggaaaggtaaagttacattttcactttctttcatcctcttcaaagttcttcaagtgatcacagtggttttatttagtaagtatttatggtttatcctacaacagtgaggctgacagccacaggcagaagtttgcctaataacttcattctcatacttcagaggttcggaaaatactgccttgctgcctgtggggtcctatcctatttgaagttgagatcgtatcttctcaccctctaaatattaaacttgaaagaattatgaataaatatggtcgcaggcctgtcccaaaatatttgtgagtacattactctcttgttctagaatttcataattcataatttgggtcaacagtatacagattgacatttggtcattgtcatttattagctaagttattttaattctcaaggcatcaatcttctcatgtggtcagtgggtaggactctaatcctcactacacatcacagacagtaatgagactgtgtgtgcaagaactcatcctggtgctcagctcatagcactggtggtatttattattattaaacacacatggaaggaacggacatggccgttgtttggtgggggagcaggaggacacattaagaaaatgataaaaacaaaaacaaaaccaaattacattacttgattattgtttcaggcttttattggtgaaatcagtttgataatttagaatgctcagattgttaagtgatcagttaagacaaacaaattgaccatttttttttttttttgagatggagtctcactctgttgcccaggctggagtgcagtggcgtgatctccgctcactgaaagctctgccccccgggttcacttcattcgccattctcctgcctcagcctcccagtagctgggactacaggtgcctgccaccatgcccagttaatttttttgtatttttaatagagatggggtttcacagtgttcaccaggatggtctcgatctcctgacctcatgatccacccgcctcagcctcccaaagtgctgggattacaggcgtgagccactgcgcccagcatctgaccattttttaactcatggattacatcatccaactaaggaatttatccaactagattcactttatgcaggaaatttagctttgcaaagttctcagcaaaaatattgatcacttttgaaggtatttttgttgttggttttattgttgttttttctatcaataaataaactaatttgttttcttttttctgtatgcaaagtaatgcagtttcaatatgtcctatgcagcaagttattaggttacttttaagattaagtgctttttaaatactataaaccacgtatgtatgttgcttacattctagagtgctacagtgaaacatagtccccaaagaggcagcatcattagcacctgggaactagttacagcaatgactggcctcactgcagactcacttcaacagaaactctgagtgtggggcccaggaatctgttctagtttaaaaagtcttccaggtgattctgatgcacgctaatgttcgagagtcactatttttgatgttgtgcctcaatttgtaaaaatatgatgctatatctatttcatagcattgctgtgaggtccaatatagtaatttctttttttttttttttgagatggagtcttgctctgttgcctggtctggagtgcagtggcacaatctcagctcacctcaacctctgcctcctgggttcaagcgattctcctgcctcagcctcccaagtagctggaattacaggctcacgccaccacacccagctaatttttggcatttttagtagagatggggttttgccatgttcgccaagtttgtcttgaactcctggcctcccaaagtgctggattaaaggcatgagccaccgttcccggccagtaatttcttgaataaagtcccttaaaaatctaaaaatgtcctacaaatgtaagataagcttaatattttatgattacctccttttgcattattcagagctacaacagacactaacttcttaaagtatcctttagcataattgaggaagaaaaagcctttacctttcaatttgtgtgtgtgcaattatctttattaaggaaatctgcagcacgtatccgtgggtcctactgaagtcatcaacttatatgttttcttccttgtgcttgtagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaaggtaacaccaaaggttaaatgcagtcgccttttttgcttgattttcttttatggtgctgatgagcttttatctaatttgttgccatttttctttgtgggcatgggggctgttccacctcaccttatttttgtttcacagaccatagaagccaccttggtatgtggtgacattacattgtcattcacgacttcaaccacaaggtggcgatgagagactatggatttgttagtgctgggcatgtagcttcttctgttcccaagtgcattcacaagactccttttaatcaaaagctggttttcaaaaaaacataagaagtatttaaaaacttcatttctgggctagagaagccatcgtaatcatcattatcatcaaaaattcatatttcggtggtggctgaaaagacagatgtctccatccacaggatgtcaatgaaagtaggagctactgacatgataatgtagcattagcctccaaggcctcatgattcagggtgtaattgcatttatttattgctgtttttcggtgagggtttgatggcagagttcctgaatccatctttgcttttcttttacagaacgcaatattcattataacatgtcttcttttaatgaatcagtcggtcttggctacttgaagacacatgcaattgaatttgtcaagtatccttatgtatcaagtggaatgagtggttgactcacgttggtttggcaagagcctctgaaatagataaatggctaatatctcattctggtggtggagttcataaaatgatatgtgggaaagaccatggcagctgtgacaatctgcccaaatgaaaattgtttttataatccacacagtgaactgtgatcttaagcatcatttgtaaatgtgaaatctgctctgtgctgtctacttgtttgtcattgttggcctagacctttgttgttttagctctttgttgtttatttttctctgctgtaggactctttttttctgttttccttaataagttacagttataacaaacggcaaatgagtcgcatttaccccaagggaggccgagtcgattccagtaattacatgcctcagattttctggaacgctggctgccagatggtttcactgaactatcaaaccccaggtaggagctgatgtccagtgaccccaaattccatgagaacactttgacaggatggtgccagcacttcccatcagttggctgtgggcattttttaaaggaagcagacatatggcaaagcaatgtgttattggatttatataatggtgagaaataaaaaaaaaaaaaccaaaatagagcaaacaatggtagaagataatgtgttgtgattggaatttaattcctttcataaatgccatgactattcctgctaaccattatcccatattccaaaatatttctcatttttcttccttttggatcaaagttgttatctttgtttccagaggcagaattaagtgaaaagaatttgagtatctttgtacagtaacagcgactcatttctcctttggcaaacaccctgaccactgtgaacattcagcaaatatgactgatgcaggggcacttcactaaacaaatacagaatattttgaagtaaatgccactaaaatggtatataaggagttacatatttgaagaggtactaatctataacttggtcctccaaagtgtactcaaagtcaggtttccaatatataatgactttttttttctggaaggaaaagagtaaatttttataattgataaacacatttttaaaatttttgaggtttgcttaagagcctaggatcacagtatcaagactagaggtagcaaaatagaaatagaatagatagaaatatgccacaaaccctcttcactgtagatggtcaattctacagcatggttcttacaactggtaaaataaaacaaaaccagaaagctcttttttccttcaactctttgctattaagagaactgcccatgcttcccaatttgaggattttttaaaatctattttgtattttaagaatccctgtcacttcgttccctgctatgtggattgagtggaagatcctttgactttcattcctttggcatgagtgtgagctgactgtgcttctcatgccttgaaggagcctccccagtgaccagaagctcctcctactggagtcaccattctgcatggggtccccacagtgcttgctaggttagactgtgacgtgatagctaccaatacaatcctgagtgtttctagctggggcccagtaacaaggctctgatgacttcacttacttaaaaaagcccaacttgtgttctcagttgtcagtgagtccataatatggattaaatggctaacccagcttatgttttattctataatattaggtttaaacacaacattttgaagaggaaaaaatatccatcagtttacccatttcttttgcggatgggaagaaagaaaaaatgttattcacttgcaagacagaagtcaaaagccatgtgctgccagtgtagaccccactagagtaattccccctgcctcccatcctggaagcatgccaccaagttttatgcgatacttacctagttcattttccagtcttttaaatcaagtttcatattcaccctcccgggtatctccagggttcctctgcccagggatcctgagacccatcctctcccactgtagcaggttggatatctctactctcaatactcatcaaacaatggtgtgactcctatattgaatccagttttaaaagtgacctttagcatgatctttatgaaaacacattttatgtttaatttaaatgaaacatgaggtcaattcaacatggaagagagtatgccttaaatagaccaagcagaaccttgtagtattaaagagggacctgtgggcctaggagcaatctgatacctattgtttcaaatcaccccgtcagggtcttttttgtctaggaagacaagatgctaaattatttttgtctcttgacagatttagcgatgcaattgaatcagggaaaatttgagtataatggatcgtgcgggtgagtaatatgatttaaactgttttcacctagattgagaactccatactacagctctaatgaagccatgtcattttcaattaggggctacagaatttaagctgggtttgagggatggaatagaaagaaatgaaatacctagagaatatttgcacatatacattcttcatctaccccattttactaagcaggttttgggttttttaaatcacaagtgaagcagttcatacatatgctacagtttaatcctctcactttaaaatcaatagtggaggattttatgtctgggacaggtaataatccctgcacacttggacattaactggagatgtaggcattaaatatgtgcattttacctaggacaaatcaaataatgaagttaatttcatatgtaatgaagttgtgggtgtcgagctgaatttcattcagttgggaataaacctttgtcctctactgattcttttttgtgtcttgtaagtagcagttatcaaagaataatgctgtgaatattgtcctagtttccttaaatagcactcttgaaaactgtgaaccaagaagtgaaataggaaatgttaattctacagaaacactgaaaggttaaatgaaaatataaaattagaattctcttgagataaaaaaaaaaaaacacaactatgtggtcatcccctcaccccacctcagcctcatgcatctgtccccaaacaagtaaatattaataactccagaccactgcccaaaggcctgtagaggaatccaatggaaaactatcccgtcataatgatgctattaggaatttcttcatggtggctcacctgattggatatctttttatcactgaacactgccagtcaagataacatttttcagtggttgtgagttaggaatgacttttcagcatgcactctgcctccctctgccagcctggtgaatggttctctgccaatgtggctgcaaacacagtgattatgctattccccaaatcacccaccacttacatacctggagcatgccctacattttcctctgctgtgtgctttggaagaaaataaattgtgtagctgggaagagaaagatctgaattcatatttcagaattttgtgaaagcaattttgttatttaatgccaagtgttccaacccaggagattttgcgcataaattgctttgtagacctcctcctctcccaagtagtgggccaaggcatcaagccccaggggttcagccctggactgtcagtaaaagccctaggctgggagtctaaagatcagggtttgagctcagctcccagctgctcctagttcttgctgtattgcctagagcaggtgtgttagacccagagcctctcttctctgcttgataaaatgaagacggtgacacctgtcgcacagggtttgttgtactcaaaggaaaaaaaatgtcttttttctagaacgaaacagggaactgaaaaagactttgtcctttgacaaaaaccgagtcctttctgatgagacccacctttgggcttccctctcagtcactgtagaatccagtctgagcaacaatcgtgctagttcagtttagtgaaaatccccagcccttggtatctgaccaccctggatatcctgtcactttggcctgccttcagcaataatcctatcaagtcagtttggccagaagtccttatccttgatgtttcctcatagtaattttccatctgctggcgctcaccttactccatggttctaaatctccatgtacgcttgttggggtaagggttgagcccttatacctatcaccatggctccctacccctttgaataaagtccactttaccatgtttaacaagtgtttgtgtacatttttttctttaacagtttacgacagctcagtcaggttgaatgagtgtacgaaagtacttcaggaactgcacatttctgtgcaaaagtgagatttaagaaaagcttaaggccttgtgatcaatcacacacacagacattgcaaaattcaatgagtgctctgttcagtcgtcctttaaggaccccaaggagtcagcctcagcactcctggctcttacaggacccgtcgggcatggctgtgctcacttctgaaaacttgcagtggcccggtgatgcttgaagcactttccttgcccacctcagcgatcacacctaagatgccatcagctgtctaacatgccatgaggaatcctggcagcctggccggatgcagggagtattgtttctgtataaaaaaaatcctgacggctcggcccagtggctcacacctggaatcccagcactttgggaggccgaggcgggcagtggctcacacctggaatcccagcactttgggaggccgaggcgggcagatcacaaggttaggagatcgagaccatcctggctaacacggcgaaatcccgtctctactaaaaatacaaaaaattagccgggcgtggtggcgggcacctgtagtcccagctacttgggaggctgaggcaggagaatgtcgtgaacctgggaggcagagcttacagtgagccaagatcgtgccactgcactccagcctgggtgacagagcaagactccatctcaaaaaaaaaaaaaaaaaaagtcctgacaatcctatgttgtttgtttttcctagaatttctgcttagccattattagcacgtgcagtgtctcactctctccaccgttatttattttttcttaagacagggtttcgctctgtcacccaggctcaagtgcagtggtgcaaacgtggctcattgaggccttgacatcctgggctcaatccatcctccctcctccacccctcaaatagctaggggtgcccaccaccacacatggctagtttttttatttgtacagatggggtttcaccatgttgcccagactggtctcgaactcttgagctcaggcaatctgcctgccttggcctcccaaagtgctgggattacaggcatgagctactatgcctgacctcactggtcatttgtaaatgcgttcatttattttaaaataccttcacagaaaaggatactgttgctactttagcctgaattctgtgctgatgtgttggacgctatgtgactgaaagcatacacctcaccagaaaagctgaaaaatagcctgtgcagtggggcagcccagcttgataaagtatcagcgatgctgttgactctgtaatctcctaattccccttcccatacacccagctggtggcaaaggctgtcagtgacagggaaaagagaagaaattgccgtcacctgcatgcctctgtgttccatggcgatggtagatgtggggcccggtgctgcacaggagctcctgtcactggtgctcgggcactgcatggttctcaccgtgtcacccttgtggttctcccacccacctgcaaagacttttaaaaactgcccctttgggctgagtctgaggactgcatttcttaaagaggcattctgtgccctttaggcctgtggaggcaaagaatccctgttttatatagaacatcagtgtgcaaagtacacaaacacccccaggatctagcaactgtagcaaaacgtcagataccctcctgggaaaaccctctgtgctccctggctgatcttgtgggaggacgcaccactgggcccaataagtgtgaatgttaccaggaaagtgagcagtgcttttaacagtctcgtttttgaagatggaaaaatggaagacatttccctaattgcaaatgaaacaaaatagtgtaaattaatacctaaaatctttttagactttcataggaaagtgagtgattgatatcaaaatggtatgacattttatgattcagaggctgttttttatacagcatttctcccttgcccacaggccgtacgttctaagaaccccagtggatgcctgaaaccaccaaacccaacatgtattatatatattgtggttctacacattgcatacctgtgataaagtttaatttataaattaggcatagtaagagattaacatcaatgactaataatggaacagttataacaatatagtgtaataaaagttaggtgaatgtggtctcaaaatatcttaattttttctcttttatgtttattggctatttggatattctgttttgtgaagaacttctactcattttcctattgggttttctatcttttaaaatagattttttatttcaaatttttattttccaatttttatattaggttctattttaatatttttggaacagagttgaccaggggtagctgaagcctcagaaagcaaaattgcaaataaagggggatactgtatagcatagcaacttgcagttatcatcagcagccattttgctttcttgcagctaaataaaataatggcatgttggacaactgatggcatcttaggtatgatgaaataggatgcatttccttatgaccccattttctcattcttggtgctcctatccacccacctggttagcaacccttcttctctccctcgcttgccttccaaggccttacacagtccacagaaaatccttggatccctgtcttggcattggctttggccttgtgcctgtgcctaccgcacagacctagatgtctggaatgagttcattttctgtaccagaaagcaccaaacagaccatctatgtcatttgcagggcccaatgcagaatgaaaatgaagggctcctgagaatttaggatggtggatgcagagcattaaaccaagcatggggcccttctgagttcagggccctgtagaactgcacaattagcacatccacatagccagctctggtgccagattctggcttcagcttccctatcaatgccccagccccctgcaccctcacagccaccagggatatgagaggcaacctctgctgctctctcagaccgccttggacccagaacagatgctcctttgaccttcaaagaaagcttgctaagtgtcctatcccaggccagggcttatctcatggtcctgacaagcttctgcatactctgttttactctcttcaagtatacaaaatgaacccatttcaccggagcatgcctgctttggagaattggatatgggtttcttgcccctttcccctgccatttctcattttggatcaattcactccttcagagatgagtgttctatgcagatttgaaaggggggatgtggaagaatgcttttgaccctgagatgtcattgtgatcccgtttcttattttggtgggtaggaagggctcttgatctttaacaaaggactgtggaaagtgaggaatctctggacactcacttcccaaggagattcagaactggaaaggtgactccagtcctgtattcatccaagtcccgaccttcctcgggaggcagaatccctcatttgccacagctggggtccaaatgctgcctgtgtcatgaaagccagacccaccattgttacctcccctcacagtctgtgtcggttttccttccagagaaagctggtgggcttccctcggagatgcaggcgtagtattgtagctactcacctactttccatcctgattctttaccttttgctgtatcatcatattttctagttgccaactctagccacaaaaaaagctgcaaatctaaaattccatgaatacagaagataatctcttctatatagagagcttttatattaatattgtgggttgcattctcttggagacaagagtgttcaaaattaccttcaacatttcaacaattgtgtaaatgtctatattcttgataaaaaatcagtgttgtctcttaaagattcctttttggactatcaaatgtaagggaatatttttaacactttgttttttgttcagtcttagaagataacaatgaatggtgactttttcaaaactaagaaaagtgacattaaactttaaagaaaaaatatcatgactcaggatcccttttgggttgtattttaacagataataaagttgacatcatctagacttgaaattaataaaagttatgcttctaagaaaaattagagatttgagttcccataattttgattcttttacatttaaaagcaaacctttacttttggaaaaaagtacttttattttcattgatgtactgctcatagtatggattctttaaatctatggttatacttatttctaataattttttaattttttttaagttttttgacacaagtttcagggaaattatggaatctgtgattatatgaccactaccccgtggacatgaggggcagacattgtgtagtgagggtaattgcagaacattttcatcgcctcaaaatctgtatcgtttagctttcatctcccaataggaattttaatctaccctctgtctctatatttgcctattctgaacatttgatataaatgaatttatataacatatggcctttcgtgcctggcttctttcacttaacataatgttttcaaggttcatccaggttgtaatgtgtatcaatactttattatttttattgctgaataattttccattgtatggatataccatgttttgtgccatacattcattcatcgatggacatttgggtaatttccatctctggattattacaaataatgctgctatgaatgttcatatgcaagttcttctatgaatatgtctttccatttatcttggttacatgcataagaatggaattgctgggtcatatggtaactctatgtttaactctttgaggaactgccagactgtctttctaagtgaatgcatcattttacactcctactagcaacatatgagagttccaatttctccacatccttgtcaacacttattgttatctgactcattaattacagtcatcctagtgtatacatagtgatatctcattgtggttttgatattcatttctctgatgactaatgatgttagacatctttttatgtgcttcttggttttttgtatatcttatttggagaaatgtctgttcagatcatttgaccattatttagatgagttattctttatgtattctagatacaggcctctaatcagatatatgaattgcaaattttttcctttttgtgactagtctttttactttcttcatagtgtcttttgaagcataaaagttttcaacagaaaatccagtgtatcattgcatgtgcttttggtatcatgtttagaatccattgccaaattcaggtcataaagatttgtccttatggcttcttttaggaattttgtagtttggctcttgcatttagttattttatcctctttgagctaatttttgtatatggtataaggtaaagatccagttttatttatttatctatttatttgcatggaactatcctattatcctgtcactatttatttaaaagactattctttcacccattgattggtcttggcatccttgtcaaaaatcaattggccatagataacgtggatttatttatagactttgattctgtctcaatgagttatgtgtttttctttatgtcagtaccagactgtcttgattaaatcttgtagcttagtaataagttttgaaatcaagaagtgtgagacacccaattttgttctctcttttaacattgttttggctattcttgatcccttgagtttctatatgaattttaggattagcttgtcagtttctaccaaaaagtcagctgggattttgatagagattacactgaattcacacatcaatttgagaaatacttccagcttaacaatatggtcttccaacccatgaaggcaagatgtcttcccatttatttagctcttctttaatttttttaaacagtgttttgtagttttcaaattgtagacacttattttttttaaaaaagtttattcctaagtggtttatattttgctgttgttatagaattgttttcttaatttcatttttgcatgttcattgtcattgtatagaaatacaattgactttttatatgtttatctggtatcctgcaatagtggtgaatttatttattccaatagtttttttagtggattccttagagtttttttttatttatgggatcatgtcatctgtgactagaaataggcttacttccttctttccaatctggatgccttttaatttgttttcttgcctgattgtttctactagaaatggagaaataatttatttttattttcacctacctctagctgaaatgtcaattacctttgattgtgaatgtagacaacaatccacagtcacattagtggtacccgtgactctctcaccaatgtaaatcacagacattgtcatatttcactactattgttacagctgtctcaaaatatttttgtactttagattattgtcatcataattagatcttaccattagatcttataatttaatgcattattacaagtacaattaatacagaggtagaatatcacatatttttatattttgataactatagctaatataattggtttttcattgttattctttgcattttattttatacatataaagaaaagtatttaaaggtgaccaggggataaaaaagttccagagaagatgataggatcaggaagtcctggataccactgaggctgcagctctttaaggttgtgcataagggcgggcacattctcttccatccttaggaccctctgcctaaaatcctagctcctgtgttacagatggagaaaaggaagcatccattgtttcaactagcgagtgttttagtctttgtaaaacctactaataaacttctatgctattgtcctaccaggtaccttctcaaaccagatttcatgaggcggcctgatcgaacatttgaccccttctctgaaactcctgttgatggtgttattgcagccacttgctcagtgcaggtaaggcccctgctcatcacaaggtagtataaatgtatacacaagtggtccttgaaagaaattataaaatattgaatgttaaattgcaagatccatgtgctgctcacaactttgacttaagattccaccccctttttaaaaaatgagacccattttttcactagtaaaattattagctacttaaagtgaaagataccatcaaaaaagtacctgctacttgattccatttatacaaaattctagaaaatgcaaattatagtgacagacagtaaatcagtgatggcctttgaaaaaagggcagggaggaatgggttacaaaagggcacaaagaaacttcaggtgatgatacaaatgtttatcatcttaattatggaggtggtttcgcagatgtgctcatatgtcccaactgatctaattttacattttttttttgttttttattttttgacactgagtatcactctgtcgcccaggcaggagtgcagtggcacaatctcggctcactgcaacctcctcctcccggtttcaagtgattctcctgcacctgtagctgggattacaggtgcccaccgccacacctggctaatttttatatttttagtagagatgggtttttaccatgttggccaggctgttctcaaactcctaacctcaggtgatctacctgcctcagcctcccaaagtactggcattacagggatgagccaccgtgcctagcctaattgtacattttaaatgcatataatttattgtatgtcaaatatacctcaaaaaagctgtttcagattgttagctagaaaataatgtaaacaaaaaaccctaataagtggctatagtcatttaaacactaaatgaaaaatcatctctccatagctttatcgtagatagactaacattataaaactgtcctagctgaccagtgtcaatatcagtaatgacagacaaattctagcttcacttttctgtgtgtctcttttcaagacttctaaaagaattcattaataagtatggcatgatggaatttcagagctatgaagggtcttaggacatacctgaattcatcacttcatttcataggtgtagacacttaggtgagatgaagaggccgtggacactatttgtattatgattcatatatattttttctttgttttttttctagacagttctagaaggtagaacatctgcttgaaacagctggggtttttttgcctatagtagttgttcgataatgttttggtttgatagaaatgaatacattattgccatagataattgaaattcctgctcccacccaaaagacagaatttcttacttcctgattattttttgctactgatgcttacacagagcttacttctctttgctctcgttcgtgctgctacaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtaggacattttcagcacgtcaaacttactctaataacttgggagccatgttttagttcacagacgctacacgatacaggggcacttattcaaccgacaacatcttctttttctcttctcctaatggctaacttctgtagctgtcataggatcattggttctatttggccctgcctccttttggttctcctctcctccttggaagagcccatctcctgcacagcagtgcctcagctctgggtttaccatcttttagaatgagtccttgctggtggacaccatcgtacactagagagttcttccctaccctggaagttactggtaacttacactattcctttagccaagtagtcaggtaagatgctgcactccaaaattttggtcaatagatgtcactacatgggtcagttggcatggtcctgtctctcctgaaagagtgacacctgttgcctacttgcaggtcttatccttcttgtactgttgttagtgttttatttttttctcctaataccgtatgttggatcctaaaaacaatcacagccattctctctaacgttcggttgttaatctcttattcaccttttcccttggtttattttttgtctattgaagatgcagtggaaaatccgcacaccggcagtgctgtctccaagaatgttcactttcctttcttacttactctgttgtcctgaccacaatgatttcttgctgcttctttaggcacaagttttccagctggttctgctccatttgtacatcatgcaacacagataatcagcttctttccttaacaaaatagggattatccatttcagaatagagtaactggcttacagaaaccaaatgaagggagatcaatgtaggtttgatgaaacaggccattttgacatttaagtttacgctgggatccacacaatcttcgcatcccattgtcttcttctctgcccctgtcaggatatggtgtaaattacatgcatagctgtgatttggttttttccttccctggtatttccaatttgttatagctggatccgttaccagtatggctagtgttctttggcatagtgaataatccctactcacatttctagaagctgagaaagttgactcaggcattctttgttttggatgaatgagaaaatacccagcttagtgtttatatataatagttctggcactagaaacgagatgccaattctgagtccttctctgttcttcagaagttaaatcgtttttttcattgctagcaagtgctttaaaaactttgttttctttcttgtcatttttgtatttttcactaatctcacatggcaagaatggcaaatcccaagcctctattcactgcataaggagcaagagagagggaaattggctaagttaccatggtttctcctcttcatcttcattaagctggaattaaattatagccttcagatgtaaataggcaaccagtccattgtctagctttaaacatagcactcagatcaagcaagatgtcctggttgcttttagccaataaaaaggcattcctgattaaacacattggataccctttttgtaatgttgctattttgtaactgaatcaggtttctgctatctgaactcagattttatgttcatttattccgtttggggatagcaggagtaggtgtcttagaatcaaagtatgttaatgtttctagctaccgcatcttactctatttaacatcccaacatttgctggaaactgaggagtacaagaaacaaggaggacccaaatttatgtacaaaagttatctcttatgcatgaagcatttattcagagatacttaatttatttattcagagatactttatttattcagagatactttcgtattcttaaaaacaaacaaatatagatgtcagcaatatgccagatattagatcacaggattagatccccaattcccaggccccactctgtcactgatatgtctaagatcaaggaaagtggctttatttctcatccattatatgggtggggacaaggatcaatcacaagggttgaagtggtaatctttaacattcatttcatctaacatttttcacgagataatttccaggaaacatgttccaattgcttttctcagtgtcttgggcactgtagctcatgcagtacattttggggaatgcagatggatcatggacttactttcaacatcagggaacatttaagaacagcatggatttggtccacactccttagagtcatggttcttgggcgctgcattggaaaaatcagtgaaagtcctgttctgtttgcaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggaggtaagataaacatttgggtacggaatatgatatagatgaggtcctagattataagattataaaacatcttgtccatgctttaaaaaacaataaaaatactgtctattcctgctaatgctgccaaccctgattaccttgaatacatcaagaatacatcataacctcaggtttcatagtaagaaatgaaagtacaaaacgagatgatctctaaagtcctttcttattttaaaatactataattttatgttgtttatcaatttttacaaacacattttgtgaagggtatatttatattgacaatcagactagggaaaaaaacataaataaggtgaaaccatagatatcttatcaatagtatcgctaaaagatttaaattgaactcagctatcaacatgcctgaattttcttccaaatccacaagaaagttcaatttcataaaaaatcctagtcatcaatccatatgctttaaggtaatcaatgggaggaatccaaagctagattaagtcatagaattttgcttacatgcaaacatgttaactttttatggcctccatctaagccaatacattaaaagaaagcaaagatcctctatattgtcagcctgttgaaccataaggaaatagtacagcaggatgatggcatccgattagccaagggttcaaatccttactctccactgctggcagggtgatcttgggaagaggatgtaacctctcaaacccctcatttcctcccctgcaaagtgaagataataataactacctccctcatagcattattgtgaggtgcttatcattagagtacatgatatagcaaggctcagaaatgtatgagcgcatgggggtgggcggggtgtctgtagacacagatataatttctatacttcactggaacacatcactattttatctggggaatatgggataattttgctgtttgtttttagtagtgcatgcttctgtggagggcagattttctgcaactaaaccacaactttaccagtctaatatcagagtcaaaaattaaaataagccatgaggatttttccatcccaaaattcatagtccaggctccttcctccttctcctttgtctttcataaaaaaaaaaaaggaagcacattagaagctacaacatacagtaatagaggtaacaacccataaaaagcctggaaagggatgctgtgaggctgggtaagaggatcagaaaggggcactggagacaagtggtaggtttaggagcagcagtccgtggcaaacctcagaaacctccctgcaacacagcatggtggtggccatggggcatcagctgatgagttaaatcatactccacatacgtgagcttagaaagcaggaactgtggaatacctcatacattttagaaatagttgtataaacccatatgatggaagatttagaagttttgcctctgcatgggttaacttcccactgaaactctaattcattcttgggaactaagccactcgaatagaaaagggaaagaaatcatttgtttagcttctactttatgccaagagctttatgtaaagagatccaaaagcatgaagttgttcagaatggatgtaagcatagggagatctgtgctgcagaaacatctgtatttacaatgtagcttattacccatgttgtatttaagtatttagccaaattaatctctttaatattagtcctgccagtattctttcctaacatgtcattgtggctgcttactttttatcagaagcgtttgaaatttctatgtaccattgatgagattctgcagtcgatgccttaaccagagttgacattcaaatacaatttattcaaaattctctggtcatttattttatatgtgaagaaaccagggacagacattatgcggtgtcagggacttccctgtagataacagaagaagaatatgagaactgtctttttccaaatctctgatcttctttatagcttcttgacttattcaaaatatacttatattttccctgtttagccaacctcccacattcatatctcagtgtgtttatgtgctgaaccagtgagataggaaatctatagagtctgtgttccctggagtattgatattccctcttcattccacaggaacaagttcaagatgaagctcagcaccatcacactcagcattttctagaaaaaaaaatgttttttttcccctaggaaaaaaaagaaactcatcaatatacatcattagatttatatttagctaaagaaagatagtgtggattttcattacttttttccacaaatatgcatagcaggtttattctataaaaagttaagtagctaaaatatgtatcagagagcaattctgagaacacagaggatcaaatgagggtcactcacaaatctgctgcccagagacagctattgtttacttccagtctctttttttcctgtttgtttatttatttatttgagacggagttttgctcttgtcacccaggctggagtgcagtgacacaatctcggctcactgcaacctccatctcccatgttcaggcgattctcctgtctcagcctcccgatagctagaactacaggcgtgcaccactatgcccagctaattttgtgtttttagtagagacggggtttcaccatgttggccaggctgatcttgaacttctgacctcaggtgatccacttgccttggcctcccaaagtgctgggattacagacgtgagccactgtgcctggccttttctgttttatttttaataaaattaaatcttactatactgctaatttggaattctaatttttttttagaatatgtttccatgtcatgaaatatttttatatttttattagctgtataggattacattttatgtcggccataatttagttatggataaacactgaagttttcttccttggccgctgaggaaacagagttaggaatttgagtgcaactccttctgcttctccttctcatttctatagcataaaaactctcaaaactggccaggcgcggtggctcatgcctgtaatcccagcactttgggaggccgaggcgcgtggatcacatgaggccaagaattcaagaccagcctggccaacatggcaaaacactgtctctactaaaaatgcaaaaattagcctgccatggtagcacacgcctgtaatcccagctactctgcaggctgaggcacaagaattgattgtacctgggaggcagaggttgaagtgagccgagttcatgccaccgcactccagcctggttgacagagcaagactctgtctccaaaaacaacaacaacaacaaaataactcccaaaagacacaaagaaataacagagcagtgatggctaccatgagttctgaacccttcctggctgtttctaagcagcccagatgcaaaatgtccaacaatacagtctcctatcagaaaaaaaaaaaaagtaacatttaggacagatgattaggaatgaatcatgaaaacttggcttaattttttcaatattattttgctacaaaacgtaaagaaaaacaaccctgtcttttactccctctgtcatacacaaatagaagtactagattgggtgctaggagcattcttcctttgtcaaatccaatgagactccgagtgctgggattatctttgctgctttatctgtgggtgccaacgccaccgtagatggcatttgcccattgcaaggctttatcagtgttagacactgctgtaggagacaggaagcagttccagggctaatggcaatgaaacgagggtcagtatttctttttcacccactgttgctttgggtgggttttatcacttgtgtttattttattattactgagtgatagggaggggagcaaataagagagttgatgctttgcttccgaaatctatggagcctcagcattgtattgaaatgtcactccccgctgtgtttcatgagcctcccagcgctttgttcctcgggcagtgctgatcattacttctgcaaccataaattttgcctcctcttctacaactattttatgtcagggaagatgaagtgaccctctatttctttgtacatttcccctttccaccttccctatgattaaaaatacatcttgggtctctgcccagggttttcatagggttgctttccaaccatttttacaaagatagttgactgtttcttatatcagatatttccagagaaagaatgttcttaattaagatgccattcctgggaaataatctcaggacttcctgatgcagtttaaacttgttccatctgtcctcttccttaagggtgctaaaatgtcatattttattaaatatttgttgaaaaacccagttgcatattcacagtgatatctttcttgtggccttttctgtactacagaaaatattagtcagacttcaagaagaaaagctctggaggggaagggggcaggatggattatggtaaaatactttggaaattgctagactaagcaaatttaaacaggcttatctattgcatggctcctgggatgtatggtgaatgcccaaggggagggggagaacatgagcatttcccaatcttatttgacacaggatcttgttgcccaagcacctactgtattttctaccattctaggaaatgcagtttgagaaatgcttaatcttttggtaggaacccaaaggactaagacaaaatcatagacttgggatttgcctttctttatcagcaccacattgcagctgataggggaaaaggatttttcttctgcctgtacctcttggtaagttaggaatagtagaggggaacgggagggaacctgggccaggagtgagcacataggggtggggagggggagtgtaggtgccatgggcagtgctcaccactgaggcactcaatgatttgaaaagcattggttaaacaaacgaaaatcaactgagttctcctgaaaagccaataagcatctggaagtctgtactaaggaattgctatcttcatttccattcttagagacacctacattgatgctttcaactctatatgaaagtcaggaagcatggcagggaggaagggaggggaaaagcagggcctacatggagagtctttactaggagagaccagcttcatggaaatgacattatgcccagaaatagatggtgtttttaaaaatacacataagtagagctttaagttaaatcttaatgaaagaaccaaatcagaaaaagcagactggtttcttttaaaaagagaggttccggagcccctgctgtggcctccaagaatctagggtgttttaggccacctacatgggttctgcagagtcaggagtttgcatgcatccatctctaccctgttagatgtacaatgtggctccccccagcaaggcctactcacctgccagtggatgccgatcagcactggaaatgaattcttgccacagtgatttatcctgtggaaccctaaactaaatgggaaataggcagccacagtattccccaataaaaggaaggaagcccagtgaaatgtcatattggcaccaaagaaagatactgggtttacttgaatatgcaaaactttggccaagaatataccagatttatttaaccacttcctcaagttatttttctgggctgaggcaaggaaaaaataaataccatttttcaagtacagttacacaagtaggtaagtatgagatatttgaggtagagcttttcattctctgattacagattattttaaatgtggctattaaaaatcaatttccttttttgatatgcagcactcttcgtatctacctatccatatgtctcacatatatatgcctctggccagtggagaaactgaattacaatgaaaaattatcttaaagatgccaaggcaggccttggctccctaatgctgagccctttgcactttggcagagaatttttgtcagaactgtcccaggtattcaaatgccattcttctgcattgttctataactccagctacagaatgaacacctgccaccacatgacccaattagacatcctagaaaggggtatccaatcttttggcttccttgggccacattggaagaataagaattgtcttgagccacaaataaaatatactaacactaacgatagctgatgagctataaaaataaataaataaataaataaaatttaaaaaataaaaataaaaaaagtttgtgcataattctcatgttttaggaaagtttacaaattcgtgttgggccacattcaaagccatcctgggccacatgtggcctgtgggccatgggttgggcatgcttatcctagaagtatctagtttgttatatgaaattgctaggaatgaagcatccatttcaaatagcctgctaactttagccttgctcaaggcatttagtccttttgtaatctcttttttgtcttatctgatttaatttgaacaaaccttactttacacttttcatatttttgttgcattttgttcaagaacattatattgcattattattgtatattgtaatttcttaaaggtaaaggcagcctctaactgcaaataaaacatctcaaataagacgtttcaaaaaataagaccaaataaggcagcatgttaggatctggcatcatatgtccctaatagtgtctagatttgttaatattggtaattcaagatagagttaagtaatgatatttatccagctaatggataaatcttcagcaggctccgattttgttgtatcatttaggtgacatctacataatccgatagcagatggctgatgagagcatctcagatagcttgcctgtgacaaacaagacaatatgtggattcagctaggtcaggattgtgtagaatcagccctagaagctgagaccaagacattgctgcataaacaggaggaaaaccactggtattctagcaggaggtctccaggggctgctggaccctccatagtcttaatgataaagcctgccttgtacacttaagcacatgactttttatggaagatgcatacccaagaatttaagtagtgaatttttttcccctcaattactgttggcaatcgaatgtacagttgtcttgttctccctctgccctagtttcctagaactactgtaacaaataaccacagactgggtggtttaaaacagcagagatttatggaggctagaagcctgagactaagtggtgggcagggccatgccctctctgaaggctctcgggaagaatccttccttgcctctttctggcttctggtggcttcagacagtccttggcattccttggcttgaagatgcaccactccagtctctgcctctgttgtcacatggccttcttccctgtgactccatgttctctcccttcttatagcgacactagtgattggatttagggcccaccctgatctagtaggatctcatttcagtcctcttctaaaacctaagcaaagaccctgtttataaataacatcacgttctgaagttctaggtagacaggagttttggtggacactattcaacctactccaccctcttaattctgcttttaatttttattttttattctttatgagacagagtcttgctctgtcgcccaggctgcagtgcagtggcatgatctcagcttactgcaacctccacttgccaggttcaagcaattctcctgcctcagcctcccgagtagctgggattacaggtgtgcaccaccacacggggccaatttgtgtgtgtgtgtgtttgtgtgtgtgtgtgtgtgtgtgtgtgtgtgtgtatttttagtaaagataggatttcaccatgttgaccaggctgatcttaaattcttgacctcaaatgatccacccacctcagcctcccaaagtactgggattacaggcatgagccaccgtgaccggcctccgctttattttcttagtactccttccattcatcattcttcaataactattttaaagcttattaagaataaattttgttaggaatgcctatcaggcatatgagttatataaagtgctatattatttaactaaaccattaactttctgataaaatgacaaagaaatcattttttgcactaagatattcctaaattcatctttttatagaaaagttgaaagcccatctaagtatctaccagtggggaatagtttgatatagaaaatcaatgtgacatttcccatttactaaaaataattttcagaactatgccgatataatatatgcatcaatgaaaatgcaggttatataacttctaataaaccatggaaaatatgtattcatgtgcaaaaatgacacaaaaatatacaaaaatgcttggttaggatagatggatcatttaatatcttgctttattgattctttaatgtcttgctttattgattctgtaacttgttttaagtaattaaagtattatctgttattcctatggaaaagactaccagttactcctcaaaaatgccatatactctcttcaggcccccagactgattatatgttattaaaaattagcgagtatttgtttcctaaccacccagtcctgtgtgttatcactgaaatgtgccattgggattggatgcttggcaaaacatatctgaagtgagaatgtacagagaagcatagaccaagtatatctcctccaaagaagggcagaaaagtttaatggatacaagttaaacctcactctgcctcataatggtgtggacaagtggcaagaagaggcatttgggagtcaggcacaaagagttgtgctaaaagtctaggttggtcaaattgtgtcttcatgtgctgaaggaccttaatcatgcccacttcatggcatcctgatgacgatgagaaagccatgtggttctcctaacacagcatcacctcatggttgaccagtgaccacagggcagaaggatgctgagtagaaagacatgaattggcatcagaggagtcttctgaacattgcatttcctctctaagcaatggaggtagaccctgtgtctcctccagacactactgactgaagagagatgtcagcaccatcagcaccactaaaagtaatgttgggagccaaagtattgccatgagaatcaccgaattgttgtgaagagagatagcagcagtatgaatgcagagatcgagttgccacctcctgcaagcacctctaaaagtaatgttgggagccaaagtattgccatgagaatcaccgaattgctgtgaagagagatagcagcagtatgaatgcagagatggagttgccacctcctgcaagctgccacctcctgagcctacttgaggaacttagcgtcacaaatgggacaaccagcctttatgtccctcaatgtgatgcatataaagtcacagcacctcctagaagtatccttaaagaaagatgtcaagagggattgctttagactaaaattgacttaagagacataattatcagagacatagtgtgaaatctggtaccttgattcaagcaatgtaactataaataggggaaatattaagatgggctgtgtattatatcatagtaaagaattacgccaattttgttggatatagcattgggatggttggctccaaattaaatttagagctgcagagacaagttattaggaattaaatgttctgatatatggaattcaccttaaaatatttcaatagagaggaaagagaaaaaatgaaaggaatataaaggaaatgtggcaaacaaatgtttataattgttgggttatcatcataaatatatgaggggttattgtactgttctctccacttttgtgtatacttgaaatgttttgtaacaaagagtttaaaatatataaataaattcctagaatattaacttgccaaaaataattgtctgtgatttttttttcctgagcaagatttaagaactaatttttccacagctgttgttgagaggcaaagagttcttagggatcatgggtgataaaaacagaccttctcacatgccactggtgggagaataaattgatgcaatttcggtggagtgcaatttggcaataactaccataggacaaatactcttacccatcattctaacttctaagaatctattctgtaaatatatgtagaggtatgctacgaaatgttcaaagacattcactacaatactttaatagcaaagaactggaaggacaagctgtctaccaataggaactggttaaagaaattatcaccattcagagaatggaaagtttaagcaacccttataattaatgtattagagctatattgccaatatgagaatgtttcccaagatatttgacattaaaaaatggtgcagaaaactatgaacccatttggagttttaaaaaatatcagaaaggatacaagaaatggataataatagttaccttctgggcgtaggattggcaggagagaaagttttcacttttcattttatatatttgaatgtttaccatgtgcagatgttattttattttatttgtttattattatttttttctgagacggagtctcactctgtcacccagcctggagtacattggcacgatctctgctcactgcaacctccgcctcctgggttcaagtgactctcctgcctcagcttctcaagtagctgagattacaggcatgcgccaccaagcccagctaatttttgtatttttagtaaagacggggtttcaccatgttgcctaggctggtcttgaactcgtgacctcaggtgatccacccttctcgtgttcccaaagtactgggattaccggcgtgagctactgcgtccggccaaccatgtgcaaatgttattttctgttataaaaaggaaaagaaaaaaaaattgaaacctagagaattatgtgccccgtgtactgagaatgttatcttaagaattatcctaagattgtaattaggaaggcgattctgttagggaaaactttataaacttacacagtatttaaaatgtataaattatggatggtttcaagttaacaagaataattttgccttctatagtatgagtaaattgtgcacgattatatgaaactctgaaagtacttggaaatcttcaaatggcattaatataaaatattaaattctactatcttttaagttcaagttatacctgagaaaacactagagaaagatttcattttgtctaccatggaaccaaaattggctttgaatatgtattatccttctgtatcgaaaaataagacctacctgcctcaggtactttttgtgttcatcatctcattgaattatcatgattattctgcagggcaggtggtatccaccctaatttccagataaagaaactgaggctggggacattaatcaacttgctgaaagtcacacacaagtgaagaaacagtctagaacccacacacttcactcagtttgtcctgacactttgcctccttcatatcaggaaaaactttgtatcaggaaaaactaaataaaaaaatcatctggtctttggcccttgcttttaactcctttcttgttttctgcaactagctgtgccttcctcagtgtgtcttatgtcctaggaaaagattattaacagaaagcacaacaggtatccaggattgtagtttattaagcagagttttaatgaatattttcagtaaaacagagaattaacggctcattgggtttttttttcccctagatatcgtggatgctttatcagatccaaagaaatttctctcaattacagaaaagagagcagaccaaatgagagctatgggcattgaaactgtaagtagaaatggttgattaaaggtggccaagttgtgggagtttgattatcaaacagtgtttacaaaaacaagacaaagtaatgaattagcaaatttaaggagggtttttaaaactgagctcatcaattcaacaatagttaactttctacaaaagtgtggcatgtttaataaaatgtgactgccatcagaaaaatccacttcatcatcagtggcttaactcacatctggggaccccttccccattagaaagaaaatgcaaaacatttgttatacttttgggaaagtttaaaatgtaggtggagcatttctaatcagaaaaatgcaacatccgaaaagttccaaaattcaaaaccttttgagtgctgacattggatagtcatacctttgctttttgaagtttcactgtacataaactttctttcatgaacaaaattactaaaaatattgtataaaattaccttcaggctgtgtataagttgtatataaaacataaatgaattttctgtttagacttgggtcccatccccaggatacctcattatgtatatgtaaatgttccaaaatctgatatccaaaacatttctggtctcaagcatttcagataagggatattcaaactgtactgtacaggatgtttctatgatacactgaaataccagttaacctagttcagtgaattaatgataattgctttttatttttaattatttattttttaacagataggatctcgctctgtttcccaggctggagtgcagtagtgtgatcatagctgactataaacttaaacttctgggctcaagccatccttccacctcagcctcctcagcagttgggactacagatgcatgccactgtgcctggctaatttttttactttttttgtcaagacagggtctcactctgttgcctaggttggtgtcaaactcttggcctcaagcaatcctcccaccttgacctgccaaagcattgaaattactggcgtgagccaccatgcccagccaaaatggcgtttattattgatttttcactgtttgccagccttacatcccaaccttctcccattccagtgcacacgtggattgtttctttgtttttaaatgttctctttaccagactcctcagtttggaatggatgtagcatctctccaatagctagaaaaagagaaagtattctctgcttgttaagaagttggatcttctttccttggctggatcctttgcctttaagagagtagaagtctaggaagagtatggtagaagtttactggattcagtaaaataaagaatgtacaagatatttgaccttgagtgacattcatttgggtcaatgtaaatgtttctgttccagagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtgagagagagccgttgggttccttatcttctgcacccaccttaattacacagtgtacaatatctatagctttaggaaatatataaattcgaagttctttgtgggaaagaaccttttacatagtgatgttaactaattcatccccactctcttccagaccctcccataggtagttacctggacaggccgtgggctcatgaaccaacatagttattcctattggacatttctaaattctcatactgataattttccctcataagtagaaacatgattatttgtttgtaaaattatcaaatgagcacttgaaggccaattccatgtgcttacctgtagatgaaacaaaagatcattaagaggtggcatcacaaagaatcacgtgtctcatattcagccagtatgtagggaaacaactgtgctggttattttaattggtttccatatgaattggccagacatccattgattggatggtgcccattccatactggagggaaagtgggcagggagaatgctgatagggagtggcaaggagttcatttttcttgttctggaaagaattctggggtcatcctgagaaggtcatgggaaatgagtcaaaggagtatttgaagaaaattatagtcttggcagaagaattcattgaaagtgggcatgctaagggcaaggtaagaattatgatactcatgcttctgttataacacacctatcacattgtgttaataaagtattaacaaccagagaaagaggtcattgcagatgagaccacacctcatcatcagtgtgtccctggaaccatgcctagttaaaatctagtagtctattttctcaggaagtaaagcgctgtttaatgaatgataggggcaaggaaatctagattaagttggaaattgtcaaaaggaaggaagaatagaaataagttggcagcttgaggccaggtgcagtggctcatgcctgtaatcccagcactttgagaggccgaagcgggcagatcatgaggtcaggagatcgagaccatcctggctaacatgttgaaaccccgtctctactaaaaatacaaaaaattagccaggcatggtggcgagcccctgtagtcccagctgctcaggaggctgaggcaggagaatggcgtgagcccgggaggcggagcttgcagtgagctgagatagcgccactgcagtccggcctgggtgaaagagggagactatatcttaaaaaaaaaaaaaaaaaagaaagaaagaaataagttggcagctttgatatgggccttaggcagaaaggggctttttggtaactcagacttcaaggacagatcccagagatagattgtaccattgagagaagtagaggagttaggaggaggagctgcttttggtaaggaagatgattttggttctgtatatcactgaggacaagctgttgctgatacatctgggcagaaatatgcaattaccaaatctatatcaggtggagaagaagaaggagggacagagaaacagaataagaatacttagaaggcagaatgaatggggaaaaaagagaaaagagagatctatgttctaagaagaattagttttgagaagatgctgtagacaagtccagagaagtgaagactacaaaattatagttgaaccaggggtgattggatgatgaaggtagaaacatggttaaaaaaatgtgagacataatttaagacataaaatggttgttctggaggacagtagcatgttggtaggaactaataaagaaaaacaaggaaaatgcaaaagagagtacatggtaaaacaaggctataaggaagatctgaatcaacagaaagggtgaaattcagctggataaggaaggaagagatatgttctgtctgagctaagaagaatgatgagtgaatagaagtttcaggatagacaggaagaattcttgacagacggtgtatcagtcagcttatgctgcataacaaatgacctcaaattttagtagcttaagacaaccaccatttattgagatcatgtttcattgggttggttggtctaagctggcttggctaatctctgtgtcttgcttatgcacctgtgatcagctgataggttgactggaaggtagatgtgggatgaccttatgcacacatctgtcatttggcaagttgtttcacattatcctgaagcctgagcaggcttgttcatatggtactccctgagtttaaagagcagcccttttccagcctctgctagtctcccattggctacagcaggtcacaaagtgaaccaatattcaaggggtagagaaatagactctacctcttgattagaggagaaagaaatagtggtcatttttgtagtataacacagatagattttatctgatctaagaagttggttaggtggctgctctctgctgagaaacgtagaggtagaactgaaaaacagcagtatagaaaagctttggagttgcccctggctggaatagaatgatccacaggaaataaggagaaggtctgccacatagcacacaggaccctggtgagggttggtggtgtgtactaagttgatgtagcttgatctcattacttcttcagcagtgcccagaaactcagcaacaactgtggacaaagtacagcttagggagttgcaagcctgaaattatcacaatttatatggtctgggaccaaaagtttgaagaccattaagttatgacactgtaacagttggctattgatgtgtaacaagcaatcacaaaagtcagtaatttaaataagtaagcatctattatagctcatgaggttgtctgggtggcttttctggttatgggaggattagtatcagtgactcagctgatcttagctatgcttattcaaatgtttggggttcagctaaagtgtcattggctgggacaagtgggctgtcttccttgtggactctcatctttcatcagcttagcctgggcttgttcacatggtagttgcagtgttctaaaatggaggtgaaagtacagatgctccttgacttatgacagagttacatcctcataagctgaacatatcattaagtcaaaaatgtgtttaatatctaagctaccgaacatcatagcttagcttagtctagcctattttaaatgtgctcagaacacctacattagtctacagttgggcaaaatcatctaacacaaagcctattttataataaagtgttaaatatttcgtgtaacttattaaatgcagtacagtgtagagtatacagctgattgggagctgaggcttgctgcagccccagcgcatatccctagcttaggaaaagatcaaaattcacaattcaacatatgctctctactgaatgcatatcacttttgcttcatcacaaagttgaaccactgtaagttgaaccatctgtatgtcaggttccttgatgagtcctagacttagaactggcatggcatcctttccactacattctgtcatcccaagcaagtcacatggcccagctcagattcaagagttggggaaacagattccacatattgatgggagaaattccaaagtcacatgtaagtaggtgtggaaacagggaggggtggaattttttggccatttttgcactcagtctgccaccctgatcataatatataggttaatgttccagtggggtagatactagaggagagagacttttctaggaaaggaaaaggttaaagggaaccaggaacaagatgaaagtaaaaagcttgcttggtaggtgtgagggagtgagtgaagttggcaggatggagattgcagtcagaaagaggttactctaagctacttgtcttggaggaagggcagtttcaagcagtgttaacatcccgtttacaactgtcagtgggaggtgaggtaaagtagagatgaagatttctagaatggaaggcatcatgaaaacagaaagaaaagtcactcagcacattcttctcatgcatattgaatcactgtgttggacgtctgggaatgcctgcataggaaaaccacaattcagatatgaagttcatggggccgggcagtgtgtgacctaaaaggacacatgtggaggtagttaggctcagcagagcctggtgtaagtgagaggtctgttcttttgtatgatagtttttaggagaatggcatggaagtacaagagagaagtctataggtgttcttcccacgcctctccatggattggggtggggtggggaataaactctactccaggagcctttgggggaagtgatgtcatttgagaaagcaagcctccatttctttccagaaaactgtcttaatttgagtcaccccaaagaccctgagagaaggcttccagtgcaagtagtttattctgggaggcagtggacatggatagagatgtgaagaagtgacaccagggagggaaggcagccagtaattagaatgttttaaagccagttgccagtaggcacctggaacttaatgccctggagaaactctgggggctggtattggacatacttctcagaggtctcctcttagagggatgagggagctggggaatgtataccctgactcctgtcagccttttcttgagggttcccgtggaagggataaattctcggcattcagacgctggcaattggaagtgaactagaagagctgatgtagagagggcatagtgtgtggctggagcagacggcatttgctgcagacctctatgaaggtggggaggtgtgaaattccaaactgtttttcttagacattcagccaaacagcaacaactgcaccaacacgacttttttttttttttctgattttaagaacaaaggattaagaacacccagctcctaacttccagattagcaattaagagaaaacaagttattgttaaggaactatgctgatatgaacaaaaactttatgtagtgaaacttcaattagctaaaacccaaaatgtgctgcctaacctactttcataccagggaagcctgtagacctgcacagtcctatatagtagccactaaccacatggggctaccactaaccacatagggctatttgaatttatttaacaattaacttaaaagttaaaccttgagttcctcattcacactagccacatttcaggtgctcaagagccacagatggctagaggccgtcagttggacagacccacgcatggaacattcccattattgtgcaaagctctatgaggaaggctgttcttggcacgcagatggaactgtcctcttctgtagagtgtggtttttttttttctaactaaatcacttatgggaatcaacatttttacaaattgtgtctttcccccaaaacacaaaaccaggtagttgagggaagtttatgtttttgtaggttccttttaatcaagacttagttgaaccaagacaaaaagaaaataaaaattgagagagagagtgtaagtttcatcagactgggtcaaactcagaatttgctagatctctggaggaccttgcatactccccaaatcctgtatgttcattttacagatgagagagctgaggcctaaagacagggagctctttgtgtgccaggagtcactcccttgccttaccctgcctcagtcactagagagacagcttgtgaaagccaacttaggagatcagtagagagccccatggaccctttataccccgatcataaaatgttacagatcacaaggctgatttccctcagccaaaactttccttctgcggcctgaccaccctatcattgaatgtgcacatcttaaaatgaataaaagggaaaaacaagagcctgggacttgatgcctatctttcttgaatatatcatacctagcctttgggattctaatggaaatcaattacagcacagagtacacattcattttgtttgcctaagatgaaaatctgcagtcaaacagaaactgtttgaggatctggctacaactgttgttgccatgacaacacctggcctagcatcactcagatagcaggatgacttagtgtattaccctagctcctcctggtatgctcctgttatacactggtttgattttattatttcctgtatgtttaaggcattgctgtgctcaatagcacattgcttaaatgctaagattgaatttggtaaaagggagaagccagaaaaaaatgttttattctttcacaatgactgaattgagaatagagttgggaattagttgactggcatgatatgccttgaaatacaaaggtaagaataaggataatagatacttttgtgcctgatcagctcccctttatgggttcactatcccatctcacagctcctatgaattttggctgattgggcatttcagctgcccttctccatagaattgccctgggaccatgagagttcccttgcctgaaaggttttgtgaaacctctgtagcactcagctgattgatccagggttacaaatgcccagcctctttttgccaaggtggaatgactcttgggtgccatttgtactgaagagctccctgcaggatcagactgaggctggatttctactggaaacacaccctaccttgttcctctgccctgctccacttctttcattcccttaggggtttctcctgagagtctgccctcaatcaatcacttgcacatgaatccccttctcaggctctgcttgtaggaaacctgacctaagttaagacattcaacatttcaattgtccagttaattgctttgtaataggaacttaagatgtttatattcatcatatgtaaagctgcttcaaagtctttcgatgagatttcgatatgtcagttctatattaccagttattctctctgatttttagtatacatagtgacttaattttttttgtttgtttaggtattgaacttatccctcaagtaaggatagaagacttaaagcagatgaaggtaaaattgcttgactattttgcaagcactcttgtattacacatattggtgacaccaatatatttttgtttctcaccaagtgtaatcattgtgattacaaaaagaaaaaacaaaaaacctatttttgattctatttttctcccaaaggcttacttgaagcatttaaagaaacagcagaaggagctaaattctttaaagaagaaacatgcaaaggtacagtgctctacagctactattttgtgttatgtatggatgaatcatttgtagccaaaaacactactttgaagctgataccagaccacttaacagtaataactcattctaactggttaacaatgaaattaaaaaatagaatcggtttgggagtgcttgtcacttgtttgtagtctgcatttctaacaattctttcaaatgcataacaaagcttcatccatttaaaaattgtttcactaggccgggcacagtggctcacgcctgtaatcccagcactttgggaggccaaggtgggtagaataggatgtcaggagtttgagaccagcctgaccaacatggtaaaacctgtctctactaaaaatacaaaaattagctgggtgtggtgacatacccctgtaatcccagctactcaggaggctgaggcaggagaatcgctttaacccgggaggcagaggttgcagtgagctgagatcgtgccattgcattccagtgtaggtgatagagtaagactccatctcaaaaaaaaagaaaaattatttcactaataacatgactatataaaatattgaagaccagctcacaattctagccactagttacctaaattgccaggtcactgtcacatagtttgccatacacactggtgcatggagggagatgctagcaatctgtcaacctcccactcacagcacctagagagagaacacttgtcactttttctcccttatgtaaatcttgcccagtagcctacttctgaaatagatttatttttgctttttacccataagaagtggtattttgacagtgattgtgaaaaattacaagagctagttgcaaattgtaagagaacagcaggaggtggccccaggaattctcctgtgggttgaaaaacgtcatggccctcaaacatcgtcacttccagactccctcacaggtaaagaagaaaaaggtagtacctctttccttcctaagaacatataataaccagctgctgctggtaggataatgtctgtcctcttttattaagggcaatgagagcaagagaaacttaatttataatttattaatttgaaagaacttctgagttcttttaaactaatcttgcattcctgtttctttattctctgacccaagcctcaaaccaaggcatgtccttcagaacttggcttgagtgatgtaccttttaatcattccacgtattgagatgccgagaacattgtctggaaccctgtcccctgtcatttctttaagagtttgtgctaacactgattttttgagaagtcatttctttaagagtttatcctaacactgattttttttagaagttaggcctaatcttatcctagtaatgttccctgtattacagaactgttgggctcaatggatttgctgatacagtcacttcacttcaaagactgtttctaagtttcatgaataattccattcagtgaaattccttacattgctcaatggggttattggagacagaacaatttaaagtaggggcttcaatgttgttggttattgacaacaggctgaactatggaaagccaacagaaaaagagtaagaatgagaaataagagagaaagcaccttaaatgactttaattatttggaatagagtggatgcccgtatgctgcagcactatctaacagatttttcttgcatttaaattggatctcttttattgagcagacacctcagtggcctttgggctagttggaaacataaagattttggcttcatttaatattttcttgaggcatggccagaaaatatgctgtggcgggtggtaataatagcagcaataatagcagctagaattcctgcatgctcagtaattctcagatgctgtgctcagcaccttatatgcattgtctcatttaagactctaccctgtaaggtaaattctatgtgagtctccatttatatgtgagggaattaggaattagtgaagttatctgatgtcccagagttaggaagcagcatagctgatatttgaaccaaaatcaagagtccagaatccatagtcttgcaccatactcctgtgtaggatatgggatgctcactaagtggacaagttccctcattgggtcaaatgcagtgacagcacatgggacattagggaaaatcactatcaactttgggcagtgttgatatactgctgattatcaggactgtgactaaggaaggatgcccctcaatttttagaacttaacctacatcagagttgtccattaactccctggagccatcatgcccggcccaagctaacttctaagatgaagaatataatgaatatttacttgcctaatatacaccgatgccagctctgttaacatattgtctttaggcgagacatggtggctcatgcatgtaatcccagcactttgggaggccaaggcaagcagatctcacctgaagtcaggagtttaagaccagcctggccaacatggcaaaaccctgtctctagtaaaaatacaaaagttagccaggcatggtggcaggtgcctgtaatcccagctacttgggaggctgaggcaggagaatcacttgaacccaggaggcggaggttgcagtgagctgagattgtgccactgcactccagcctgggtgacaagagcaagactctgtctcaaaaacaaaacagaacaaacaacaacaacaacaacaaaaacatgttgtctttaaaaccaaaaaatgaaaaactgtttaaggagaggggaacaatgtggtgaatctattaccattggacatacttcatgcctgatctccatatgacgtgtttatcctaacactgatttttctgtcagtcaacacttttaaagtggcaatactagcttgtacatattgatacttgcttaagcacatattcttaggtattctcataacagttatataaaggagtactataattatatgagttttgtatctgttagcttttgcagggtaacaaaccaccctaaaatgtagtgacttaaaacaatgaccatttatttggctcacaattttgtgcatcagtagttggagctgggtttagctggatggttcttctggtctcagctgtattcactcatgaatctgctgttactaccagtttggttggcagatgggggactggctgatttaggtcagcctctgttaaaccacttcctctctgctttatgtggtctcctgtcttccagcaggctagtccaggcttgttcacatggctggggtcctgagagaccaagcagatcaagcatagtttcttgtggccccagctcagaactaacacaccatcacttccacctcattttttggccaaagtaggtcctaagtctggccttatgaggtctctaccttttgacaggtgacaaagttacatcagaagtgggagtggatgcagaaagggaaataactgtggccatttttatagcctaccggctattcaacagattagcttattaatacttaaaaaaacacagcttcattaaatcatctagtttttaagtggtggagtcaggatttgaaccaaattcagcccggcttgagaactcagacttgtaaccactatactcagctgcctctgatgtttctcacactaatttttcttctcttcacacatctttttctttatggtctcactaacaggtttttaagagcaatcatgaacctatcagggcacaaatatcttgggttccttcaggactggtttttcaacataaggtcattgggccaagagctggaggctttacaaaaatatgtattcttatgcctatctgacacttagctatcatctctaagaaaagaatataggaaatacagaaatacattttagataaactcctctcctctgcatgctaaattttgaggactgtttttttaggaacattatgtagcactttttactatcttttgagcccttagtagaaaccccactaatcgcctgcaaagacacttatcaagcctccttaaagaaacagaggttttatcctcttgccacataatagtaagaattaattcctacatcctttctgtgaaaggacatctacagctcttttataatagttttcagccacccaacatggagctaaggcttaccaccccaaagccttatgtcataaaatgacctgctgatgaagaaatatgacctgggctgcactctccctactagtgtgcccctggcccaaacagcccttggtagctaagaacagggactattatttagtctatatccagcaactgtagggagatctcagctcttacatatcagcctagatcaagcttgtccaacctgcatgcagctcccaggccacatgcagcttaggatggctttgaatgcagcccaacacaaatttgtagactttcttaaaacatgagatttatgcacagactttttttttttttttctctcattggctatcattagtgtcagcgttttatgtgtggcccaagacaattctttttccaatgtggcccaaggaagccaaaagatttgccactgctggcctagataaataattctactttttagacttaaagagaagcagagaatctatgaactatatctcagcagtttaagaaataaatgtatggtcccaaggagagcttatttccaaacttgcaggttagctaccagatagaaaggaacagtggggtgagtgtgaggttctgccatttgcaaataggtgtgcaatttgctgttaggatattgagaagaaaagatgggggtaacgaccatttgcaccccagatggatataaaaatgctcattaaaatgtctatttttggaaaatggcaatgatcaactgcatttgaccctctgaatgtactggcaatcaaacttctacttgtctcatactttctagaaccacttcaattcgaaatggaaactagggtaatggtttttcaagtgtctattatatgagacacagaaaaaggagaattaattaacaataatcctcccccagcacatgactcattgggatccagagctgcagttactttcattaagagacaggcatgcttttcaattgtccaatgaggtcaattccttagagccaaaaatgtaaaacccaaagttggatacatatctccagtaacgtgttagaaggggaattacaattcaaatgcctatggggtccaagcaggaagtagctgagggaagttggacaggtgttgactccataaaagctgggagcactcatctctatccacaggccaagtcagtctgagctaccaccattggtgcctggagagtagatgggtcagtcgtgtcctcttaaaggagagtcaaaaaatcagaaagcttatctgaatttcctgatcttttactatcggcgtctaattcaacctctttttgaaactgcgtaggaaaaaacaaaacaaaatccaaaactaaaaactacatctgcaggcaggatacattccttaggccaccagtttgcagtatcaacattaaatgagtcaaatgaaatgcctgagaagcctactaaactctggcatttttagtaaagctactgatggaaaattttctctttgctatgcaagcaatttagccgacagcaccaagactgttgttaaactcatcaattttaattcatggtcagaccttagtaccagacctataacttagttttgcagtggaaaggggcagagacacagcagttgccctcagagtccgcctattggtaatctcagagttacatgctgagcaaacatgatttactccaatttttcagcaccctctgtggtgcgatcattcacgcccatagtcacatcagtcacaagaatgaattgcagcagcagttttccccaaaagaagctgaatttactcttaacttggataagaaacgtacacaaattcttctgaatgctatacatgtttttccccaaaatgtcccagttaagatttactttaagttaacacatttaattttggtactcttggcttgaatgaatgagaaatgtatgtctcttcaatagtgtttcatgatttaactaaggaccaaaagaataaaaccaataatggacattttttttaagctaagatggacttagagatcatttcatgcctccttcattttacagcacaatgagctgagacttgaccagagtcacatggaaatcagtaattaggatccccatttctttctgaaaggacaagtggtgtctgggaatcaagttatcccaaaacacttcagcaatcactgcctaccacacagggatggagttttgaataaaaagagaaacagagacaatttttcaggaccagctttcctgttactgacattaattatagtcactttaattcaatatgctttcagtttttcaaattatttttgcatatgtttagtaaccttgcatctcataagcaactcatgaattcggttaggcaaaggtacctaactcagttttcttttcttttcttttcttttttttttttttttttttgagatggagtcttgctctgtcatgcagtggcatgatctcgactcactgcaacctatgcctcccgggttcaagcaattctcgtccctcagcctccagagtagctgggattacaggagtgcaccaccatgcccggctaatttttgtatttttagtagagttgggtttttgccatgttagccaggctagtctcgaactcctgacctcaggtgatttatgcgcctcagcctcccaaagtcctgggattacaggcatgggctactgtgcccagccctaactcagttttctaataaagacattgaggcctgggaagatttatatatgttacacaagggcagttgtttaattattggctgagctgggaccagaatctaagtcctcttgctattttcctatgctgactttttattcatgcgataaatacttattgagcatatactttgtaccaggctttgtgccatgtactggtaaagagaaaagacctgccctgctcttgtagagcatattacatagagttgaatccatcataaacaactttgtggtacaaagagccctattcctcatatctaattggattaataaggttcaccaaaatattttcttaggaaaaaaatctgtgtcaatttacatccaagcctcaaagtctctacttgtcctgttctgcactaaaatatttaaagaaatagccttcaccctcctttcaatgatatttgcaagataatataggactgtggcacttctgatatattttgagacctgcagaaagccccttatttatttaattttttgcccaggaaaaattaacacatgggttagccaaccataatgatttctaaatcttagaaagaagactaggaggagggcattttagtaggtaccaaagtattacaagagtagttaaatacattcagggatacatcaacatgttcctctattcctggggcagtagatcaagcatggaggaaacatttattgatttaattagtctgattgatatccctatctcaagtcactctctgtgtgttatcatgggtattgaatagtatagataggtttgtatgtcactgtgttttgaataagctgtaacacacatttgatacattagattcacttttaatcctaacaaccctatgaagtaaatgtcactatcccaattataaagatgagcatactctggaaaggtaagtgactcaccccagcactgaaaaacccatgtccttaacccagtgccacattgcagaagctctggaggaaatgtgtttatagcacaaaggtgcacacacattggtaatatggctagatttatggggcattccaattacaaattaagcccagatccacagcaagcccacctagcctttgttcccactgtaagttcctatgttgggaatctccctatccagcatcacccttctccactccttctcctaaagacaagaatgctgaggccttgtgcatgaatgcgtttctaaagaatttatatataaatgaattgtagatcaagtcctgtgttaaatctcttagctgggaaattaaggaagtcttggtaaagacttaaaaattccttccccatttatattttatgaaaccgttaaaagaagttcatgaattagatttgcataaagtcaagcctaccttagaaagaaaataaatttgcttttaaattaaggcactattttcttcaataagtgaaaggaaatatgacggtgagaggggttatataacctgaacaacatgtacacccattccagtcatgaatagcatcccatttttctggttctcaagagtaaggttaggctataacatcaagtgtcatttagagttggaaatttctgattgtactgatttcctctgtgcttgggaggctgagcagctaaagaaatctgatttcatataagtcattggctgtagctaaatgcctttttcattgtccaggaagaaataatgtttatattgaaatacctactttccaaagcattgcagccccaatttcaatggttacgtgaagcagatgggaaaatgttttaaatatctgtaaaacagaaggccatagctcctgaacactttatcctcataaactgcttctagataagtaagccagtgaaaatattaagtgatgtagattcaaattcagctgatggtgacaaacacagtgatgcctctcattatataataatggcattcaagagctccaaaatgtgcaggtgtttagaaaccatgtcacatgatgaatagttacatttagcatatacaagagaagaaacatggtggctgaacttgcatgtttgaggaccaatgtgtggaaggggcagtaggctaattacatgtctcaaacagcagaacaaagatgaatgggtggaaatactacagagatgtgtatatgtagaagaaaggacttcgagatgattggcactacccactgctgagcaggagtgcatttgaactgggcatgttcactagactgaggctagagactcccatgttgggaatgcccttggacaaaaaaaccggtgttgaatgggagatctggagtctgtactgttctcagatttggttattccttgactttctaaatgaagactctagggaagctggtgaaagttatgccagccctatatggtgtgagccatgctaagagtccaattcataactgcaaatccttcttgttcaggaacacagtaccatgcagaagttacactgcacgcaagttgacaaaattgtggcacagtatgacaaagagaagtcgactcatgagaaaatcctagagaaggcaatgaagaagaaggggtaatactgtttatttccttctgaagactttctctatgtttatattttgtcttttcccacagttttgctgctgtttaggtcaaggaagaacttagtgttgacttgattttcatcattaaaaattattcctgggaagtaagaaactcattcattttaaatgctctaacatcataacaggtcaatgagtggatgtagcttctggtttggggaaggttctcagcagagattctgatatcttttaattcatcataattatttctaatatgagaaagaaatcttagcctcaaataattgaaaaaatacctctttactctgagaattgattgtcctttttgattttgaactaattttaaatttacagaaaagtttccaaaatactacagagttcccttatgcccttaactcactttccctaaatgttaacatctcacataatcatagtacagttgtcaaaccaggaaattgacagtggtgcaataccattaaccaagccacagtgatttttcacattttaccagtttttccacaagtgcttgttttccactctgggatcacctccaaaattaaatagcatttagttgtcatctcagtatgtgataattcctcaatctctccctgtcttttgtgactttcacttttgaagagagctggtcagttgttttgtagaatggctcttcttttggatttgtctgatattttctcatgatgagagtgaggttatgcatttgtggcaagcacaccatggaaacaatgctgcttccttctcagtccacgatattggggggatgggggtgtgacattgatatgtcccattattggtgatgttaacctggatgacttggttaagctggtatcttacaggtttctgcactgtcagattacttttttccctttataaatactttggggaaaattccatgagaccacgcatacattctatttatctgagaaattatttttcctgcctttgaccttctccagggattccctctggtttttatctctttccttcaatctctgctgatgtcttctagttttccacaacctttggcacaagagaaaaggagaatgagatttctttttcctacttgggttttttggcatttggtttttgttttttattttttgttttaacagtcacccaagatatacctagaaaactaaactctgaaaacagaacagattatgttagttataattttcttggacattggttcatattgccgaaatttcagatcccaagatctaagttcatgacatgaaaccaatgtaatttgcttgaggagtaaatggtgggtaactaaaatgcctgccctggtatcaggcctcactatttgagaggtaccctcatttttattaaagttgtatttttcagaaaaatacaaatcaggcactgattattgagcatctgttattatgcatcatctgccttttgttttccccgtaggtttcactgtgtattattgaggcagaaatgtgcctgttgcttagaaaacattttgatctgtattttaagtgagtaagtgagtcacccacctcggagctcatgtggcaatattggtagtgattacagtaagttttgaggagctgtgattcttctagattctaaccacatcagctttggcctatttcttttttgtaaattaatttctcatatttaatgacattttaggctataatattgaaactgatggtagacagactctaataccaaggagcaaattgttgatgactttatagtactctccaagaataaggttatttgtatttacaagatatcttttcaaaaaatgtttcatgcatttttgtggatcggtgtatttagaaacacagttttggcttaaccaaaccaaaaatttttattaaggagatttcagatccaagcaccatagagtaaatttctttgctaaaaataatattacagttttctgattcaatcaatcatgagtgctacctttagaaatttttaaaaaattgataaaatatatctttacctcatgattgtttttactctcaaagataatgtgggatcaaaatgtaatttattataaacttggtaattattagaagtgtccctggtgtgacacttaaccccccaaacaggctattgagtgctcttggaggtctctcagcaaataaagccctgttttatcctaaacgtagatgagactggaaaagtctaatctgtagatttcttcctgagcctctgctgtcaaacgcagcactcctagcaggctcttcacacagagcatttccaagtactctaaagagtagaatcttagcaatacattaaaagttacttcaaaatcagacatcagatactttcttctggaaagccatatctgaggagagtttctcatcattaatattcaccatgatatcaaggttgcctggacttagtcttgctatgttgcccaggctgaagtgcagtagcacaatcttggcccaatgcaacctccgcctcccaggttcaagcaatcgtcctgcctcggcttcctgagtagctgagactacaggtacatgctgccatgccggctaattttttgtatttttaatagaaatggggtttcaccatgttggccaggctggtctcgaactcctgacctcaagtgatctgcctaccttggcttcccgaagtgctggaattacaagcgtgagccactgcacccagccttcctggacttttaactgcaactgagttgctaaaaagttagtgaaaggggaaactgtgacagtccttggagctttctcatgcaggatctatttttgaaacaaatgaaaggtttccccttactcttacctactcagctgaaaggaaagattgacctgggaaagggaagctttattcaagtgcttccagctttggctaatgactacctctcatatgctttccactcaaggatctttaaggtgatggtaaaaagatgaatgggggaacaagggaagacaagctaaagttgggaaaattctaaattacagaaattattttgcatagcccgaatataaagaaggttgatgcactagaaaggggaaaataaaatcttgattttcaaataaatattacaagtgcatgcccttatgccctcagatgagagtgttgaataaaacctctcattgcatttactgtgaaagatttgtctagaattaagtcacgggaatgtttcggcagtgctgcaaacttattgaataacagaagagagaagaaacttgctcagtgccagccattgagaagtgctagatttgatgcgagaccttgcatttttagagtaatgcttctctcacaggaacttggaattatattataaggaagcattctgacttgagctataataacctagagtatacatgctgaagatgaagctcaggacctgttcttgtttcagcagcgatgtggatattccaaaaggaagacataatcactgaaataagcagtaatagttgctgggcactcgcctagcatatatttcctactcacaatagaataagaagcaaaaattgccctgtggtgccaaggattgctattttctccttcactggcatatttaaaagacaaaaatctggctttataatgaaatggaagaatgaaaaattcacttcaagtctgaggacctattttccagttttcatcccaaataatattttattgaataagtgaaaaatagcttgagaaaaacaggaaccaaaatggaaactgacaacagccccttaatgatgaaataattgttaggtttgaagtgcctctttgtatagtggttgaattgagtaatcatgaaacagataatattttgtaaggtgtgaatctattactagaaagaccagtgttgcccaatgagccatgacatctcatatttgatgaatatattatcttcatcagaaagctttgtagcaaagacccatgggaatgggaaaatatctaatttctggcatgcatttgcaactttccattttcaggggaagtaattgtctcgaaatgaaaaaagaaacagaaatcaaaattcagacgctgacatcagatcacaaatctaaggtaagaaaatgcccatttttacagcagtgacttgcagaagacactttgtaattttttagaaggagtacctagtgtaaattagaaataacagtagcccagagctggtctagtagcctgcagctgatctgggatgtcaggggagcccagggttcatgtttgcctcagactcactggctttaagaagagccatttcatggaacatcttcttttgtcttgtctgttgaactatgctaacaatatttatgttgcctgcctcagaggcatcaaggaaaataataaatgaagatactaaaaggaaatattatataaaatacagaatatacttccctatagaaataacattaaacataggacagaaaaccgcccaaattgggaggtgatacttactccatcctaactttacatggaaatttggaatgagaaaaaattaagagctgatattctaaaagagaagcctaattactcacattttcttaaagacaggagaaaataggagcttgagagactttaatcaactttgtgggcatttggagaactaagtgttaagtcccagttaagaatgaaaacaattcttccagcaatgatagtttttaaatgaaaaggaaaaaaaaagaaaaaaaaaaccaacaacaactgttaaagaaagctcccaaaaatagctgtggttgaaccagccagcctcatctatctatatgcagctgtgtcatctggcctaatggccctgctgcatgcatggagcaggcaagatgttcaagatgttcttggtagctgtatgttttgtagggcatgaactctatagaggcagtaaggcatgtgtctttaagagttattccccactctctctcttcttaactggaatgtttgagaattagtagttgtgcaaactgtcatgattcttagatgcttggcatcaataagaaaagccttggcaacagtatcagtttgcttttgctatataatgaactgtgtcaaagaagagcacattgaaacaactactacagtttattaggtcacaattcagtgggtcagaaatttgggccatacttctgctgattttggctggagacacttgtgtatctactgtcagcagggggcgtatggccttacttatgtatctggtagttgtctggctgttgcttgttttcctacatgacctatcaacctccagcaggctagcacaggctcagtcagagggtagccacagggatcccagcatagcagaagggcaagtactttccagcctctgcttgcatcacatttgctactatctcattggctaaagcaagtcacaggtcacccagcttcaaggagctggagaaacagactccagctcttgacaagaggcactgcaaaaccccactgcaaagagcttggatattgggtggggaggactttctaccctagtgtctatcagggttgacacagtaagtcatgatccagaaataaaagaacacacagctctctattcagacatgtgggcttgtggacatgaagctggagaaacataaggtgataaagaaaatcctgatggaattggtaaaagagcctaaggcccacacaaatcagagtgttggctgagtgtggtggctcacgcctgtaatcccggcactctgggaggccgaggcaggtggatcacctgagatcgggagtttgagaccagcctggccaacatggtgaaaccctgtctctagtaaaaatacaaaaattagctgggcatggtggcacgcatctgtaatcccagctacttgggaagctgaggcaggagaatcgcttgaacccaggaggtggaggttgcagtgagctgagatcatgccactgcactccagcctgggcaacagaggcagactctatctaaaaaaacaaaacaaacaaacaaaaaacaaaacagagtgttgctaagtgaggcagtaaaataagggttcacagttaactattcagagccaaagcaattgatttattttgataagcaataacttcctgcttcccattgattaatacatattattttttggtggttataggtgtctcatgattcaccaattaagttggtgggaggaacctgaaatacctgaataatgttgtgcttttgggttcatacctgacctatgaggattacaatggcaccgtcccctttttcccaaacaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacaggtgggggaattgccgtctccagagtaaacatctaatatttaaaaacaaaagctgattttgtgtgtataagagagccaaggtaataagtgaaatcaatttgacgtacaacatgtagctcttttgtgtatctcatcatatggctgattatgagcaagatgagctataagaaatggcacccaggggccaggtgcagtggctcacacctgtaatcccagtgctttgagaggccaagacaggaggattacttgagcccaggacttcaagacatagcaagaccccatctctattttgaaaaaagaaatggcccctgccatcagagggcttacaggtgttggcaagatacaacacccatatgaacagttaagtcagataacaaagtagcatatgacacatattttaaaatgtcatgggcactaaaggcatccagctcagaggagctctaccttttcagagtggtcatggagacttttcaaaatggtagggctggaactggcctttggagaatgatctggagtctcttaggtagaaaagacacacagagagataaagaccaatcagttcagctcctagagtgaccaggttctgatcatttaatagctacctgtggagagagtctccatttcccttccttacagtgttaggacttctgtgaattttgaaaagataagcctgattaaaaaacagcaaagtatcagtttattttggcctgtgcccacttcagcaaagtgaatattgcatttgaaatactgcaagccatgagctggacttatccctgagcagaagaaggttggtgtttgttacatctttttatcatagctcggttgcagcttgcttggttctcacttagtgcctaccgtatgccacagttagggtctcttgagacacaacaagagtagaaaatagaagcattatacaaataaatcaaacaaaaaaatgtgtttaatgccaactgcataagttatctggctgcatgcccaaattcccaacattactttggagtgacagatactgccacaagaacaaagtgtttttgccctggtttcccattctcatttgaggcaactaaatgcagtctcccatgctccattttctgtgggataatgtgctgtacccccatgcattttaaagcattctatttcgtcctataggattagaagttgtcttttcttttttccttagaaatgctcttgattcactatgcagaaagttgtgttcatcattctgcctttgatgattgctacaatgccagattttaggtgcctacccttattcaaagatacttcacggaatacagcatggcacttgtctaatcttcttttacattgttgaataaagagaaaaacattagctcacaacagtaggcattatctgaaaggaaaaaacaaaatatactaattcttgaattgcttaggaagtcatttgaagagatcatgacctagttactaaaatactttaaaaaataaatccatgggcttcattccaagatggctgaataagaacaggtccagtctgcagctcctagcatgatcgatgcagaagatgggtgatttctgcatttccaactgaggtacctggttcatctcattggaactggttggacagtgggtgcagcccaagaagtgtgagccaaagcagggtggggtgtcacctcacccaggaagcacaaggggtcaggggacttccctttcctagccaaaggaagccgtgacagactgtctctggaaaaacaggacacttctgcccaaatactgtgcttttcccaaggtcttagcaaccggcagacaaggcgattctctcctgtgcctggcttggcaggttccacgcccatgtagccaggctcactgctagtgcagcagtcagatcgaaccgtgaggcagcaacctggctggggtaggagcgtccaccattgctgaggcttgagtaggtaaacaaagtggccaggaagctcaaattgggtggagcccactgcagctcagcaaggcctactgcctctatagacaccatctctgtgggcagggcatagctgaacaaaaggcagcagacaacttctgcagacttaaacatccctgtctgacagctctgaagagagcagtggttctcccagcatggcgtttgagctctgagaacggacagactgcctcctcaagtgggtccctgacccccatgtagcctaactgggagacaccaccaagcaggggccgacagacacctcatataggtgggtgcccctctgggacaaagctgccacaggaaggatcaggcagcaatatttgctgttctgcagcctccgctggtgatacccaggcaaacagggtctggagtggacctccagcaaactccaacagacctgcagctgagggacctgactagtagaaggaaaactaacaaacagaaaggaatagcatcatcatcaacaaaaagttcatctacaccaaaaccccatctgtaggtcaccaacatcaaagacaaaaggtagataaaaccgcaaagatggggagaaaccagagcagaaatgttgaaaattctaaaaaccagagcacctcttctcctccaaaggatcgcagctccttgccagcaatggaacaaagctggatggagaaggactttgacaagttgacagaagtgggcttcaaaaggtcagtaataacaaacttctctgagctaaaggagcatgttcaaacccatcgcaaggaagctaaaaaccttgaaaaaaggctagatgaatggataactataataaacagtgtagagaagaccttaaatgacctgacggagctgaaaaccatggcacgagagcttcgtgacacatgcacaagcttcaatagctgattcgatcaagtggaagaaagggtatcagtgattgaagatcaaattaatgaaataaagcaagaagaaaagattagagaagaaagagtaaaaagaaaggaacaaagcctccaagaaatatgggactatgtgaaaagaccaaatctgtgtttgattggtgtacccaaaagtgatggggagaatggaaccaagttggaaaacactctttaggatatcatccagtagaacttccccaacttagcaaggcatgccaacattcaaattcaagaaagacagagaacaccgcaaagatactcctcgagaagagcaaccctaagacacataattgtcagattcaccaaggttgaaatgatggaaaaaatgttaagggcagccagagagaaaggtcgggttacccacaaaggaaagtctatcagactaacagcggacctctcggcagaaaccctacaagccagaagaaagtaggggccaatattcaacattcttaaagaaaggattttcaacccagaatttcatatccagccaaactaagcttcataagtgaaggagaaataaaatcctttacaggcaagcaaatgctgaaagattttgtcaccgccaggcctgccttataagagctcctgaaggaagcattaaacatggaaagaaacaaccggtaccagccactgcaaaaacatgccaaattgtaaagaccaacgaggctaggaagaaactgcatcaattaatgggcaaaataaccagttaacatcataatgacaggatcaaattcacatataacaatattaaccttaaatgtaaataggctaaatgccccaattaaaagacacagactggcaaactggattaagagtcaagacccatcagtgtgctgaattcaggaaacccatctcacatgcagagacacacacaggctcaaaataaagggatggaggaagatctaccaagcaaatggaaagcaaaaaaaaaaaaaaaaaaaaagcaggggttgcaatcctagtctctaataaaacagactttaaaccaacaaagatcaaaagagacaaagaaggccattacataatggtaaagggatcaattcaacaagaagagttaactatcctaaatatatatgcacccaatacaggagcatgcagattcataaagcaagtccttagagacctacaaagagacttagactcccacataataataatgggagactttaacaccccactgtcaatattagacagatcaatgagacagaaggttaataagatatccaggacttgaactcggctcttcaccaagcagacctaatagacatctacaggactctccaccccaaatcaacagaatatacattcttctcagcaccacatcacacttattctaaaattgacaacataattggaagtaaagcactcctcagcaaatgtaaaggaacagaaatcacaacaaactatctctcaggccacagtgcaatcaaattagaactcaggattaagaaactcactcaaaactgcaaaactacatggaaacagaacaacctgctcctgaatgactactgggtaaataatggaatgaaggcagaaataaagatgttctttgaaaccaatgagaacaaagacacaacataccagaatctctgggacacatttaaagcagtgtgtagagggaaatttatagcactaaatgcccacaagagaaagcaggaaagatataaaattgacaccctaacgtcacaattaaaagaactagagacgcaagagcaaacaaattccaaagctagcagaaggcaagaaataactaagatcagagcagaactgaaagagatagcgacacaaaaaacccttcaaaaaaatcaatgaatccgggagctggttttttgaaaagatcaacaaaattgatagactgctagcaagactaataaagaagaaaagagagaagaataaaaaagatgcaataaaaaaatgataaaagagatatcaccaccgatcccacagaaatacaaactaccatcagagaatactataaacacctctatgcaaataaactagaaaatctagaagaaatggataaattcctggacacatacaccctcccgagactaaacctggaagaagttgaatctctgaatagaccaataacaggctctaaagttgaggcaataattaatagcctaccaatcaaaaaaagtccaggaccagacagattcacagccgaattctaccagagatacaaagaggagctgataccattccttctgaaactattccaatcaacagaaaaagagggaatcctccctaactcattctatgaggccagcatcatcctgataccaaagcctggcagaggcacaacaaaaaaagagaattttagaccaatatccctgatgaacatccatgcaaaaatcctcaataagataaatactggcaaaccaaatccagcagcacatcagaaagcttaaccaccatgatcatgtcggcttcatccctgggatgcaagtctggttcaacatatgcaaatcaataaatgtaatccatcacgtaaacagaaccaataacaaaaaccacatgattatctcaatagatgcagaaaaggccaacaaaattcaacaggccttcatgctaaaaactctcaataaactagatattgatggaatgtatctcaaattaataagagctatttatgacaaacccacagccaatgtcatactgaatgggcaaaaactggaagcattccctctgaaaactggcacaagacaaggatgccctctgtcaccactcctattcaacatagtgttggaagttctggccagggcaatcaggcaagagaaagaaataaagggtattcatttaggaaaagaggaagtcaaattgtccctgtttgcacatcacatgatagtatatttagaaaaccccttcatctcagccccaaatctcctcaagctgataagcaacttcagcaaagtctcaggatacaaaatcaatgtgcaaaaatcacaagcgttcctatacaccaatgacagacaaccagagagccaaatcatgagtgagcttccatttgcatttgctacaaagagaataaaatacctaggaatccaacttacaagagatgtgagggacctcttcaaggagagctacaaaccactgctcaatgaaataaaagaggacagaaatgaatggaagaacattccatgctcatggataggaagaatcagtatcgtgaaaatgcccatactgcccaaggtaatttatagattcaatgccatccccatcaagctaccaatgactttcttcacagaattggaaaaaactattttaaagttcatatggaaccaaaaaagagccctcattgccaagacaatcctaagcaaaaagaacaaagctggaggcatcatgctacccaactttaaactatactacaaggctacagtaaccaaaccagcatggtactagtacgaaaacagagatatagaccaatggaacagaacagagcccttagaaataacaccacacatctacaaccatctgatctttgacaaacctgacaaaaacaaaaaatggggagaggattccctatttaataaatggtgctgggaaaactgtctaaccatatgtagaaagctgaaactggatcccttccttacaccttatacaaaaattaattcaagatggattaaagacttaaatgtcagacctaaaaccataaaagccctagaagaaaacctaggcaataccattcaggacataggcatgggcaaggacttcatgactaaaacaaaaagcaatggccaccaaagccaaaacagacaaatgggatctaattaaactaaagagcttctgcatggcaaaagaaactaccattagagtgaacaggcaactcacagaatgggagaaaatttttgcagtctacccatctgacaaagggctaatatccagaatctacaaagaactcaaacaaatttacaagaaaaaaacaaccccatcaaaaagtaggcaaaggatatgaacagacacttctcaaaaggagacatttatgcagccaacagacacatgaaaaaatgctcatcatcactggtcatcagagaaatgcaaatcaaaaccacaagagttgccatctcacgccagttagaatggcgatcattaaaaagtcaggaaacaacagatgctggagaggacgtggagaaataggaacgcttttacactgttggtgggagtgtaaatttgttcaacgattgtggaagacagtgtggcgattcctcaaggatctagaactagaaatcccatttgacccagcaatcccattactgggtatatacccagagaattataaaccatgctactataaagacacatgcacacatgtgtttattgtggcactattgacaatagcaaagacttggaaccaacccaaatgtccatcagtgatagactggattaaaaaaatgtggcacatatacaacatggaatactatgcagccataaaaaaggatgagttcatgtcctttgcagagacatggatgaagctggaaaccatcattctcagcaaactatcacaaggacagaaaaccaaacaccgtatgttcttactcataggtgggaattgaacagtgagaacacttggacacagggtagggaacgtcacacaccgggccttttggagggtgggggactgggggagggatagcattaggagaaatgtctaatgtaaatgacgagttgatgggtgcagcaaaccaacatggcacatgtatacctatgtatcaatcctgcacgttgtgcacatgcaccctagaacttaaagtataataaaaaataaataaataaataaaataaatccatggcagaagcacttttcaaagcaacagcagtattttagctttttctcaaacccctggtggttgtgtttcttcctcatgatcacaactattattcttggttaaaaatctttgctttcttgacatttgtcagcaacgtttggtcattggtgtttgttgaatgaatgaatacagaaaggtcaatttcctaacaagttatggtaaaatctgagagtgatcttcttgtgtccagagtttctatacatgttcctgctggagtggctctagggtagctgagtgagcaactctccagttcagtattgcccatctctttggatgcagagcaaatagcagtgcctaggtaacctgactgcttgtatgctggtttccaggcagtgctttcaatagatctccataggttatagaaaaaaatttttgtaataatatactatgtagcattttaagttttattcctttaatgcatgtgtgtcatgcatacacatgcattcccacatgcagtggttggtcacctgcaaacctacttttttgctattccctgtgcttacttgaaaccatttagtccctttcattcctgtggctgatagaaacaggaaggccgtttgtgatggttagaacattttctctctctcttccagcccatctgatcccaaataatatgaagcaaaactgagatctttatatttatgggcaaaaatactgtctcctcatcacaggccatcactgtcacttcaccactaggtggccactgcccctcaaggatcagcatccacatagcttggggtcccgtccctcctttttccaaaatacagaagtcgatgagctcaataatagaaagaaaaaaaaagaagagtgagaggagtgagcctagtcatattgctataaacagaagtatttttgtttttttccatgcttaaattatgtctatatatataaaatgtaaactttactgttgtaaccattaagtgcatgacattaagtacattcactttgttgtgtacccgtcactgccacccacctctagaactttctcattttccccaggtgaatctctctacccattaaacacaaactctccatcccccctccctgtttgttttcttgtttttaatacatagggaaagcaaggaaatgcgagcacaccaggctaagatttctatggaaaatagcaaagccatcagccaagataaatctatcaagaataaagcagaacgggaaaggtaagtctgagagtgttcactgcaggaatatggcattgacttgaggacacagtctcaactttctttatgtgtgtacacacacacacaactgagacagcaaaacacttgtggcttttgactaggaattctgctattataactgcaatggagatttgttattatcactgtagaacaatcgtccacattttctggttgcttactaccaccagtaaaattagtttacattcaatatatatgtgctgctttacaaacaaagttgcataaaatatgacataataatataattcttttttttattttattcatttttttttttgcttgtttgttttgagatggagtcttgctttattacccatgctagagtgcagtggcacaatctcagctcactgcaacctctgcctgggtttgagcgattctcctgcctgagcctccctagtagctgggattacaggcatgcaccaccacacctggctaatttttgtatttttaggagagatggggtttcaccatgttggccacactggtcttgaactcctgacctcaagtgatctgcccgcctcagcctcccaaagtgctgggattataggcgtgagccactgcgcccagcctataatcaatataattctgaagcatccttcccaggttccactgggtcattctgcaagcctctcccctgctcaggtgtcagtccgttctggatgggccagttctgaatagcagcaacagtcaggagggcggtcttcttcagtagtccttcacatgggatcatcttgaaagcccccatcccatttgtctcatttgtccttatgttaggtgagttttctggaagcagatcaaggcaggaattgatgtgcttgtgattcactgaggaagggaccttcagagaaagggagtgagaaagcaggaaggcccagggcaggccctaagcaaggatgtggtctcacctagggtcccagtaacctcaaataaaaaattccaccacagatttgtccctctttgaagcaagagtacctggcttttgtgtttccatattaggcagtcattggccgcctgagactggggggaaggtttgtgtgtcctctatagaaggtgccaagtgcaagccctttagacacagctggtgaaggggatctgaggagctgtcaatagtcatgttacccaagggataggcacttaattcccagcgatcaccagtgctgcccatcatccacctcaaggaacatctgagaatacaaatgctatcagctccataaccaagagcctggattacgccaccagcagttagggacagtggggttccttcttttgggggaataatacctagcaagaaggtggccttttggccaaagtccaacagagaaaagctgttttatgagccaggtgcagtggctcacacctgtaatcccagcactttgggaggccgaggtgggcagattacctgaggtcaggagtttgggaccagcttgaccaacatggtgaaacctcacctctactaaaaatacaaaaaaattagctgggtgtggtggtacctgcctgtaatcccagctactcaggaggctgaggcaggagaattgcttgaaccccaggggcggaggttgcagtgagccgagatcctgccattgcactccagcctggccaacagagcaaaactccatctcaaaaaaaaaaagaaaagaaaaaatgtcattctctggatgttattctcagataagcaactttgtttaagggccttatatacatggaaatgacaccttcttcagtttgaaaacaccaaatattccagccatgataaaacctcatgaatttgaactgttttagactatccaaagtgaaatatagaattaaccatgacaaatgtgccaattaatagctttttaccatctttttcaaatatgttacaaagtagactttagctcggttgaggtcaaattatcttcaatttggagttactgctaacttaattagcaagggtcttaaaaatttatcttattttgaaaactgtacttatttgttgtaactttctatttttatttgtgcaactgtatgggggtacgtgagaaaactttacatgtatacaatgcccagtgatcaagtcagggcatttaggttgtccatcacccaagtactatacatttgtggctaagtatagtcaccctactctgctatctcttataagtttgtatccagtggtatgtggttccaaaatatctacaaattggctgttttttaaaaaataatttttctataccaaatgatagttatattctaaacccatactgtgtgtatgtttgtatccactttatcaaactgaggagaaataaaatttaaaaatttgtcatagcactaagaaagatacatagaaactgaaaatcatacttacatttttagatcaaagaagacattttaacagaaattacccaatatttataactgaatgacaatgtaaacactatttatcaatgtgtagagggtagttaaagtgatatttggagggaaaaatatagcctagatgcatatattttttaaaagatgtgaaaattaatgagctaaccactcaaagagaatatgaagttggaaaaacagagtgaacccaaagatctctgatggaaagaaataaatttaaaaagcaaaaaatactgaaatagaaaacaaaatgcaatagagaacattcagaaaaacaaaagcttatttgaaaagaataataaatcagttaactttcaccaagactaaagaagagagagaaagcacgaattagtgatgttaggaatgaaaaggggaattaactacagagaaaaacgctttgaaaaactaagtctactattaaaaaaaactaccaataaatttgaaacgttagatggagtggagaattgctttgaaaaatataaatatccaaaactgactgaaaatggagaaaacctgaacagactggcaattattacagaagttcaagaagttataggtcttttcactcatgaaaaacactctacctcaccagtagtcagggaaatgcaagttaagacaataagctccattccataggagcatccaactgacagaaagtctgatagtactaagagtgggcaaagatatggggaaagggtaacacccagacactgcagatggaaatgcagttggggacaactggattggagtaaggaagagcctgttcgtaccctgccaagtgacaagtctgagtatacaccctacagcagcctttgcctgtgtgcacaagaagatatgcaccatacttcatccactcatctgtttattcaacagacacttattgtgtcaggtattacagggcccacgcacccgatcgttgtagcgttgtttgaaaataacctaatttttgttaatggcaatgaggaaatagtgtagtctgttcataaattgaaaagtccatacagcaaatgaaaataatgaagtggtctggaacataggtgtatctctaaaacataagactaagtggtaagctatgggaagaaacccagactatgttactctatgggtacatttagaaaacacaggaagcgatgccactgtgcctggccagcaacatcagcatcacctgggagcttactagaaattcagacctcccaccccaggcccactggatcaaagtcactaaggggaaggcacaacagtctgtggtttttatcatctctccaggtgattggtatgcacaggaaagtttgagaagctcttatattacacatgggcacatctgtatgtggtttaaaatattaaaacatgggtgagaagatccacaccaaattcacaatagtggtaacctctggggagagaggaataaggaaaactgaatcaggaagaatacacatggggctttaattacatctggaactgtttattgcctttaaaaatgtgagataaacatggcaaaacattaaaaatatcagttaatctgagggacacatacacagatttttaaatattcttctctggacattatatgtttgaaaatactgcaataacaattagaaaaataaagcaataattccatccagagaatttgatggaatatagctctttattatttgatataatattaatttcattcaatgtcataccaaccgttatttgtgcccattgcttttaggcgagtcagggagttaaacagcagcaacactaaaaagtttctggaagaaagaaagagagtaagtattttattatatttttggcattcttcctttaaaaaactataaacaataacatgcttagccaccagatctctagctaatttgtttaatttgatttttctgtacattaaacattccagcttctctgctccctgaaagctaaaataatgtctcactaaaatctttaaggtaatgatttggcaccattttatacagaaaatgaagccaggtttagtcatgcgtaagtcctctattattttctaagattttagcaggaaagatcttcccagaaataattatgagtttaaactctccaaattttgagatgattttttaaaaaattattatctctttcacttaaattataaagttacaagtcatctctcatccctgttttaagattgtaacccaaagttcaatcagaattttttttttttttttttttgcagcttgccatgaagcagtccaaagaaatggatcagttgaaaaaagtccagcttgaacatctagaattcctagagaaacagaatgagcaggtattttacctaaaatacgtaaaaacatgcaggcagctagccagctttgggatacacatgccatggcccacagtgaccagtggcttgcatattgtaattgaaaggtagatagaagaatttgttgcccattactatattttctccattatatccaaaaagaaaagaaagtaccagtttttggagcaggagcagaatctggctgtgccaaaaaaagaatatttggataaattatggggattatgtgaattctaagaatgaaattactaaaagtgagaggatgaaaaaaagagattacgaagtatttctccattttcatttagagttttataatttgcaaactataggcaagggatatgatgtttaaaagcaaatgagagaaaccacctattttcaaactcaatctgaaaacgaagtttaaaaacctccctgggacttacaggtggtatctaaagtcatgagcccccatcactctacaaatcactgagcatgagtggataccatagtcttggtctttttccctgcaagacaagacactaaataaagaaatatacacaaataaagagttatccaggccgggcgcagtgggctcatgcctgtaatcccagcactttgagaggccgaggagggtggatcaggaggtcaggagatcgagaccatcctggccaacatggtgaagccccgtctctactaaaaatacaaaaattagccgggcctggtggcatgcacctgtagtcccagctactcagttggctgaagcaggaaaatcacttgaacccaagaggcggaggttgcagtgagccgagatcgcaccactgcactccagcctgagcgacagagtgactccatctcaaaaaaaaaaaaaaaggagttacccaaacaccaactgtttagttaggccaatgggcatataccagcaccaaggtaaatgtatttttatctggtgcatagtacaggtgggcacctttccaaatgggctacagcccatcagccttctacagtaacctttaattaatggaaatccctctagttcctatggcaacaagaccctcagttatcatttacatttcagactctctcagttcaaatgttattctttaggtgtagttggtatagaagttattattcctaggtaattcaatttagaaacggagaggttttgatgaaatatgtacttgtgccacattattccttcctgttttctcccatctataaaacaatcctatttaaggaatacttttttccagagtaaatgactccccttgaagaatacttaagtaggaattatactaaaaagtacctttgagaaagtaaaaataaaataaaataaaataaaataaaatcttttttgtatggcaattgggtaacagataaatctgacttctagtttcagattctttactttttggtggacagaaattttattcatcaacatacttcctagttatgtttcccatttccttttcagctaagtgcttctattcataagcaagtccactccaaggggacaatacatggttattgtcccacaggtacaattcatttgaccaactcataaacacatcacattctggtacaagttacctagcttatgtttttgctcttaaagcacttctcagaaagtgctcctgggggaaatatgggaatatgagtaaggataaagtcaccatctccaaagctttagaagccacttcagtgattcaacaatgggtagggataaggatgccttggagaaggtttttaaaaattctccctagaggaagggcacagtgaaaggtaaggcacagttatgtgttagttaactaaattaagaaactacttggaaattaattgtgttgcttagcaacaagtttgactaaagaatgtaaatgtgctcagaattactcatcactacaatagtggtgtatgccagagctagagaaaacagtcatcttgtgtcgctagctttggagccgaagtacataatttttaaaaatcagtttgagcttttatcctaacacatggctaattcaagccacaccagagttcttgcattaaactgctagattagtgatagctgtattgattagattgtattgggagggtgctggctttttgttgcagaaattcaaatatgtcttttaaggtctaccacccacaactgacactttgagtcacaaaagcttgggaaagcatagaacatgaaaaggcttgagacctgataaagatttaatgagattcaaggaaaagacattcaagatatcatactgatgcttctggcaagcaaagaatttggacttgagtttctgtgttaagctttgctttagaaatatggcctgttcaattgcaaattcaatcccagatctttctagtatacattttttggcatttaagggtgagaaagctctcaattcacagttactctgtatggtacaacactgtcatgggcacagtgcaaaagatacagtgacttcatttctttcctcataaaaaggcaaggtctggaactatatagtataactgccttcataaccaggtaaacatttcatcagcaagaacagttctttgtctccagacaatgcaaacttctacaacaatcttctaaataattgttaaatcccaagacattttttctaagccagagataaatgtaaacattctcccatagtatttccctcaaaggtttctttctgttctcctgtgaccctactcctaatcggtgtcccaaatctccccttccaaagcaaggcctggaatggattcagtccattagctaaaccagtgttgggggcactggcagaaacaaaccaggcgtcagtatgttttggtcctgattctggatcctcaccttctaggttatttgtaagccactttatgtccttgcctacttggtcagccaactattcacttaacactctgaaggttggggatgtttttcctacttgagttttttcatagacttcccagctacacagtatatctcatctgtcttgacatgtaccatttcaaacattaacgactccattactgtcacacactcgagtctcaaaaattgatttttatcatcaatcctatcatttaataaagagaggtaaaaggttttgcttaaaggccaggttctccacttactgccacagaagagaggcacagtctgggaatgacaggcgttggttgtttgtttcgtttcttttttttctgttgagatcaactaggggaaagtttgtcactgaggggtgtgtacatgttttatccttagctttttgcttttctgtatatggttttgcattcatttttcaaattcacttcaatattcatttattttcttcgttttgtatgtatgactcaattttgacattactatttttgtacaaacagcttttgaaatcctgtcatgcagtgtcccaaacgcaaggtaggaccgaaactctgataagcaagacgttgctttccttctcgactacgtccgtattctctgtgcagtctccatttatgagtcacatctggtcataactaatatctgaagggtttggatttaaaagcttgactattccatgcttggatttctgatgtcatattcatgccaaaatgccctaagtctttagagaattacttctgagggtatttgaacctgtattttctattgcagatttaggaaacagatcatggtaataaagacataaccagaacagtgatgtgcagctgtcatttggactgaccagagctaagacagggtcacagagtcaggtcactcacaaatgttaatatgactccaattaatttttaaagcgctcgctgaaagttggttggtggtttttaatgatggagctgtgctgtgcatgtagaaaccttacacgatgactcttgtcatgctctctgctaagtcccatctgccaaagaccctaatcactcctcataagtaaggtggtcatataatttattgtccataccaggatagttttgagagtgaaaggcagctctgtttataatatctaggactacaggcataaactggaattgcctcagacaaatgagaatgaatggtcacccaactcatataagaacttagctgttggaatagtcttgtaatgtcctatgattcttccttctacaccgtggtcaatactttcttcagaagctaaagggggacaagcacagagaatcatttgctactatttaccgaacttggaagtatttaatttccagtgctgataatgtttcactgtcatcccttttgaatactgtttgtgtcatagtttcatgtttgtatatttttctccatttcttcatttctctattagagtattactatactttaggcataaaaaatatctgggcagagggaaccaaccatcccaaatttacacagaaagatttaattctttggtgttattatatccatcctcaccaaaatgaagcttaacgccaaaatatagaagtaagaagaagaaggaaatcacagtatagtctgtgggttaaattaattttgtcacaagaattcatttggaagatgcttctcatatatctacagagttgaccaaatcccctcccagtgaccttccatttagttggaatatctaagcagacataaatagtaacatcagggcacttcagaatcttcatccgatttatatcttcataggtccatgtttctattttcaaatgtcctttatttcaaagcagcatgtcactaaaaaaaagaaatgggcaatcatcattcctcaaaagatacgtgcatttggttgggcaaaatcatccaggctaccagttggataataaaagtcgaaatgtactatttgattttttcctatgtttccaagcaagtatttctcaccagacactgcccccatcatatcccctttcctcttctcgaattagctggttttcttagtgacaatctgaactcatgaggttgaattcaccattgcttacttcctggtagtccataaaaagtaccctagagaagtaagagcccacagggatagagtttgcacaataagattcctgaaagcctgcatgttcctgtaacattccatttacagaagactccagccaatccaatgtaatatgctctcacctgaacttctctatcaattagatttttagggaattacttttaactaaatttcaggctatttaggaaataagttgtacataagcaatacttattctaatgtgataaaattatctacacacagtcaaagcaacgtgtcaatctgtagaaactaaatcaaacagtttgtggtatggtctaaagataaagcaagtggtctaccctcttctcaagtggttctcctggcactgtgtaaaccagtccccaaaatttaatgtgtataaaaacttcctggagatcttgttaaaatgaagattttaactgattcaatagatctggggtagactccaagattctacgtttctaagaaggtcccaggcaatgctgatgctgcttgtacatggaccatattttgagtagcaaggatgtggtgacaggatcatatttatgggagaagagaggccagggttgttaagtgccttcagataaggatttcaacacacgtaaggccatgtttctgatgttataggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttc

SEQ ID NO: 55 - DNA, 216353 bp, Homo sapiens
cgcagataaagtgagcccggaaagggaaggagggggcggggacaccattgccctgaaagaataaataagtaaataaacaaactggctcctcgccgcagctggacgcggtcggttgagtccaggttggtggcatttggagtttttttcgttctgtttgggaacccattgccgcttcccgtccctcttccccactccttcttcccccctcctccggccacccctttctttttgctggcgtctcccaactttagggcccggggggcgctcgtggcgccgggctgcacctgccggggcacgccgggactgcgggccggcgcgctcgccctgggctggggtgcggaagcgcccgagtcctgggcaccgggcgagagtgtgagaggagcggacgcccaggagggagccgaggacgcgcggcgggtagggggtaggggcgcaggaaccgggtttcagccccagtcgggacatcggttccccctggcttggcggcctctggagggagacgagtcccggggagaaggagggcggcgactggggctagggattggcgatcggagtggggagggccggcggctgagcgagctcgctggctgacgcgaggagggggaggccaacttcccgggagaaggggctctttcggcgccagggctggctagggagctgccgccgccgccaccgagggctcggactccaggcagctgcaggctccgctcgcgacgctcggaaagtaccgtttatttatttatttgcttgcgttcagcgtctcgggttgaacccaacagacacccccttggactttaggaaccctcttcagacctctccagccctcacctccatccccgtgtcagcggcccctggaaaacacgcacatgcaccccgacctgggtgggggtgggtcctcaccccggtgttggaaattccccaaaggcgggaacgggggaggggagagggttctgtggggggagtctccggcgctctccgctctcatctcaaagcgcgccctcccttccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttgggtaagtcgaggcccgccgcgggctttcttaccctctgagtctttcctagggtcgcttgcagcagcccaccccgccctccgcaccaaaattggggcgcgggtgtggtggatgtggaaggaagaagtgtctttttggggaatgggatcgcgaatccccgggttagggaggcggtggcggcgcggcgctgcctgaagcttttcgggcttggttttgatttcctgtggtttttaatgacccaacttggcgggggactaagaagccctccagcccagggccctgcacccccagagagtctctgggagctcgcggagccgcggcgggcaggtggagttggggagcattggggccgggagagcaaacttggaagagaaaagtttttcccgagtagcttctgggcactctccgcccggcggaccgctgaccatggctggcctgccccgcgcccagcgcgcgcccggtgcccagtccgccgccgcacttctcctcggaaagcgcctgagtttcagccgggcggagcgggtggctggagccgggggtggcccgggagcccgggtcgttgctcaggccaggatgccccggggcggagggccgacgtgcgcggtgggcagcgcaggctctggagcaaacccttgaagcccgcgggctgagcctgcgccactcttccttgcgggcccgggaggaggagagaggagctggaattccagggggcgggaaaatggactcccggatggtcgagaggtggacccgctcccagagcagggcgcccccgaaggctggtcaagcatccctgacccgggcgcgcgccctcgcccggagcaggggcggccggggtccccgcccgccgcactcaggctccctcccctctgccccgcagacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggtacgcgtggaacctccccaccccaccccgtgtccctccccgaaggcaggcgggcctttcgtccctgggccagctgatctcatcctccactcacttctccccagctgcagagtgaggacctttccttggcccccagggacaacggcagctggtgtttgctgggctgaccagcattgttgggcctgttgttggaaaacccatgaggaggacgggggctggggggagggccacccccgggaccccgctgacctctctgaaacctggtcggagcatgggaggaggatcccactaaagggccccaaggaacccacaacttctttccaaggagagccagcctggggctttcgctggcctctcaataataataggaaggcttgccctgcatctggtctggactccccctgtcttgttccctttaacctgctctgatgtaagatgaagtattgtaaaaggtccaggagaatccagtgtatcttcaccctccccacctaacgtgatcaaaggcagatgtgtgaaaatccatttgtcatcttagattagctgagtcttgaaccagctggtgtggttcaaccttggttatcacagaagtagctcagggagagaaagatccactggtcacaaccatccagtccaatgggagtgttttggtcctcataagccagagggggctcatgtttgtaagcctaacgcaaacatcttgtgtgttcattcttgactgagactcacactggagatttgtattatacagatttgacctgtcagcggtcacttcctccagagtctattaatgaaaacctgtttcagaggtgggctgtttaatagccatggtacctgctttccaaccgtatgccaggttttgggagcaagcagaaataagggtctttcctgggtcacctttcttccattggctcctggaggcaagcagggctcgtgacgtcaccggctcttccctctctgatttctattcctttgcaaagagtgggagagttttctggcaagatagggctgggttgttctccaatattttcatggcactctggggagaacaaggacaacaaaggcggagggaatgaaaagaaataaccatagtgaaagagatgcatttgaaatctttcaaagtttcagcgtctttttgttacacaatcataacataattagaattcagattcagcagcaaaaacctgcttgaaatatatgtttttctgatctgagcccaatctttctgttgtttttaggaaatgatctgctggaggattccccatatgaaccagttaacagcagattgtcagatatattccgggtggtcccattcatatcaggtaagcagatttatacttccatgctgatgcctttgtgtgcttgaattcgttggcttgcattctctttggctctcaaagagcatataagtagatagttgaatggcacagtgtttctgggaaattagaaataggatgatgataatgaagaggcataatgcctagagatgattgtatgacttgaaagtaattctaaatgaagtaatgtggtgtggtggtttggaagaggttcgagggaggtgacttggttgagtatttttttttttccacattaaaatatgattggccatctcttgcaaagggagtgccacttctgtctgtaggtggcaatcgtattctcttcttgctgcataccttacatagtgcctccctggaaatgggatctgttcagattatgccacttactttacaagacgcccaaagataatcttagattgttgaaaaatttgggatgaattcacttgtctgcctttgatttaaaagattaagctctgccatttgttaacaattcttttgcttctattttttcctgagcaagtgtgtgcatttatgagagaatgtactcctgccccaatggcccttttaaatgtagtctcgcttcccatggtttgttttttctctctttgcagttctatgtgtggtttggaaatgaacttaattttggaattaagttttttgtaacatctgcattcagacagcccataaataagcaaggcagtaatttatctttatgacatacagattccagactaatgttgtctttatttatttacagtttagacattttctcaagtatatatagccaccacaaattatatgtctctcagtggttaaacgtgatgggtaatgttgaatttgattctatgagattatggtttgtaactgatgagagtgtcttggtgttctaaatgttttgtgtttttttgcagaaaagccacagaatcaagggagtgtataaatactgatattttatttgggtgtgttatacatgcattcatccattcaccaaacatccattgagcacctactgtgttctagctattgcggtttgggcagtgagccagtcatcaccttgccttcatgaatcttagagatagccaggaactgacattgattaagtcttattatttgccaagcaatgtgttaaaagtgttacatcattaacttaggtaatcatcaagtgcttcttaggtattattatttccattttatagatgaataaattgaggcatagtgaagttagggaaacagccccaaatcacaaaagtcttaaatggtagaaccagaactgaaactcaaatttgtttgattctaagcttttgtaacatctaccctttgctactcagagtgtggttcttataccggcatcattgacattgccagggaattcattagaaatacaggatctcatttgaactactgaatcagaatacacattttaacaagatccctaggctgggttcttcatatgtacatgaagcttgagaagcatttctctacattattctgtcttttccttcagaggaaaagtgtgtgtgtgtgtgtgtgtgtgtgtgtgtgtgtgttagtctgtcagtctgttttggcataagatataaggatacgagtttagtgtaagaggaattcaaatgtttctctgagtaatgccaataatttccactccatgtcacttctagtgctttctgtccctttgatccagccaggacaatggtttaagcagtggagaggagaggtacagacaaacgtatgtgaccacctaagctctcctgggagcggatctgtagaaactgggatggggtgttgccagtggagtgctaggtgccagaggcaaacctgaccttcatcctgcttttgagggacaatgcctgttacctactgtctgccctgtggactcctcctttgtactgatgcctggaagggtatgaacctctccatggtcattgatagtgagaaagcaggcaaggaagaagggccactgggttttaatttcagaatttctatgagcaatggtttttttttttgtttgtttgtttgagacgaagtcttgttctgccacccagggcccaggctggagtgcagtggcatgatctcggcgcaatgctacctttgcctcccgtgttcaagtgattctcctgcctcagcctcccgagtagctgggattacatgcacctgccaccacgcctggataatttttgtatgtttagtagagaaatacatgtcaccatgttggccaggctggtcttgaacacctgatctcaagagatccgcctgcctcggcctcccaaactgctgggattacaggtgtgagccaccgtgcctgcccgcaatggagtttttattatttttttaaaaacttttctttttagagacagggtcttgatctgtcgcctaggctagagtgcagtggcctgatcacaggtcactgttgccccaaactcctgggctcaagcgatcctcctatcttagtctcccgagtagctgggactacaggtgtgccactacaccggctagcaatggagtttttttacactcattttccctctcagagttgctctttcatttgtataatgaggcaattggagtaaataatctctaatcgttacagtccatggatctgagaaaaggttgggctcatctctagaattcttccatggttctcttacatcaccttctctacccttgcaatcatttcaactgttaaggaggcatggtcattctcagataccactggtttgtctgaatttatgagtattggacattcttctgcatgggccaagtttcacttatgcattccttggatcccattcgcaggccagctttcttttcacagcaagtatgatctggagtttgtgagccctgtcctgtctagaacccagaaatcataatgaattagccagagccagaaaggccttgtctagagccccattttctatctcaagggcattggctttaggttccagcactaatgtgatttgacctctgacagtgactgtgttccttaagtgggatagtaaagccaaatggagacttgagaggctttaagtcattgaataatgcatattatccagtttggcctttgcaggatggaaaaggatggaggaacaggatgataaatgttgcttttcatggtttgaatctgagctttctagaacatctcttctgtcttgaaaatttatctgaggaagccaggacaacagtgtctctgcttttcacagatatggtagcaatcactttccatgtttggatttctctgcccaacatgaagagcatgtttatccacatacactaagggtgagctgaatcctcgcaaggaacaagacatgtttgacgttcttgtgtttccattttccttggattcctcaaacccacattcactttagccattgtttgcttgctaaccacataaaaggccttgctgaggtattatcagtggcccgttgggaacaagaaggagaacaaaaataaggtggaatctaaaaaccgtcctgttttcaagcttgaaatgcagaagggaaaccaagtagccaagtcaggagagaactgcagagggagggtggagggctgctttccagaaacctgagagcggaagcctttggcccctggggcacaattaagggcttgaggaggtgtgtttcctgtggggtgaggctagtgtgggttttaggggcctggaacatgaagcgagcgggaggacacacaggagaaagtgcgccggtgcaagaggatgtcggaggagaggcaggaacacagaagtgtcctaggatcccagagggcagagctgtgtgggcgctcagaggctcagaggcagaagccaccgtgcgcaatgcactgtttagcatctgcatctctcccggccgagatctctgctcttgcacctctattctgcccctgcttttcttcctcagaaaagttcgagacacagaagtaaacagggatttgaaaggatgatgaacctgttggcaattttttttggactcttggagtgggagagcaaagcagtgagaaattttgaaaatacagtgagtgctaagaaaagcctgaggatggggaacagagggaggacagaagcacctctttggcagcaaggtttaaaactattgattgggagactggatttttgtagagaagtcaggagatgccaggccttccttaaaatacaatcacagttgatgatattgcatgcaagaatcaagtggatagatggtagggaaagagtaatgttaggttttgaacatcctgacttgctggaaggaaaagtcccagcttctggcgctcatcattttcctaccaagtgctaggagtggctttgacctttccgggaagccttaggatctccagattcgttcccaagtaattggaagtggtttgctccaggatgagatgcacctaaactctcttttgagtcttgcctctttttttctgagtgattctgtgaataattagccatgtttagcatttctgttcaaatgcaccgtcatatttaagtcattattttttaaaaagttatcacaaagtctacatgttggagaagagccttgtaacatcacctgctttcttgtcaggtcatgacgagagaaagccttgtaaataccagctattagggatcgtggtggtccttttcttgcactcagctctctaatcctggtgttcctatatttgagaacccccattcgtttcctgttatttactctggcatatggtaaactccttagtgggccagtgaaggccctgctctccattttgaagccccacaccccatctccactcaagctcactgagccaaacaattccccaagtatttcatgtgcattcactttcctgtgcctttgcacatggccttgcctttacttagaaatcttctatcagttctttaagaccaagatcaaatttcacctctgaaggcctttgctggaatccccccaaacaggcaattctactcagggctccctcatgctccatcgtgctcttgcctttatggtagctattaatcacagcatatcaagaggacttatttatgtgtctgtttttcccactggaaagtcggagacttgcttgttatgccaggtgtcaactcagcaccaagcatcttttcttgatcctgagccggcattctgtcaatcacgagtggttgaatgttagagaagaagggtccctagagatctagtccagtactctgtttttatagacttgaagctcagagaggggaggggattggacagagtcacagtgcttgagggtaggcttggggacctttgccaggtcatggcactggtgtagggggagccagtgttggtccctttctgtctgcatactctctggaccagcctcattcattctggagacctcagccaccacttacattgatgactcagagccttccttcctactgcagcctctcttgagcgctaaaccagcatttccagctgagtcctggatgactccatctggcggtgtctcagttaactcaaacttagcatgtccagaatggatctcatcatctctcctttgctccttaccctctctcttcctggatctccagttttatttaatagcattattgtcttcctagtggtctgcactataagctgtgaagtcatctccgtcccttccattgtcttcaaccccttcagcctgacccatcaccaagtcctgctgaaattacctgctgtcttttgaatgctcccctccttccacatcatggatgtaactgtcttatctctcacttgaactctgcatgggctttccagctgacttccctagcttctcccagtccaacctgacctcctcattcccaggtcttgtgcaccttggtgactttcaggaacactctggcttcagtcttccttcactcttttactaactggcttttgatctcgccccagccaccatgtatcatagacaagacaggttgagcagctgccgttctactagcactctgggcagcttcatccctccgtacctttgcacctgctggtgctaggagaaagaacatatgctctggagttccaccaacctgggtgaatgaatcccagctctgccattcaccttatcttgagctcactgtgcctcaggttccatgggtgtaaaatgggatgatgataatgcctactgtataggttcttttggattaaagatgttatatgtaaaatatccagtatagtgcctgaaacatacttggtcctcaataaatctcagtcctttttaaagctacactaaggcgatgttggcttgctcctgactcaagactgggactcttttcagcagaccacattgccccatcagagaatgatgattctatgtcttgcaaagggtagcaaacctgagccttcaggaaggctgcttataaactaccttggacaagcaatgaaaaatctatcctctatccaaaaggccctagagcaaagtcctgtctcttaatcacctggcctgaggcttagctaccctgtggggaaggtcttccttattcctgcactgagtctctccttttcccttggacccctgtccttatgctctgtggtcggaagtgagttggttgcagctggtgatcacctggggtgggagcttttcctgtgcttaaggattcttgtgatcagccttcccttccaagcttggctgattcctattcctctaacctctccccataaatctttccagtacccctcatagcggcaagaattactgctccctgagaagggcatgccttaaacctaggagatgcttccgtctgcaaaggctttgctaagtacacttacatttcactttcacagaccactacttttggtttttattctctccctgtcctgcccctcagcaatccatttttgttgtagaacaataggaaattgcaaacaggtaaaaaaggaaaagaaatttcaatcacccagcgtcctaccaccccaaaataactgctgtaaacatgctaataggagccttttccaatttttcctatatatgtaaatatgcatagatgtgtatgtacatacatgtatacatatatttttttttacaaaaatggtgtcataatctacatctactctctgattacctgcttgatgatctgaaaaacctatgtctttctgtctcactgaccacttcctaaaggcaagattttattatttagattaaatgtcaacctcaagaaggtccatgaatacaggacatgctagtatctgtacacttgtggcaaagacccaaatgttccagtgaaggctgtgaaggtacagacagttaaatattttgcatagagttactgtaggtcctgttaacagaagaagggagataaaacatcagtgagtgacaggtaattgtatgaactgaagattgttacaaggtgcaaattatttatagccaatatgtctgtcctcattccttcttcttagtcctctgaagtatttctttttgccatctcttgatttttctgctgtcgaagcttgttctttccaagggatgtcctttttgttttttgttctctgggacacagtagcaaattctcaagaggaggtatcaaattggggcttgtttggtaaaagtgtatggatccaggagtcaggagatctgtgttctgcttctagcatcgtttacccgtaactagctgggtgaccttgggccagtgtctgcaggtcctgagagtcatctgctccttttgtaatttgagggcagtggcctagagtgatctttaacatattaggctggtgcaaaagtaattgctgtttttaccatgacttttaatattttccttcctttttgaagggcccgtatattgaatcttacatagttattcagcaactatttttctttctagcattttattcatgccaaggaaacttgtgatcttggcatatgtctttcatgttcataacctttataaagtatgatttattcaatgtataccttactttgaactagaatgtatttaaggcatcttatttgaatacatggaagaagataaagtacaaaagaaaataagtaaatgcagaagacaggggaaaagagaaaatgagagtaggaaagagaaaatgaagctaggagtgagctcagtagacaaatacatgctacaagattatatttcaataaattaaataatcggaagtgcggcatttgtttcacgaagggataaataaaaccactggatttgtagatgcagtaggatgtttggaggtcgttctagtcccgtccccgtatttgactgataagaaagcagaattccataaattgataggacaatgcaacataaattgtctaggacagtgatgacaagtaaaattaggtgtttgcttgtaaatgggtatttgaaaccctccatatcttggcatttccccatctcagttcagttgtctttcacctgttcaaatctgtgctccccccttaggatactacactttattttctttgtttcttttagcatgagagccacagccattgactttagttaaggaggtagttgttcattgttttggaacaagggttaattaataggtctctggcaacaagaactagtggctggaatgttaattttcatatttcttggcacccttcagggttgtctgtaaggaaaagtgagaaattatttgttgcgttaagccctcagattttttttaaagataatctttcattcagagttttttgttaaaggagcttaccacttcctgtaatttagagactcaactagctgggtcagtgatgaaaatgaatgagtaatttgcataagaggctaatttattatgtctcctgggcatttctttcatctctctttccattctaattaatgttctaagagggtctatcgccatatcagaaattaggggtgaaagcagctattgttaacctttattattatgattttttatcttctgtaatcttttaaccattttcttttcatatccaggatttacatagacagggctgtggggtatatggagagattttagaggtatactcttttacgatctttcttcaaatagtaggctgttgtaaaaataaaaatgactcaggatagctctccagccacaggaggattttcaaaacatatagaactatgcagccatggtggcagaattgtttctaaatacaagctctcaaaaacatctttataaacacgtatacagacacataggcatacatacacttgtatatctgcctgctcacatgtgcatatttttatagagtgtgttaagtgtggatatgataaaatattttgcctcaaaaagatcttccttgacacgtgtttcagttggtcctggctgtgacaaaggcagctgtgtgtgcgagtgtgacacagctgaggaaaggcaagagaacaagcaatttcttcgaaaatcaattgcaatttactcctactaaattagccaagggtccgccccatccacgcattagcatatgacagacttttaatcatttggtcaagtgacctatttttggtcaaactgcagttccctttggaactctgcctatcccagaactgtgtattctcctcattgaatcctcagtctctttaaaggggaggtgagtgagcaaagaggagtcccgctggggaagcccctaccttgtgtccccttcccctgccgtgtgtcctgcactaagctgccttttcacagacttacgttcttctggtcccccaccatgctaaaaggtatgtattgtgccctctcatttctgaggagaaaagctgggatcagagaggttgagtaactttcttaaggccacacagctgatacctggaagagcttagattcacttcttgttcctgtgactccaaaacctgtgttctttctactgttagtgatgaaattttaagcacagaccaggatcctttatttagaaggagctatctactcccttttctccctctttaattcccagctttctccttgttcttccaccctaaaacactgtttgacaaaaggcctttaaagttgcaatatacaccactacctattattttaatatttgggcctgccgtctgatgggttcttaattgacaaccaaaatccagaacacgcgtactattaaaaccattcctgcagaactgcagaaatattaaccaaagaagcaatttctggattgtatcttttttcatttcagtgtgagatggaaggcttctaaagtggagcagaatgcctagggccattttttgtcatgttgtcgtataaatagcattacacaatgttaaaaaaaaaaaaaaaggaatacatagttgagtcccactttaaggtgccctaatgtgctattcatttgtcttccaccatgctggtgccactttcctctaggtccctgtgaactgtgtaggaagcaccatgccaactgtgatttctgttgtcctttgcacatgatcgttttgtgtacagttaataatgtatgaaaataagtattgattgcattctttgtaggagaaggccagcagttttcttaaagcgcatgtttatgaaatgtttcattaatttctgttactacgcgttttgaataaaacaattgatgaggaagataccaggagatccctgaattccagagagttctcaatgaaaccactatatatattcttcttagcttgggaatggcaagtggcatttgaatggcaaaagaagtgatcaggctgaacatactcccaattcgaaatggttgcattccccatgatacttaaagagaagtaaaaataataattacagcagctgtgagttgcagcgagctaggtgttttatatgtcataacttgcttaagccttgttcagtagaggtactcttagccccatttggttggtggataagggaactggggctcaagtgagaaacttgtcttgggggcacatacttaataagtggtagagccagcattctcatccaggaaggctggcttcagaactcatgcagtagcacccatttgcatgtatgtaacatgcatgggagaaatagcccatgaaaatatcccatgaaagtgaagtgcacgaactgcataaaggattattagatattttttactgagtgatacatatgtggatatatgatgcatataatatatatattacattatatatgttacgtatatattacatatatacattatatattatatattttattaattttatatttattttattaatataatatattttattttattaattaatatattagatattattttattattatatattatatatgttacatttatacttattttagaatgaagagaagaagaggtaagtttttagagtctctatcagttttcagtttttcagtatgatagaattccatttctgccaaattcattcatcagatatttattaagaacttactatgagcacagtgggaggcccagatgattcagaggtaaataggaattgtcctctaagaattcccttttttgctttagagatagatataaacaagataaattatgatgaatgagtagaacccatagaaagctcacatacggccctatggtgggaataacggactggatggtgttgccggtcagagaaggcttgcaaaaggggacttttaagctggcttttgtggaatggataggagtttggtgagtagagctgaatggggagagcattccaggcagaggcaacagcctgggcaaaggcacagtgtgtccagggtttgccgtggctggagcagcaggtatgaggagtggtgtgagaagaactgagcagagaggcaggtttgtcacactcaggggcttgacctttgtcatcgaagatgggaaaggaagatggctaatttgtctcagcattgctgaaatttttagattgaatcgcatgaaattgccattttagtaggtcaacatggtagaatagcaacaatttcagacagttcaacttaatatagttttgtgtcataaaagcacacacaggggctctggatgcttctcgaccagagaaggacataagacctgctgtgggtgagtaacctctcatcatagaaggcaccttctgggaaaacaaaaaatgagcccaggagcactgtgctattagcctcagctccaggtggaaatggagcaagagcaagtgtgggtcaagttcaagctcctcccttccagttgcaccttcttgaggagaaagcatgcacaagctcggaaggcaaaggccaagtgcacagagcccagcatttaggtgccgagggcagggaggatagaggggcaggagtctctgtggcaggctggctgcatctccctgggtggtcctgggaaggtgtggtgggggcggggtggggggtacaggtaagcagaaagacagcagagcagacagggaccagcaggaatcaacccaggaagctgggtcatcctgaagggcctcggctgctaggaggcattttggcttgtggtaggagaaaggtggtctctgacaacggttcattgggaccctgtggatgctgagtggcatggctggtgttaggaggcctcccctggtggacagtggggatgtgcacagcatgggtccctgagaggatggctcccatctgcttttctgcagggtcccagccccaaccccagcactgccttttgtcctgggctcagggtggacttctgctctctcgcttgggagcagtggctcaggtgtgggtgcctggctccctaggcagtgttgtcctcctgcctgggagggatggtgctgtccagcctttctcagacctctggaaccgtgctgggtagcacccatttggaggacttgaggtatgggcttatttattcgtttattttgtatttactgttttcttcctctgactccccagtcttctgccttgcctagctgttttctgtgccaaattctcaactcgattcagaacatttcgtaagagaatgtctcaatgaaaactcaagtgttctaaatgaagggagttgtgttaattgaaagcagtgcccactcaccccagggagcacctgcttgaggggagaggatggggaggaagggagggagggctgggagtgcctatgcagctcacagagctggctcctaagaagctactgagccctctctgtgtgtcctaccctgcacccatgctatgttatgacattgtttttatgacatcaatggggctggggtgggaagaggtggtgctgccctttttagctgctggtgatccctgggaggaagggcaacatgttcccagggcaggacctaccgggtggaccctctgtattcatcccagagatagggctggcaacggggaggggcaggggatgaggtcatggtgatcccaaaaaatatatgtgctgcagagtagcacggtggcaaggagcaaaaaccttggagttgagcacacttgggtttgaattccatgttccagcacttagtagctgtgagaccacaggtaaatagttacttgcaacgttctaggtcctgtatgtgtaaatggggctaataatagtatccagttcataaggttgctacaagtaacacttacggaatgtttcatttgtttttccgccctcctgagctgtgcaggaaaccggtgggtaggtggatgactgccagcgccttcctttcctatgcattctcactccctttctcctcctccctcaatatattagcatgaaacaggaatagtagatgatttgagtgcacgcagatgtcttctgctctgaaaagaaaaacaatagccatacccgaaattccaattaccagtcagtccaaaacactgattttctactctacacttaagcagtaactcaggttttttgcgaactgactgtgtgccagggaatgtgctagctgctggggagatggtggtgggccagaaagtgcagagtgcaatgccatgtaaagaaggggagaaggagagaggaagagaactaggatgcaggaaggaaagttctggaaggggatggcagagaccggaatgtggggatgtggggagtggattccaggtgagctaacacatcagtggaaaaggaaagggcgtgtacccagccagcagagaaaattaatactgaatatgctagtcctgtgttgagtggatgtgaacatggtggaaacctagtgtttttttttttgtttttttttttcctgatgattctcaagaatgtttaaaaaaatgcaatgtttgcaaacaaagtagaaacagttgaagcattgttttctattagcagtataaggttcactggctatgggtattttttccttcttgctttccaaattgtaattttaaaagatgaggcatttcatattcaagagtttcctttgtctgaaataaattattcatttctactcagtttcagaaacaatgaacatatacttaatgcatcacaattaagcgggtgcagcttcacataaaattatgttccatgcattttggtggcaaacagagcagcatatcctatatcttgtcgacatttgttcctcataagcaaaatataaagaagtcgaagcccagaaatgtgttttctttcctctcatggtggaggggggtaactttagacccaggcagccttgtttttgacattccacagctgttggtggctttgtcagtctgtagagaaagtgaacttactgcaactgccttgtgcgtggggtcaggtgagggtcagaattcttgagcaccacacatttatctcagtcttctttgtctgggtttgagatctgtctagaatccttttgtggaagggcattgcctggaaacgacttcctttggggtttggtggcagctgtttttttgaatactagctggttggtcatgtggcggttttctgaggatctggccctgagatattcttcctgtgacaaggtttctctttaggaaaataggcattgccagcaaggatcaagatgtccgtggacgtccactttagtcttgaagatttagctatactggttcccaggagcattttttgggatgcctctgacttaagtcccagccctgaggtcagagtgaaagctggctctggttgccaaagggcagttgtcaaaggacattaattgtgaaatgtctgctggcctcccatcagtagggcaggagatgctttctttctttttttcttcttctttttttttttaatagagtcagggtctcactctgctgcttaggatggtctcgaacttctgtttcaagcaatcctcctgccttggcctctcaaagtgttgggattataggcataagccaccatgtctaaccaggagatgctttcataggctatttcttttttcttttcttttctttctttctttcttttttttttttttttgacagaggctctctttgttgctcaggctggaatgcagtggcacgatcttggctcactgcagcctctgcctcccaggttcacgaaattatcctgcctcagcctcctgagtagctgggattacaggcacctgccaccacacctagctaattttttttatttttagtagagacggggtttcaccattttggccaggctggtctcaaactcctgacctcaggtgatctgcctgcctcggcctcccaaagtactgggattacaggcatgagctattgcacccggtctcataggctatttcatttaatcttcataaaagcctgagtgttagccttgagtatgcgtgaggggcattattcacattttgcataagaggaaaccaaaactcatagaagtccagtgacctgcctaaggccacatagctagttggtggcaaatcctgaattcaagccaagtttgtccagctgcaaaggcctagccctttgcatgctaccccggcttattgcctttttgattgtcaagaacaaaagtagctagatgcaagatggatcctcagctacctctggcctaagcaccctttgtatttgaacagaaaaaaaattacatgctttttattttagagaggcttaggaagaaggccctggacttggccagaagttttcctggatgcctccctgtccttgaccctggtttctttcttattttttttttctcttgtgagagagagtctcactctctcacccaggctgcagtgcagtggtgcgatcttggctcactgcaacctcagcctcccaggttcacacgattctcctgcctcagcctccccagtagctgggactacaggcatgcaccccaacacctggctaatttttttatctttagtagagatgggatttcaccatgttggtcaggctggttttgaactcctgacttcaaatgattcacccatcttggcttcctaaagtgctgggtttacaggcatgagccaccgcaactggtcttgaccctggtttctgtccggtgcctgccctggctgactggactcactgcagagccctccaggtatcctggcgctctgtgcttccacttaggtgtccatgacctccagttctgcagtttctgtggcatctcttgctgtggtatttcctatgtggcaaaggcccctggggaattggtggatgaactctgatttttgcgaagccctcctttagaataggtccatccagctgcgtgctgggtagtcccatctagatatcctggccataactcaaacatagtctgtattgaacttgccttctcttttaatcttgtggactgaggaagaggcacattagaaccttagggagatgtttttatattggccggggggtgcagtgctatagcagaaaggatgtagatttggagtcagactaagtttgcatcctgacttcatcctttcataacttaggcaggttgtttaatacctttaagcctcagtttcctgatttgtcaaatgtagacagtatctgctgtgccgtgtcattgtaaggactggatctttgttatgagacagcatgttgaagcctatcccccagtcacagtgatagaagttcttagttaaagacgagaatctgtttactggcctcgagacattgcactgcacctgggaagggcaggtagtccgtgtgctggtccttccagctttccagggcggaagtggtgagggtgcgcgtttctgacttcgtggctgctctctggagactgctcagtatctttgcacatgccaccctgagatgcatgaccattgatagcctggtttgcctgtaagacaaagcagccccaccatgcagtaggcgccagctgtatacctcacttggtatcacctgcagccttgccagctgaggcagatgcacctgagtgtgagggcggcaattgacctgttcctccatgtgccctgttcctaccacctgaagggtaacttcattaagttcctacctgttcctaccacgtgaagggtagcttcattaagagaaagtgcagtcgaggtagatagaaacagcctctcagaaatggctctcatgcggattcggcttgctgctcgtattgtgggcgagccttggagactgagggaaggtgagtacttgtgagttcctaggcagagtgagtaccctgcgttgaatgtagaattttcctattaagagcagaacaaaacaggtttttagattagcactctgacgtgggctggaaatgcccggcaaatatttaccctagatgtaaaacactcacaaagtcaaatgttgtttggaaaaccctaaaatagaaaatttttactcagggttttatatttggtaattgtaaaaaaaaaaaaaaaaaaaaaaaaaaagaggcctattgttgtctgtgtcctctaagctggcttttacaacatggaatgacgacaaagcctcttttgccctccctcctgcccatttctgctcctctgcccttactcagcctcatgactgcattcccagccccttttcagacgtgtacctcctccacccatccaggtgactgtggcgtgttttgcttggtaagccctgactctgggcctggcaccatttcacctgcttttcctcttgaaactgagcctgggatgctggaattgacagatttgcctccccagcagctcccaggagtaaaggaactctactggctgaagtgtttaaactcctggaaggctggcattggacttgagatattctttgtatgcatcagacacctgagttagagtctctgaatgtcccattatacgttttttgctagacccttctgttcctctctggtaaagcagagtgtttggaccataccagtggttctaacctggcaacctcacacattttgtgcatcagtgtctcgtgggggaggtgtatgatattctgatacatccacccccactcttacgccagatgtgctgtcttgggtgaaaactgctgtgctatggtggatgatctccccaggaactttctggctctgacctgccatgtgctcttcggagctttgtcaagattctttggatgacttcttccttcggtccatcaacaaatgtctactgagccaactttcgtggactggacattgtgctagggtcctagggacattggcatggacaggatgaactcacgaaacttatagtctagtacaggaggcatatgaattaaaatgcacgtgttttgatagcagtcagtactctgaagaagaaaactgaccaatatgatacagaagggaacagaggggagaaggggacccttttacacgtggaaatcagaatgtgcctctctgaggaggtgactttgagctgggacctaaatgacaagggggaactggccattctgagcacctgctgaagagcattgtggcagaactccaaggaccccaggcgggccaagcctggtgcattccccagaaacagtggagctagtaaggtgggagcctggtccctttttaccagtgattatctccttccgctgccctgtgcagggggctagcaatgggaccaggccaccaccagggctcaggagggagctatggccaggggtcctgaggacaccaggaagcttcaaatccatggcacctgctttttgggtggtgggactcatgaactgtacccagaaaagtatctggctgcgtttcactatcctagaattctgagacatgagcaaaacagccgtctggaccagagactttgtgctcgagtgtgacttggaggggccagctttgccctgttgcacttcagatgtacgctttgaaaatgtaatccttaaatgatagcactcctctagtgctaggctcatgttttgtattgatttatctcattcttttaaaaaaggaagataattatagaatcctgatgttgaaagagtcttttgtgatcaccaagttcatcatcaagtccttacttgatggatggataacagaattaaagaccagaatggttgaggcctgtgttaggagacaaaatggggctagagtggggacttagcgccctgggtcctctctccttagttgacatacgtagtgtccacgtaggacaggcccaaagaatggcgatgccccaggagatgaaggttcaacccctgaatacatctgtactattgtcagagaaattcttaaagaatcaagtccttgcccacttttctggcctcatcaagccccatttcccatgatgggtcatagatctaaagacactctgcctttctcctccctagcacacacatctctcttgttctgcctcaaagcctttgcccttgccttccccccgtcatctggaatgtcctctatgatcttaacttagctggctcctctttgtcattttcaaccagaggtcttccataaaaaggagaccacttcgctaaatatcactccctcctcgttcattctttattacatttcctgtttcgttatctgcacagaccctaccactatcctcagctattttgtagatttacttgtgttgtgtgtctgtttctgtaatgttaggttgtgtacaagcaaggaccccatctggcttgttcaattttctgcacttgggtagttttcccaagaaaactatgtagtaggtgctgagtagatatttgttgaatgaatgaatgagtgaacaaatgcatagtaagtgagagctaggtaggtagaagatgcttactaaatagctatttggtgcccagcacttagttgaagcagggcagaggtgtacaggtcatgacatgagggagcctacggtcttgccagcgaggtacatctgtcaggagtctttctttcatgaaggacagaaaactcatctcaagcagacttggatgataaagaaaatttgtcagcacttaggacgtatcagaaggccagaagtaggacaggattctggcaaattgctgttaccaggaccatgcctcctggacctccagttcttggatgtgctctttgtgttgggggcgacatctgcagtgacaacagggtgggacctcccaacagcgccacactcgtctcttgtgttcagtaatggacccaagcaattgcaggcctcacagcctcatgtacaccatcctggactgagtacttggctgtagaatggtgaccaaagtcagattggcccctcccccatggagcttatagtctagcagaggtcagagacacaaatacatagaaaatccaagtgtaaaaagtgatcccaaagagaagcagatgatgctctgagcaccggtgatgaggcttagggtgggaagaatgttccagcaaaggaaaggccaaggttgtgtggggcaaaggggcgggccagagtggtcagtgtgagatgagaccggacatgtcatctttagctggttaggaactgggggaaggagtggggccatgtggcagccctggagctggcctgcagactcagcctggatgcctaaatcttggaattcaccgtggcaggaattgcagggtgtgcatggttttctcagcccactgtcgtcattgtcacatttgagaaggaccagctacacccatctggggaaaagaggcccttggagcattagtgctggtatgctagagatttaattcgctgcttttcaaacagaccccatgctcttaggccagccctttaaccgcccccaccagcctcagttttctcaactgtgaactggggttatggacttgttgcaggcctacaggagttgacacataacaaagtgctttgcaaactccacagttctaaagcaagtcactttcggttgttttgattttccttcaactgtgggaagagaatgaattcaagataattagaaacaatgagccctagcactttggaactggaagaagcctgagggaccttctagtgaaagtgcagaaggtgagttgtgactcgttgtggggcctgttggagatttgaagttgtctggagatcagctgcttctcctccctgagcatccccttcatgccctgtaaggctccagaaaaaggaacagcgctccctttcccgcctgattgcattgagcctggcatggtggaggtgcagctcaggtctagtgggtgcaggcctctataagacttggcccagcctcatagcaagtggcaggcaaagccccatgaacctgtgatctccagctctgaggctgctcccttgctcttaccttttgcccttgccacacccaggccacattctgcaagaagttcggggccacagatctggtcggattcagcctgtggagcacacagtcggctccccagttggcagggaattttggtctcatgtcaaatacccagaaagtcaagaggacagcaaacccctgtgtacccaccacccagaatgaaccaatgtaaccatttgccttttaaaaccatatcattttaaaacagaaactattacagggaaagctgaagtctccttaaagtatcatggcataagtgattcattctacaagtattttcagagtgccttctgtgggctgagtatattggagatatgatggggaaccagccattaaaagccttcaccctcaaggaggctgcattctatctagaggagggcagatgatacatgaatatataatgaaggtaaataggaggagggtagggggcagagagtgataggagtgggtactattttagatagaggaagtcttctctgctgagacatttgacacagtgaaatgaagttcccaagcttgtgaagtctcagaaagaggctttgagatggagggaccagtcagtgcccagcctcagaggtgggaagaggctggtgagtccaaggagcaagctgagcagtggaaatgcaccccagtaagtcagggctgggagagccagccaggggccccagcacatggccacagggccttagagaccacgggataaggactctggggtttgttccaaaactaatgagaagctctttgaaggactgggggttttgaagaagacaatgtcatgatctcacttatgttttagaagaatctcttaactgtaaataggcaagaggagaaatagcaaaagaagtttgttgtaacatcagctccagaactgataggggcttacacttgggttagtgatgagaagcagttagattcaagggacccacaggtcatactgatgaattgaggacatggagtgagagaaggagagaaaccagggatggcttctaggaattttgatgttgtcatttacctgggtaaatgacagtgccattttctgagatggggcaggggtcggggacaagaactatttttgcatacaggggtgtagacttagagttccattttggacacattgaaatactttttgtaaatctgaacatctttgcctcggcagagctgttgttcatgctatcctcattttatcttttaccatgtacacttccacgaacaatattccactcttgatgggcattctttgtttttgaaattacaaataatactgctgtttttattctggtttctctgtgcatatcgaggaaattgataattagaaataggactactgggttatgaggcatgcacattttatatttttttggtaacagctttattgagatataattcacataccatataaggggatatgcattttcaccttgttttgaaatccttcaaaattcacttttgctattaagtagtcatcctttaatttactaattgctattttgcttttaatttactattttaataacctgtttctttgcttatgcctccgtgttgagtgtcctttttgctgacgcatatcttttaatagtccgttcagtgtctagggacagtaatcactgtcttttttcttttccttttcgttttttgctaattactagcctatgttgtatagaacagttttaaatcaacagaaaaattgagcaggtagtactcagtgttctcatatactgtctgacccaacagtttctccatttatttatttagagacggagtcttgctcttgttgcccaggctggagtgcaatggcgcaacctcgtctcactgcaacctctgcctcccgggttcaagcgattctcctgcttcagtctcctgagtacctgggattacaggtgcccaccaccatgcctggctagttttttgtatttttagtagagacaggatttcactgtgttggccaggctggtctcgaactcctgacctcaggtgatgggcctcccaaagtgctgggattacaggcatgaaccaacatgcccagttcctcctattattaacatgtctctttagtgtggtgcatttgttacaattaatgagtcattgatgcattatcattaaccaaagttcatagtttacagtagtgttccctctttatgttaaacagttctatgagttttgacaaatgtacagtgccatgtatccaccattacagtatcacacagaagagtgtcactgccctaaaacctcctgggcttcccctgtttatccctcctcttctcctaagcctctggcagccactggtctttttactgtcttcatagttttctttttccagaatgtgatatggttggaatcatagaaccctacagactggtttctttcatctaataatatgcacttaaggtttctctgtctttttgtggcttgatagttcacttttttcaactgctgaataattgtgttccattgtatggatggaccacactttgtttaccaattcacttactgaaggatgtcttctttccagttttggctgttgtccgttttattatgaataaagctataaacatttgtgtttcgttttttgtgtggacctaacttttcaactcagttgggtaagtacctaagagtgtgattgctggatcatatttaaagtctatgtttaggtttgtaaaaactgtccaaactgtcttgcaaagcggctgtaccattttgcattcccactagccttgagggaaagtccctggtgctctgtgccctcatcagcatttggtggtgtcaggcttttggattttagccattctaataggtgtgtaggggtatctcatggttgtttttattttactttgtaagtccctcatggcatatggtgtgaaacatcttttcatatgcttatttgccatctgtgtatcttctttggtgagatgtctgttcagatctcttactcattttaaaaattgagtcgttttcttaatgtcacattttaagagttctttgtatattttggatacaaactcattttcagatatgtatttcactgggtcttttcagtttgaaaatgtctccatttggtcttcattcttgaataattatttacttgggtgtaatattctagtttggcaattattttcttttagcatttttacaatattattcaactgccagctggcatctgtagttgctgatagagtctagaatgtctaactattgtttctttaagctctctttttagctttctttctcatactttagggtttccctgttggcttatgtttactgatttcactggtatttaggtgtgatttttaaaaacattcctcagttttggcattaggtatgattttatttttcctatgtgaatacgtgtatttttgtttacttctggaaaattttgcaattaccctcttctaatacttctctattcttttacttctcttccttttgaacttctatcagacaaagcttcttcctctttattctatttccctcaactttggaatcctattttcaatttccttatttctctgacatacatttggggtcaggtgttcaggtctgtcctcctagtcactaatcctctctccttctatgttttgttgaacccatatattgaatttttaaaattttaacgcctgtatattttagttttagaattcctatatatttttataggaactttatatatttttatatataggattatatattaaattgttattaaaatttattatatattaaaattaaattaaattaaattttaattattaacattaaatgaaataaaattaaattttaattattaacattaaatgaaataaaattaaattttaattattaaagttaaatgaaataaaattaaattttaattattaaaattatatattatatattataatttttcttctttttgatgagataagtttctatagtttctattcctttatctcactgaaaatatttactataaggcagtttttcagattgatctgtaataaatctgtaatagatcaatagatccgtaatagatcaatctgaaagattctcccatatcttgttcatgtaggctctttcatgactgtttttttcttgtgtgttttattatttcaacaataggttcatctttagtaacagtgattttctctagtattcctacatagggtctttaaggcaaccttatgcagtcatctatattttctttgctgggcctttcatggatgctgggccatttttaagttaattcctcactccatggaggaatatctttgggaccccactcttacaagcttcatgtttctttttgtttcttgtccccaggccagtgagcagagatactctgagcctgttttcaagatatgtgtcttctgggctgctggttttatgcagggagctctgtgagagtttccttgaccagggcctgtggccatagtggctactctctcaaggccttgtcacagtggttctcaggacaggctgtacactggaatcaaatggaagctccagtgccctgatacctggaccccactcccagatatatattttttaaagctcctaggtgattttaaatgtgcagcccaggttgaaaattattgccttatagacacgtgcccagtttccctgtgttttttttttcttaaaaaaaaaaccaaaccctttttgttatatcacatttactattctctcttttttcttttctttttctcttttttggggggcagggttgggggaagattgtctatatacctgtatcatttccggttaccatactgaccagaagaaatgagaagtaccaaattctaaccagcatgcttagataaaaggattcaaatggaaggtttctacatgccttcttgggttattgaatacttcctgtgatttttaatttctctgtaaaagataactctttttttggcatcctccctccccacttcatttctttcagcatgggtgcttatcaaatatctttaattaaaatgaatttatagtttggggctgcattggagttagtggcattctctgcttctcctttgtgatacaaatatttgaatatattctatagctggagaatatattcaaaaataagttaaatttgagacgcataaatgtagtaagattttaaatgcaatataagaaatgacgtaaatattttccttggtgcggataaagtagatcattcaaaagtgaagctgaaaacaagtgatatttggaagggaggtagtttttctagctgatttgagaaaacagatggatatattaatttacttgactgttgtaggaatttcactatgtttatgcatatcaaaacatcatgttgtacaccttaaatataaaaaagaaagaaaacatatttgatggaaatgtggtttctgaagccaaaaggggccaatttgggtaaggactctgttattaaaaattctgtttttggccaggtgcagtccttatgcctgtaatcctggcactttgggaggctgaggcaggcggatcacctgaggtcaggagttcaagaccagcctggccaacatagtgaaaccccatctctactaaaagtacaaaaattaactaggcgtggaggcgggcgcctgtagtctcagctacttgggaggctgaggcagaagaattgcttgaacccgggagtcagaggttgcagtgagccaagaccgcaccactgcactccagcctgggcgacacatcacgattctgtctcaaaaaaaaaaaaaatgtttttatggataccttctcttctcaaaatcaaaataggagttttaaggaaatgatttagtgtatattgtttagctttttgggaacaaattatcgttacctgcttatgtgactttttatagaatgttgcgtttaaaaagaagtatctctgcttatggtcacattttcaaaacaggcttccaaaactttaaacttgaagccagtctctgctgagttacatctgcacataattgtaaccagagacacttgtctccctaaatatgcgcatctgcaaataattgtgctttcaattgccaacgcacagggtttcagactgtgtctaaacaagaatagagagatgaagcagttatctgagtaattccagccgaaaaataagaatgcccccatattatatcttaaattttctgggtatttcagttgaggggatgttttgattaaaatcatctgggtaactgcctgagttttctacttcattttgcatgtgtaaacacagctgttttatgattgacaactttttttttaatagctgccttttggaaatgaccattttttcaagaccacaactcttgcttagggtttggcagctcactttcaggatccttggctactatgtgctgccttccagtaagaatggctgggtagcaagttgattctcctattcttagtgttgaaacttccttctgcatttagtgatatttctagctagcctgcagaacaaatacatcagtagtccagccattgcagcccaatcctgtacataacaacaaaagcgtcagtctccacctgtgtctgaaaatcacaagtagcatggcaaatgcttccatgtttagaaaaatatccaatttgaccatcctatcagttccagatgaacctctgtttcctgccaaagtggaacttcagccagtgcattttatttccattcccaaactcatctgcatcatgtggcaatatgtattaatgctcatcgagctaccacttggatcaggtgaggatgctcatgttgggaaggaagacattgcagagacagtcagctcagaggcttctgagaccacgcatttttatgtcaggatgaacgaagcagcacacgaactgtgaagttgtgtggttgagatttgttttgacagattcggttctccaaagcctctctgttttctcggcttcttccaggaaatttgaaatgcttgcaagatagttggacgaaagtatggggaccatgaacctcttggtgacaggttcttggacatgtgtgaattggttttctccccatgttgttggttttaaaagttctttaagttctggcaaaacacactatcactattactggcttgcaaaaacacacgttttagaaatctaatgtattacgaaattctaaattatccactatgtgaaaatacatgaatcttaactaagggcttgtttttgaggattgagattcatctattatgcactttagtacattggttgagagcttaaggtctggagcagatgatttggtttcagatgtcaactctgcaagtcttagctgggtaacctcgcaagcctcagtttcattctctgtaaaatgggatgatcataactacagctacctgttaggattgttttgaagattaaaattcttagtatcatccctcacaaagagtgtgcaccctgtgtgttagctgctattcattcgtttattcctttcagtctgcagatgtttgtcgagacagcccactctatgccaagcactgtgtggaatgccaggtggctaagatgcgtacggtttagtttccctccttcatcaggcagttgaggggcgggtgaatgggttagagagttaactgtgatgccatgttggagggcagatcatgccgcagttcttaagacataatcctttctagtcatttcccacatatttaagggccttcgtttcactccgcccaagtaaaaagttcaaaatgattcattttctctttagatgctttgttttttgagaaatggtaggactcacacccttcaaaagaaatccatctctagaaaatacttctttgcgaatgtgattttgttacagcttatgagaaagaaactagtcagtgggtgccaagtatttggtcttaattttcactgcatagggagatgggtggagcgccagctgagctacaggaagggtgaagctaggatgaagttcagccatggagcacggcgttgagaggtcttctcttccagcaagaactcaagccgtggagtagttgggtcaccataatgggagtaggaggctggtgccttaggtcagcctgtggaacaacagtgggggctttgtcctgaggatttaagattataccagctgctacctaaagctcaacagtcacttgaattttcttggtggcttgatgaaccagatatgaaatttgaaaatgcaatgatttccgtttttttaataatacatcatagagaaatcgacgaacacctgcttgtagatatcctttctccctctgtgaattgctgtgatttcctggatccagttaagttctgagggacacgttgtaacctttcagtctgatgaacctccactggtgtaacaaggagctatgttaacagggcgctattgtgaacatgttcaaaattgctttgatagttttgctcaaatttaactctcaaaaattttggtaaatcctaggagactcagttatcagcttaaggtttttgttgttaaattttttaaaaacccaagtataaattatcttttgatgaagatcagcagcctccttttgttgaagatgatacgtgtctatcacaagataaataataattttaattattactgtggcatgggaaactactttttaaaaagaattccattctaaatgtatgacagacaaaattagtgtttaggaagtactgaaaggaattcattgttaagttacgttcttatcttccattttatctggctttctttatttaattgaatgttattattttggacctcataatatttgctgtgggtagaataacaataactcattagattcactgcctctgcgtgagatcaataacaaaatttccattatttattttcccaaaagacctttagacactgtacttccagcatggtataaaggaaagggattttataatgatttactttaaaaagatttttacttctgatatatatccggcaaagccccgcttgaatttcactgtgataataataattataaaacaaaaatgtcaaggaattgttccatcatgatctgtattttgactatatatgagaaatacaagtcatgcaatgcctaacagtgtttagacaccagctttgaacagaatttatcaatgtgttaggaagaaccaaaaatataaacattttaaatgaaaactcacaaatgaagatgagatttttgttcgttaattggctagctgatgtctttttctctgtctctggtcaccttgggaaaaatgcatgttcctatttgcttccaatatagctggacatggctgatgatactcttgctttgagattcctatttcacgtatttcagtgtgaacccagtcgagggaactgaaaaataaacatacaagctttaaaattttctcactttagggaaattgcaaatgctatgctaatcctatagctaataagccagctttcaacgtgggcaaaaattacagattttttttggcattgtagcatttaaaaaaaatgaccatttgttttgcatgtcaatagttgaaagttaaacacggaagaagagatttaaatattctctcttggagaaatctgtaatatcccatagattttagattaaatggattagattggaataattgcagaggacattattccttcattgagcggattacaaccaattaagtcgtaattctgaggccttgttaaataaatattgcttattatccatcaagacagcaaaacatcagaggaaagatgggtgtgcattttccgatcagtcccttgttctctagaaattccatatatatggaacattcacagacaatgtggacagggaatggtgtatattgcatgtgtaaatatatgtgacgtgcacattctgagttgttttaagtctggcccttcggaaggcaggccttccatgtctcttgagggtcttggaggctgaatgcagatggtaaagtttgcattgttcttctaacacttagaagtcagatgaagtaaaacctttctgataccttgcgaggtcactgggaggttacctggcaggcggcgttccccagggcctgccacattgaaagacacggctctcctgttgtcaaacgctgcaccttcccggcagctgcgcacaaaagagcctgtgaagaaatcagctgggtttgcgtgcacttaaagttgtatataattccggtgttaaatttattggaagactgagcgtaatgtaaaacacagagtaaaaacgaggctccgtgtgtcagctttacggcgcatttggaagcagttgagggttttcagagtctgcttggtcgaggaagagctgtgctgcaagcccccaagaaaggagtgaaagttggctgtctaatcagcgctgatgctcagcttggatgtgtccctgtgatgcctggaggtggaagcacaggtgttgtttgcccctaggaacccttttccccacttccttgtgacctttttgtgcagagctttggtgcttttggccagcaaaggcaaagcttgcatacattctaggatgtcctttatccagggcttagttgggattaaataagtatggagaatcagtaggacccaggtctttgcaggatgacaaatggctgaaaactttgttctactgctttgacaggcaccatggggggtgggtgcctatggatgtagctatctagagaagaagaacaggaagtatcgaagaaagagagcagagtcgttcttcttgcttttttttttttttttttgcctttagtttattggttcattaatctattcgagtatgtactcagtgtctgctgcataacaggcatcatgccaggcagtaaatatagcaaattgcttaagagctttggctggaatctaacccacttcagcctcaatccttcctctgccacatagcagctgtgtgactttgcacaagacacttaacctctctgagcctcatttttctcatctgtaaattacagtaacagaagaactcatgtgttcatcatcaagaggtgtggttaaatgttttatggttcaaccagagagctgaatgctacacagctgtataaaggtatgagatagctgtctatgtaaagaccttcaagataagtgaacatttcaaagtgcagagcagtttgtatagcttgctaccttttgtaaataaaaaagacgcttatgtatacacaaagaaactatggatggattcataagacactaataataatagtaattgtatgtgaaggcagtgtgggaacctggcatatgtatagtacatatattacatgtagtgcatatacatatattacttcttataaaataatgatagcacagttttgcaagtttgttgtgactattcaatgagataatgcactttaagttcttatttgaaggcctggctcaaaaataagcatgcgggttacatttttgctattattgttgtcctggtagtattgaaacaaagttgcatataagaagtaaccttttcctgtttagtggagaagacagataatcacaggatctcaccaaggcggttgcagaggaagagacaaaatgctgggggagcccagatgaggttgtaccccagcttttggggggaagacaggaaatctttctgtgaggtggtgaatttccattctccttcttcaactccattcttggttagataaatatgttctttaatcctaacagttaccccttccctcatatgagagacacatggtatatgtttaatttgtatatacattaggggtttattcaatatttttcatcagttgcctgcttctaatctttttctcttttttctgggtctgttttttctcagatcgcctgcttcctgggaggcagggaccatattaatttagttcttattcacagtgttttgttctttctgggtgatttttataaatatagaacttttctgcttttgcatatgagaaagtcctggtaacctttttgagcatagaggggaaattttccacctcaggcacctttctctgctgaaagggggttgttgtttccagttctgtggttcctggcagaggcagtgtcttcagggcctataggaagtgatttgggcagagcaaagctggcgaggcatggaagggagtgcaggtcccccttgggcaccatgggctggggttgttatcctcagagggcactaggggttgtccatgttcagggccagttggttatgtgcttgtagcaatcgccaaagcaagggtgaattttagtcagaacagaggtggcacctttgttgttctcctccttgaattcttctgtcattgtgctgagggtagtgacaaggctcacagagataggctgtgtcttagtctgtgcaggctgccataacaaagtaccataaactgggtggctaaaacaatggaaaattatttctcatagttttggaggctggaagtccaagatcagtgtgccagcaaggcgaatttcattctgaggtctttcctacaagatggcggccaccatcttgctgtgtgctcacatgacctcttcttcatgtggactcagaaaatgagagataagtcaagctctctcttatccaatcttgacggccacacccttatgaccccatctaactctaattactgccgaaaggctccacttccaaataccatcacattggggttagggcttcaacatatgacttaaaagggggaacacagacctccagtctgtgacaggagggatggggatttgtcagctttagggaggggcatttgctggagctgaattatggtggaccaccccccacagtctcaacccaatgtggggcagtcacaggcagaatcttccaggggttgggggtgggtgatggtggtgggtggtgatgatgggtgatttcttggtgcttagaggggcagcagttttggtgcaggactttagcaagggatttggatatccaatcagatattgtcaataccgttttattcattgttaggcaaagagggaataggcacctcaagattcgtttcctgtgaaaggaaactcataggtcagaaaaccaaacttcaacagcctaaaaatactctagctaaccataagttttgggcaagccacagtggccatttcagccacatgtgtcttccctctgtctggccttggcaaactagcttcagggatatccttgggttttgttgctcgctgagagaggcacagatattcctgactcagttgatctggtgccacattagtccattctcacagtgctaataaaaacatacctgcgactgggtaatttataaaggaaagatttaattgactcacagttcggcatggctggggaggcctcaggaaacttacaatcatgacagaaggggaagcaaatacgttcttcttcacatggcaacagcaaggacaagtgctgaacaaaaggggaaaaagcctcttataaaaccatcagatcttatgagaactcactcactatcatgagaatagcatgagggaacccccccacccatgattaaattacctcccatcgggtccctcccatgaaatgtggggattatgggaactacaattcaagatgagatttgggtagggacacagccaaaccatatcaggtgctcacatattgagagtgtcccagttctactccagattagtggcacaggtctatgttccaccccagagctctgtccagtagccctgagtggtacattttttgtatatatgtaatgtaatttacattatagaatgttcgcatatactagagaaacattaagaggccaaatgtgctgcccaaggccacggagtgatccaccagagggccgtgactaggtttacagtcccacgtctgtgatgagttggctaaattggatccaaatgaatggaccttctttgagtgaggtctcttttgctgtgtatcctaagttgaagctatattctatggattcaaaaacacctgtttcaggtgaaaaacactggctgcattttaggattctaggccctgtttcccctcaccagttggagctggtttcttctttacacttgtcccttcatttcactagatccccaagatgctgtccagttaagagtaggtttgactcaagccagatgagaattgaataggtttccatatctagtttttccagggactttaaaagtttcactgaagggggaaaaaaggcaaactcttctagctattttccttaaaaaggtaacaacaacaacaaagacagttgagtagctgagctctgttctgatttagcacaaaaaacctgcatttatcagggttgtaaacataagtacagttcagccgtctcccaaagagtagagagaatttgaaatgctcattcaacccaggggctgaggaaagagaaaaaaggaaccatatccaaaagtgaattgatttgcagctgcctgttcccgatatccctggcaagaagcatcaattatagtaaatgacagagtctttcccaaagccatattcagtggagtctgaggaaaatcatttgtttttttcccttttatgtaagatgggcctttagacataatttgtattggggggaaacatcaagtgtgtttgttaaaaggaatcaggcaaagtatttacatcgcccagtttggaaagaataagccagttgagcagaacagatgaccttgaaagaggaagatcctgatagatggggagcacctgatgagtcacagcactgcggggagctgggacagctgactgagggaagtaggcaggctctgcctccagggagcttctagtctaccaggccacaaggagagtgttggggagggggccatgggctgtgggtgctcaaaacaaggggccttgcatccaggctggaccaggccaggctgcaatagtatctgcctagggtgtctgtgcaggaaatcataaacttgattgctctgagatgctgggaattaatcctgagaactccctaaggcagggaatccttatattttaatatgcttacacatttccaagtgtactccgaaagctgattaactcaattaaaaaattttttttttttttgagatggagtctcactctgtcgcccaggctggtgtgccatggtgcaatcttggctcactgcaacatctgcctcccaggttcaagggatgctcctgcctcagcctcctgagtagctgggattacaggtgtgcgccaccattcccagctaattttttgtattttaagtagagacagggttttgccatgttgaccaggctggtctcgaactcctgaccgcaagtgatctgcctgcctcggcctcctacagtgctggaattacagatgtgagccactgctcctggcccaaacataccttttaaataacaagaaagaagtaaaggtggctttttagaatcctgatttaggcctgcacttaaaataacttgttctttggcctgaactagcaatctatatttaattaaaggtcagagatctctgtgccccccattaagtgttcccaaagcagaaaaacacatgagaagtgggcttccctgcagttatctctgaatgggcttatcaaagacggggcctcagcctggcaacagtgcttagctggagaccctggcaagatctgaggttttggagccctggaattggaggttatcacataacaattctgattgctttttaacacctctgaggagtttaatgattaaaatatgttctacttcagaaaacttcagaacaagctgtaaaaagtaatttgcaattctccttttctctctatctatgccgaatgtggtgtttaattactccataatagctttttgttctggtgatttgttacaaaattagacaagccctttatcatcattaaacaccaggattagtattttttttttttttgtatgaggaaacattcaagtatcttaaaaggttcaaagaaaaatggccgagaactttttttaggtataaaaatgtaaacacaatgcctcgatatttacaataaatggattcattcaaatggtgtatatttaaagggaagtcgaggcactaaaatactcatcttttaagatcacccaactgctatttctgagacaagattctggagggatgccagattacaccctgtaaggcatattccttgggaggatgaaatcactggtgtttttgctcacattaattctgaatagtatggaatatgtttaatttttaacatgtttgttttagtaggttgcagagtccaactatccaagtatggatggtttgacataaaagggcggcactcttacctgaaactctcaccagtctgaattatcagattttttgttggagagaagagaatgtaagccattgaggaagaagaagatgatcagtttgcttctcctttctttctctcctctttgccctctccatactgcgctcttaatttgatcccaggaataacatctacttgttcaactctagacagggctatattttaaggagattcttctgcaatagtcctacttgccgaaggaagtgcagttgattcacaacttggttgaattcgttttaaataagcttgtgtgcccgggtcgatttaggtgttgtgcaaatgtgaagtaatgcctgtcacagagcattagcttttatattgtagttagaatttaaatttatggtgtattacaacagattatttttcttcactaagcaggtgaatccggaaaaggctggcagctgtttttagttaaaacaaaagacaaaggtctagaatttgggaaaaggaaaaggagaatgctttttaagaatggaaagcattgtttaatctaaatctaatgtagaattcagaaaaaaagctttaccttggatttacctaacataggtacactttaaaaaatgctttgtatcgattatataatttgaattcaaaatgagattcaagtaattttaggaatacttatccccatgccttatatgaggtcatttttctgtcttgtgtataaatttatgacttttaattataacattttggaggaagacatgatttgagccactatttagtttaaccttatcatgtaagacatgaagaaactgaggctcaggaaattcatataactgaattcatgacacagagccagcctagaaacctaggtcgtctgtcagacctggctgactcctgggacaaagtcattaggacaggtcttgtgcctggttggtcgtcttctcatggacccatctgcccctgccaatccctgcatctttttcaggcatcggcttaaagtccagctgtgaacatttcacttctctgctaagaagtgttcatgacccctcatgacacgaattcaaaagatgtagtaatgttttttaaatagaaaataaagtctcaactttccttaacatgatattcaaagcccttttccccatcagtaagctagccctgtcctacccacctttccagattcctcctcattctcttctctcctaagaacactgggatgctccacccatccagagatgttctgtctttccacagccccatattttccttctgcttctactttgagtgttcctcctctctggaacttattgaaataattgccatggttgctacttatttccataacagtttactcactgatagctttgataaagcacttattgtttttcttgtgttaaattgtctgtgtgtgtgtgtgtgtgtgtgtgtgtgtctgtccacatgtgcctagtttctttaatagaagggggcactggcctgtttgtacgtatggcctctgtctaacagttgctcaataaatactttcagagttgaaaccagtcttgtttatatcattgagaactcttccctacactagctggaaaagctagatttctactgagaatagacttgtaacagcctttatatctatatatgtgtgtgtcttccctgtagcacgtttccaggaacttacgaggagcagataatttccatcttggaaagccactcaacatagtgagaagagcttggcctttggcatgagagagactaatttggaatccagctccttcatttgctatcactgtgatcttgaacaagttgtcagcgtcagtttcctcagctctaaaatgagataacagtactcatctttcagggatagcataagaattacatcagaaaaatgcacgggaggtgcttggaatagaggagccactaagaccatcacgatgtatcaggtatccttttggttaggaaccatactttggacagatttccaagtcctcagataccctgtttcctttttgatgatgccctttgggttgatgagattaaacactgctgagaccttcagaaagtggtcaaatgggtgggtgattacgctcttggatggatgctatggtaaaatagaaaagggtaacaagaagctctttgggaagcttgaatcaaagacacagcagggatttgctcaggtaacaacccagggaaacccatggagaaggaagctccccaaggggtgcctggtaggaatacatgacaccgcagggcagtctcctttccaacacgactgcctgtaccaagtgagagctggttaaaataaactattttctcatctgtcagtaaaaggaaggagaaggaggcccagccatccctcccaccacccagccttccatcattgactgagtcccaacagtgtaacatatttccttaaaatgtcgatgtattaggggaagggcagccctacagctgactgtccacatggaagcatcataggtctgttttaacctagcaggggagccacctcctcaccttcatgtgctccaaatacctgttcttcatagaacatcatgcagctcctaaggaggggtgggaagggttgcactcttaggaataagattctgggaacatcacccttcatttcccttatctccttccacctgagaagagttcttgctgatgctattgttggtattggttgagccccagatgaaggaggactgaggattctgtagggcctacaagaacaaacagaatttcagtggcccagtgctttgatgcaatttgtacttgcagtctcatcttagactgggtcattctacagaaatacttgagttttcgtttggataaaattgactagttagttaagctggctgtttttctgtgtaatcgctttccttgtcacttgccctcattgcctcaccaccccactgtttggttgtgtataaccagtgtattaatttcctactgcttctgcaacaaattaccctaaatgtagtggcttaaccaatacaaatttattagtgtatagttctgtaggccagaggtccaacatgggtctcactagactaaactcgaggagtcggcaggactgtgttccttctggaggccctggtggagaatctgtctccttgccttttccgttttctagaggccacctgcctttctttttttttttttttttttttttttttgagatggagtattggtctgtcatcaagtctggagtgcagtggcgcgatcttggctcactgcaacctgcatctcccgggttcaagcaattctctgcctcagcctcttgagtagctgggattacagatgcccaccaccactcctggctaattttttgtatttttagtagagatggggtttcaccatcttggccaggctggtcttgaactcctgacctcgtgatctgcccgccttggcctcccaaagtgctaggattacaggcgtgagccaccgtgcccggccccacctgcctttcttgacttgtggcttccctccccatcttcaaagtcagcaacacagcatctctctgacccttttttcaccattgtaactctctgggggaagattatccaactttagggattcatttgattaggctgggcccacctaagtaatacaggaaaacatcctcatctccagatccttaatttaatcgtatctgcaaagtctcatttgccatgtaaagtaacctcttcacagattccagggattagaacatgggcatcttgggcagggggcattggtctgcccaccatagccagaaatagagagtgggttagacttcctggccatcttttggagcaatcctggctgtcttcttaggcatctccagctggaagatgatgaagacacctttaaacttccttatcagaagcctccagacttttggtttgcagtgacattttcatcataattcccttaactttccaaatcacaccatgctggcatgcaaagccagccaattgcttactgactaccaggcccgggagataatggggtggtgggaggagagtggaaaatgagggctttgattacccaagccctgaacaagtccatctagaaatagccatgttccagccagttcttttgaaacgcgaagtcaggtacattttgtaacaactgctataagttgaagatgcctcaagccacaaactggctccagaaatgagctttgttctttacagcacactttgtccaaaacataggcactttaaaataacttgatagcctctaactgaggaacattccagagggcagagattgtggtatatcatctttggatatgcccagtactgagcaggttgcatggcccattctaagtgccacaacaagcatgatacttggtacactctcatttatgagcatgtggagaaaatggatctgacatgacaggagatggaattaagctctgtttcccacctgcacccactgtgtgtccagaagagattaagaactcttagatatcttgtctgtgtttccataatacacagaacagagatgagccaatgacactgccttctacttcagtttactggagatgctgaacaaaagtagatacaggaatttaagagtgtctcatttgagaaggcaggatgctagttgatataaatcactctaatcttctattcccacagcacccagcagggaataatgtttgtagaaggaaataatgacaatatagctctgtgcttattaaaggcattagctttgggatcaggcaaatccaagtttgaatcatggctgtgccacttgccagcaccatgacgctggccacattacttcatctccacttctttcttagctccaaagaataagtttgaaaaaggcagtaaacatagttccctgcgcattggctggctacagaagcaacctgacagtttggtaggggttcttggcccagctacttaatgataacagtttgatccctagagcctgccacatctaaggtccatttctgtttcctctctttgggtacagacatacctgtggattctttataaagttccagctgggccagaggtttagagcttgctgctgtcctataggccctgtttgccttgccctggacatgtggctcaaagagtaatttagagcaggagttcccaaccctggacagtaggaactgggctgcagagcaggaggtgagtagcaggcaagtgagtgaagcttcatctgtatttacagccgctccccattgcccacattaccgcctgacctgcgccacctgtcagattagaggcagcattagattctcataggagcgcgaacccttttgtgaactgcacatgagagggatctatgttgcgtgctccttatgagaatctaatacctgatgatctgtcactgtctcccatccctcccaggtaggaccctctagttgcaggaaaacaaggtcagggctgccactggttctataatacattatggtgagttgtataattatttcattatatattacaatgtagtactaatagaaataaagtgcacaataaatgtaatgcactttatcacccagaaccatccccccactcacatacaccccctgcctgtggaaaaattgtcttccatgaaaccagtccctggtgccaaaaaggttggggactgctgatctagagaagcagaagcaaaagcccctctgaaccatacagagctcacaaatgcggagctaaagggggatgccctcacggatgacatgcaaagccgcttgtcgatgaaatcccttttagcagaacttccctttctgtgaatagtggtctatcatctcagcctcatctttcatcattttcaaaaggcagccctttgatcgtgactcttcgagggtgcagtcatcgttttctgagcctggcttatttgggaaacatttgtgctttgtaaggacttgggacatgccagtatttaaaaggccatgccgaccatcttctaccctagttcaaggatccagttggcagagggcagcaaacaagggactgtttgtgcctccgtaatcacagagcagagggcattttataactgctgagtggacttcaaagttaattaccattgagaagtctgaataaagtacccctccaaaaccttggggatcaagaacatttcatttatttatttttaaagatcagtactagatctgaaagtactttaaagatcagtactagaccagcactgtccaatagaaacataatatgagccacatctgtaattggacattttccagtaccacgttcaaaatatagcaacagcacaggtgaaattaattttaatgataatatttaatttcagtcgggtacagtgactcacgcctgtaatcccagcactttgggaggctgaggcaggtggatcacttgaagccaggagtttgagaccaggctggccaacatggtgaaaccccatatctactaaaaatataaaattagctgggtgtggtggtgggcgcctgtaatcccagctccttggggagctgaggcaggagaattgcttgaacttgggaggcagaggctgctatgagccgagatcacaccactgcattccagcctggacaatagagcaagactccgtctcaaaaaaaaaaattagtttcacacagctcattcaaaatatcattttagttttttttttttttttttttttttttggagacagactcttgctctgtcgccaggctggagtgcagtggcatgaccttggctctctgcaacctcaccctcccaggttcaagcagttctcctgcctcagcctcccgagtagcagggactataagtgcgtgccaccacacccagctaatttttgtgtttttagtagagacagtgtttcaccttgttggccaggatggtctcgatctgatgacctcgtgatccgcctgccttggcctcccaaagtgctgggattacaggtgtgagccaccacgcctggccccaaaatatcattttagcatgtaatttaatataaaaaattatgaacaagcaattttaccttttttggtgacctaagtttttgtaatctggtgtctgagttttacttagatcatattacaattcccactcaccacttttcaagggctgagtgggtacatgtggctgggggctactgtattgaacagcacagatgtccatagaggcaccaggctgtgaccccctgaggagaggagatgctgtctttcatctgagcatagttttctctagctatagtgtctagcatttgagtgtgttcttcagatgtgttcataggataaacagctgggtgcatttgtgagattgacttgcctagctgtggctcagagaggcaggggttgtcattcctagtcatttgaaatgtattcacaacccaggacttcacacactgtacaattcacccatttaaagtgtacagttaaatggattttagtatattcagagttttctattcatcatacagtcaattttggagtgttttcattacctccttaaaaatctggtacatccttagctgtcaccccctcatccccttcacctctaggcaaccattactctattttctgtctcttgatttaccaattctggatatttcatataaatagaaccacacaatacgtggtctttgtgtctggcttctttcacttaggatcatgctttcaaggttcatccatgttgtagcatgtatcaatacttcatgtcttcctattgccaaatattatttcattgtgtggatgtgctacattttatttatccattcgtcagttgatggacattcgtattatttccactttttggttattatgactaatgcttctatgaactcttgtgtacagatttttgcatggacatgttttcatttctctcgggtatatacccaggagtggaattgctggatcatatgataaactctatacgtaactatttgaggacctgccagactgttttccaaagtggctataccatttgacagtcccatcagcagtgtatgtgcttccagtttctctacataatcaccagcacttgtcattatctttttgagtatagccatctctctttgtttgtgcggctataacaaaatacccaaggctgggtaatttacaaagaacagagacttattttctcacagttctggaggctgagaggttcaagattgaggagccagcaggttcgattgcctagtgagcgatgctctgtttccaagatggcaccctttattgccatattctcctgagggaaggaatgctgtgtcaactgtgatgcttgaagaaatatatatatataaaggacaattaacattttttaagctctgtaagatgctggaatccctttttttcagggaactcctggcaagcctgccacctaaattcttcatgaaaatgacatttatatttcatgattgtgttgagtcagtgaatgatatcatacagatttaaaagaatcttaaactgccagatgaactttcccttctattttgcaaaggcactcagtggggtatgaactgtggtaatcacatttactgcttgctgactgttcttcacaaggagggaaacatttttgctggtggtcctccctgtgtacagccgccaaggtttttgcaaggtgttctcagctctctggttactctccatttctgaaatgcttggcttcaatgtagaggagcccagcccagtgtgcggtcctgccatgcacagccatgacatgggacgatggagagagaggagccacataggctatctaagcctgtaagtgggtgactctagaaaatgtactaccttctggcagaaaggcctgtgctctgaaagactgatgaaatacctgtagttcacatttaattacttgcttccaattacctctgaaaatactagcatttatgtgatatagagtgtaggataatatgtctggttttagtatttgttcacatggtaaacattgatcctgcttccagagaaacaaatatgactaggagaatatgaatgttctattgctagagatgttctctcacatttttttcctggatgatgtcattccgtgctggggggctagtgggtagagggagtgggctgtgatattttgctgcaccctctgattttttatttttgagttttagaatccaggcaagtatagtcattcctcagtatccacgggctattgattccaggaccccttatataaaatggtgtgggatttgcatttaattacttgcttatgcacatccttctgtatagagttaatttaaataatctataggttacctataatacatgatacagtgtaaatactatgtaaatgttgttatactttattgtttttagtttgtattatttttattacagtattattaattttactttttattttttcaaatattttcaatccgtggttggttgaatctgtggatgcaaaacttgtggatatggaggtctgactgtatattttattcatcaggacaagcacagttgccagcatgccaaagaatttggttgatcttgatgatatcctgcaacttgatttcttataaatctctgtctaattgcctgcttctgtgaagtgccttctatgtgtcaggcgctgtgtgaagtctttattagcttgatttcctgtaatcttcacaacagccccatatcactgttgccccactcaatcaaacggagatgttgaggcttagagcagaaagattgctttcccagtggcagagccaggatcaaaatgcaatccatgactgggaacggtggttcacgcctgtaatcccagcactttgggagcctgaagggggcggatcacctgaggtcaggagttcctgaccagcctggccagcatggcaaaatcccctctctactaaaaatacaaaaattagccaggtgtggtggcgggcacctgtaatctcagctactttggaggctgaggcaggagaatagcttgaacctagaagacggaggttgcagtgagccgagatcacgctgctgcactccagcctgggcgacagggcaagactttatctccaaaataaataaataaataaataaagaagaaaagaaagccctctggctgctgcacccatatgtgcattgcctgcactgcattacctcccacctggctctttccccttctaccgcctctcataccatccttttcataaacccaagtaggatggccctggatcagggcagctgcatagatctttgcagctcagtcatatttccttgtattgtattgttctccccttccttactctcttcttggaattctcattttttaatccagcaggacgtcctttccccatgtccttaccttaccttaacaattgccataaacctattgaaacagttgcaatattttagaaagagaatttgtaaagttttaaaaaagttaatgtgtatctaggcagtctctgcaattggacccaaaatccacagatagaaaagttacagaaaaaaatgtggctggggatctagaaacatggggattattatattaaaagtattatgaacacagaccaggtgcggtgattcacgcctgtaatcccagcactttgagaggccagggtgggcagatcacctgaggtcaggagtttgagaccagcctggccaacacagtgaaaccacatctctgctaaaatcacaaaaattagctggccgtggtggcacctgcctgtaatgccagctacttgggaggctgagacatgagaattgcttgaacctgggagagagaggttgcagtgagccgagatcgcacccctgcactccagcctaggcaacagagtgagactctgtctttaaaaaaaggtagtatgaacgtgaattctcttctctctctggggtgtcttagaagggacgaggcatatttatttgttccttcttccttccacacgtctatcaatggtgtattcattgagagacagtgtagcaaagtggttaagagtttggattctgaagccagactgcttgggttgaattccagctcacttgcttccctttgacctttggcagctttagttaacctttgtgggcctgtgtttctttatctgtaaaatgaagataatgagaatagctaccttttagggtgactgagaggattcaggcagtctatgtaaagtatttaaaatagtgcctgatgtacagaaaactctgaaagcatattagttattattaatattaataagtatcttttatgctctaatattctgccctgggctttgggactacagtggacagaatgtccctgacatcatggtcctttcagcttagttagagagaaagagagagaaagaaaataacaggtgtatgttagggcaccaaggagatgtacagttgatttgggagcatatagcagggagttctaatgaaaggtcctggtagtgttcattatagttttagaactggaaaagattgcagctattttcttgtcaatcgctcctttgaaacccaaagtgcttaaatgatttgtttaagttccttcaggtgatttatagcagagccaggccagaacctgtacctcctaaaactgaggtcaagctagagtgtattacatcatcaaagctcctcctagaagccttgggcccatttcatgatgatcaacaatgcttgattttagaacagcttcttagaattcaagcttgaattgtctctgactcctgggagctgtcctgatggttatttgtggcaagcatcaagtaatgatcattatcattgtcttctgtttactttgaagttgtccatcctgataatgatcacctggtaaagagagagatttattctgctggacatttgtaaacatccagtttgaattttggaaactgggtaaccaacctgattaaaacctggatcacacagagctggctgaggaatacatgtgtgataaaatgtatcatttgacttggaaatggagatgaaaaagcatctttcaggaagtgtatgttgggtgggtgcgttgggggattaaaacttgattcaaaaaggtaatagaaacttaaagatttcagatggcttataatttatctgtaatgggaaaaatactttaaaactgagataatatcttggaataaatttgaaatcacaggctgtattatggatgtgtttgtggatgtatgtgaattgcaaagaatgaaatttttttgtgaatgtaatttagcatgcataagattacaaataagctatgtgcagtaagagtccatttgatacaatgtgtgtaattttaaacttaaaaacatcgtgctttagaactggaagggaccttagagatcatctagtagaaatcattttgcaaatggaagaacggaatcccagggaaggtgaatggctttgcctgcactgcaaactagaatccagatgtttagacaactgtgtttggagactttttaaaatgtaaagcttgatatccaggggctcacttttagtattttaccagtagtagtgttacgtcattgctaatcacagctataacgtaatttcttctggaagatggaccatctcttcagccctttgcatatatggatgcttaatacaaatactttttgtgactcctaattaatactccaattaatatccaatgatagaagtttaggaaaattaaagcaatgttacttgtcagcttcttttgtttaggctcttaatgtggcttcttctgatttctcagctgattcaaaagaattccgagaaggtcatgtatgcggctcttttcaaaggaaaacactggttgctagagggatcgattttaatatagtttcatatcatagagattttaataatgcaatctaaaatatttgtacatgaattcattaagcccagattagtcttattataattactcaaaaagtaattcaatttaagagaaaacattttaaatggatataaaatacactgtgagctgggaagccatactgttctactttatcagctctataaagtactagcagactcggacataactttcatagtatacagaatgcaatcataaaaagtattattcctaaatctatttttttatgttctttcagtagttaagagctttatccctctgtgctaggaatgagatatactagggataggatgtcataaaaatgataggggctcaccagctcatgtctcttgcattgcttttccaagtcagcgcaggccgatgggttataagcacacagcccaagattgatgttggtagcacattccctagtaaatgtagcaggaagattctttgaggcttttttttttatttttttcttatccacaaataaaagacatttagtgagcactgtgtgccttcagaggtacaacagtgacaggcaaagtattggtcttcatttctaatatgataaaaggtgaagggaggccagcagcaatgaaaacgagagaactttctccggcctacatccaaacccaggtagagaagaaaaggcagagtgagataaaagatcttgcagcattaaagagcggttgtcatttttggcttagaaggctggagatgcggagtgaggccttccggttagtccttaaagctattaccaaggctcaccggggctctgttcagtttgagcaaccttattgtgcctggaggaagcaggagggtcatgaatattggccgtgtggctacacggttgcctgagctgtctggctttggagacacagaaaactaatcacagtccctatgtggtgccactgaggctgagcggggactctggaggagctctggactctggccatgctccgggagatacagacctgcacctgggcaggaaggggctctgcttcagtggtttgttgtgctcaaactttatttaataaagcaatggaactcttttctcaggcagattctccatagaaccccgctatagagaacagaacagctctctttgcagtgctgccaattcagctgtccccatacagttcctacctcttttgacccttacctaccagggagtgtggcttgagatgctgatcaaagcccaggaaagggctagctgagccccctaaatggtggtcttgagaaacgaaggcaggtccagaggagacgggcagtgttaaaggaatgagtggtacccgaaacaaaggtcaggccttgggtttctggcacctatgggttctaaccgcaacctcttagatcgctggtgtttgaaggtaggatatcattggatcactgatgtcaaggcttaaaaataatccattcataggtaatatctgaaaattgatttggggcttctgaatggcatatagctacaggatgacaagaaggaattagaaggatcattttattttcatgaattttcctctcatgattcctttacagtcctatgcaagtcgcagaggtttttcaaatagtagacaatcaataaatgttttttgaataataatactataatttatagaagactttctgggtaccagttatcgtgttctcttataggcaatctctcattcagtcttcatagcaaattttgtctccgcaaaaattacctattgttactggcatgttgctgatgagaaaatcaaggcttggggagataaaataacttgcccaagatcacacaggcagacataggaccagctctgacttcagaacctgagtttttatgaccctgtttctattgcttattattataccattgactttcacctattgaacatgcagcataaaccagccaccatgtgctaagtgctttacatatatgcttttgactgtcctcctaggcattctgcaagataaattttattatcctcattttacaagtgaggaaatgaagactcatagagtttaaatagctagtccagtatggctaggatgctggcctttgccaggattgaacaaatattatttgactacaaagtacttgtggcctgtgccgattaaattatcccacttgatcctcatgatattcctatggtagggaaaaagcttatccctactgttgccattttatagataggaatgtaagctacaatatgttgagtgattactccgggtgtccacttggtaaggggttgggacttgatcccaggtcattgagatccggtggccataatcctttggtgccacagcactggatcatataaggacgcatcctgtcacctttggagagcccacctgcaggtctggacctgggctttgtcaactgaaaacagaactgccctggagtgccgtgggtactcaacaagtagggaggcattgatgggccccacttttcaacataaaaagaaaaaattcactgcattcacagagatttgcagaagaaatgtaccgactgaattcttgttactcttcatgtctatgtacagagcttgctggttttttaaccttggtgagggggcagctcagctgattgtgaaattgactttggttaatggtgaactgactccattcaagaaaaccacattcattccagctgttcccttccttgtccctggttagttaggtcccagtaaaattcgcagtgctttactgtaaaagcacttgtacttgaaagagaattttctttctgtagctcaaaccacaggaggactcgcaagacagctgtctccccaggtgagacttcttaaatgggagttaagtgcatgcatttcaagaaactaaactcccctcatatataatttaacctagaaaagaaagcaaaattgagagagtagtatgattacattgtttgagaactaataactttaccacccccagttttatggaagtcacgcacagtttcactgtttgccatacctttaatactgtggggtgtgggctaagtgtgatattgtaataatagtgagggtttctctaaccatagttatggactatggattgaaatagtaaattattcctagcagactgaatgggcaataagactgccatccagttctcctcataaaacaaagcaatagataaataaagcagagccaactcacttaacctgcgtggctctgtgcactgctaattactaacccaggcgcaagagaggggttcacccagagtgtagttaagtcatttttaatcgaggtaaacactagtcatgtggatgagtagcactcaagaaagtttaatcagcaacatttaggaatcacccagcctaattgccataacttattaataataataaataatcgagtctttttatggcccctgtctctggaggactcagtgcattaaagatctctagggtgtgaatctcttagtagctgtgggggaaggggcaaatatcctcgatgctcattcctaactgaagaaattggacagcagggctaagaaaggcaatctgagttccttctttcttattttcttcctcccacatctgaatcaccaacttatacacgccctttcatctatctataggaccagaatggctccaggggctggtggggagagggagccgggggtgggcaggagaacaggctttcctttgtccatgtgaatgattggggttggggttttctcccttgggaagtgagtatgagcagagcgttgtctgaaggagttcatttcctctttacaagtgtctctggtgccctttgggctcaacctgattgtggctagagcggccactggcaattccccactccatactggcatgatttccaattcctgcaagagcagaaaagatggccccgagtcttattctcagagtaattccccacagcaaccgatggaatgggaaaacatttgtataaatcatctaactttaccttctcagccccgtgacaggggtattagaatatgcctgggttttcaacaaggaaattcaagctcagcaggtctaatagattgactcctgactttgtggttggttagattgaaaggagaatattacactcaaattcgaggccttttgatttgtgtaaatgactactccctatagtttaggagatggaggtggcggacaggaacaccagggtagcgaatggtaggaatatttcaatggctaatatcctttgacatccacagtttgggagaggaagttaaaatgtagccaacagaacagaaaccgccttcttctcctttatttcccgtttgtctgtccatgaatcatttgtgcctgagctatgatcgctgtttcattctggaaaagtgaaattttaaagaaggtacccaaaccattattacaccaaaaagataaataatagtaagaatggaatgatttatatacctcagaccacaaaagacataaactttgagtattccaagataattcacgtgcaaaattgttgcaatatttgtactagtatttattaaaatttacatttgaataaaacggtgcaaaatgtaaacaaagctgaaaaagagtttttggaaaaatctaaaatagctactgtgagtttttggaatcgaagatacaaatagttactccatgtatatttgtctgctaaagcatgaaatatacaatggaagtggacagaataaagtcactaaatccctgcccgaatttccatcctccctgtccactgatacttttgagtgattcaaatcagtactgaattttgaaggaagtgctccttgtcaaaaccacgcagaggaggttgaggattctggacggatgtcgagactgaatccgtatttcaaagactaatcttatttcactaatgttttcagggttggaaatttttgtctgtattcattagaggggaatgataaatctctaatttgtactttgctaataatagtgatgagcttttgtgcttcattaaggttaaatgaatctcatgtggtcctggctcagcctttaactccatgtgtgatcttgagaaaaatctctgaactgtctgggactcagtttcctcacctgtaaaatgagggggttggatcagatgagtgctaggacagaccagccctctttccctccctcgtaggtaggagcttgccatggccaggcaggtaggacccacaaaggtgattaagagacactgctcttgtcctcaggagctcatggtctatataaataactcattataatatgagctataattgcaacacgcacaaattactccaggagcacagaagtggaaacagtgaattccctctctgtgggaataaacttcacagtggctgtgacatttgaaggctgagtaggagggctcctccaggtgtgccggctggtcagagggtggttggtgcagactatgggttccagaagcaagcgcaggtgaaagtggtatatttagggagctgtacacggttctcacagtctctgggcagtggcatcccatacactactggatcagaatttgtactaatgatgaattactgaggttagagactactgtatagtgtgtatcaattagagcagagtcaaggtttcctgtagtgggactgataggacccatttacatcccagttggctttgctgagtgtaaaagaaatggtgatgtttttgccaattccctgggaattatgagcctgcaatctgttttacctgcaccacaaccactggcctcagtgtgcccttgggagtatgaacgactccctgtggggtcatgtgtgcccaagtggagtgaaaactgccaccatagatcttctcttcttgcagtctgttaacctatgaggtgcatgtctcagccacaccactgatggacccttggttctttgtggttttgtaggagctgatgtttctggtgatgacagagaacaaaattagatgttgatgatatagttcctacttagtttttaagatgaaaataactttagttttaaaatttgggttgtaaatgtaaggcgtgttcattgctaaaaattaatacagaaatgcttgcataaaatgtaaaaaggtgaccctgaattccatctcctgaaaataagcaatatttctgtgaccattgtcacagttctgtcttcatacagggggcacagatgggctcaggattatatgtgccattttgctatctgatattttcattcaaaataatcaaggtctttatatagccatttaaaacagctgcacaataatccactgtgtgagatatattatatttggcttgattccttattgccaaacaatcaggcaacatccagtgttttgccagtataaacaatgctatgatgaacattcgtgtagatttcttttatacatttcattatttcattagattagagtcctagaagtggtattgttgggccaaggaatgcatatttaatctttttttatataccatcaaactatcttctagaagtttcattcctttttacaatcctaccatcagagcagaaactggctcacatctgagtggtactgtctgtatctctgctggtgttcttttgtctttaagttactgagtgagaaagcatgagcaaatgagcgtacttttggagtgagtgggaggcggtataagcagggtgaacctgaatccatgtgggagatgtcaaaaagtacttggcatttgtacataagtttgtgaagagatatgtatgaaaatgttcatcacaattcctaattgccaaacgtggagaacaacccaatgtccagcaacattcgagtggagaaataaactgtagtataaccccacagtgaaatactacatggcagtgagaatgaatgagctaccgtgtgctacagtatggatgactccaaaagaagccaagaaaaggattcatgttgtatcagtccatttacataaaattcaaaaccaggccattgaatttctggtgggggtggtagttagtgactgcttgtttgtttatttttttaactagatgtgtgtgtgtgtgtgtgtgtgtgtgtgtgtgtgtgtgtgtgttttgagacggaattttgctcttgttgcccaggctggagtgcaatggagcgatctcggcttactgcaacctcctcctcctgggttcaagtgattctcctgcctcagcctcccgagtagatgggattacaggcacccaccactgcgtctggctaatttttgtatttttagtagagatggggtttcaccatgttagccaggctggtcttgaactcctgacctcaggtgatccgcctgcctcagcctctcaaagtgctgggattacaggcatgagccaccgtgcctggccctagatgtgtgtttcctggtgtcagtgtaattggcatttagggtatttagtagcttctcaatatttgttgaaaaaaatacattcatttttttaacctttctaacacactttgaccatgcttgttcctctgtggccttgaatgagttatttaactttctggagcctcagtttccccatctataaaatgagaactataataaaacttactttataagattgttgtgaaagtagtattaatataaataatagctgctgatttttctatgtttactatgtactgggcactggtctaagctcttaaaatgtatgacatcatttgtttaatttttcccgtacttagatctattttgtggtttagggaactgtaagtcacagagttagtaagtgtgaggccaggattgaaatgcaagcagcctcattccagagcttgagctcttaagcactgcctcctgagttaaaggaaatatgcatagagtgcttagcaaagtcagcatatgtcatcatcatactgtccttttcaacattattattaatattttttctcctctctttctcccctctcccctcccctacttttcttctttcttggcagatgtttttcagcaaggtaagttcactgtttcctgcctgctttttcactggctgtgctctttggggaacatgggtatggtctgtgtacagagggttatggggtttcccgttctctatggacatgtcatttaggccctcagggacaccatgaggacagtggcttaaagtgccatcagcctccctgggcctctgctgtccaacctctgcttcttcctctgaaccatgcttgggggtaggatgtagactggacagctgggcagagacgcttggagaggggtctgtggctgggccctggaaggagagagggatcctgtgggcctggtgaggactgatactctggaggggagtctgggggaaggccactgtccgttggggctcctgcatccggctcagctgctgctccttataccagtgccagtggagattcctttgccaagcaaacatgccactgttgtagaggtgtggcaaggccatggctggctggtcacttcatgcttttcaacctcgccagctgggtctgactgagatagtgtcacccaggtgagggtgtgcagtgtcatctgttttaccaggcaaggtcatgtgctctgaggagctggaggtgaaatcctaaccccacattggcccatgttttagtccccacttaggatgcagagcaattgtgctctggggtgcagcaggagactcatggatcatggcctcctcgaaccttctggatatacgtcaagggggaattggctttttatcacagcttgacactactgggtaaaagtagcagggcatcactgtttgtagtcaagctgggaaatatgttggtagcacacatctgctgtgtctttctggaatctaaggctggctttacaataaaagagactggtttaaaaatacacccaggcattccataaatagcttccaaataatcttacaggcttggtattttcacaactgttatttcaccccaaacaggcagcgtgtgttatggagaatatctgccttctctgatagaagtgcagttgtggataacaatgagggtactgtcgtattgtcttttaagagtctggagtcatagacttacttttataaataatttataaatcccaacaagctataagtaataagttccatttggctagagactaagagatgagcaaaattgaaaaggtatcgtgactgttcgtgtaatgaaagtgctgctgtcagggcctgttgctgcagtgagttttcttccttcacaaactggggggtcagtggggcactctaggcagatcatttttttttctgtgaactagaatgtaagcaaccccacactgaattgcatttttcctcttgaaacacaaaacatttgagtttggaaagtctttctggaacatgtgtgttgaggttactggagaatggggagaggggaggctggtgtcagatctggcttttctacacacaatggtgagcgttcatggtggttgtaattggcagaaaaaaatggcttaccagactgcctctgtcaagtttgccttcttttttaatcagtcatgccattcgattgatgggatttgcctgtcagtaacaatgatatgcagagcaaaagttataatcatctacaaatcactggctatcgagacttaataacatctgccagagatggaagccgcaagctacccgttgctctgtgtgtcagtgggcggccgctcccttataaggtattactcggatttcaaatggaaggaactgaacttgcttttgtgaattatttacatggctctggccatattggaccatttcgtatggagacacattctctaaaataatggcaaagaactcgcccgctggtacccactccttacctttgtttctggccatcctgcttatgaaaatattgctccgtaaaatgttcaactggtgacagttacatcagctctgtgtcttacagacggaatctaaaaccgtgatctccacaaggtcttctgtggttaaaactcagggccagaattgtaccatttagttgaaatatggggatgataaattgtgctagaaatcaacaagcagaaaacgacttagcttcaagtgaacagacgccactgcgttgtctggggcccatgcacacaatggcaacattgagtggccctgccttcctggacacgccatgggcatccaggccctgcttgctttgacttggccaagaagtcatgggcagttgggggaacaccacttgataaatgtgtgcttctgtcagtgagggagggaggactctgcccagtggagtccctgcctgtttgggctgctgtgtgcattgtggcaggcagaagagggaagcaggcttgcagttgacaacatcagatgttctcagaggaaacagaagttatttcctctggattgcattatcttatatttcattacagatcaatcttgttatagcaggtgacagcacagcagttattgctgggtttttctctgctgtgtctgtggcatgtgcacgtgagagtgtgcgtctaccctgctctcatgtcattttatagcttctttctgttctttcatctgtaaatgccacttgctgtgatgcttagaccacagagtctgaggacagttaaggaccggtgggcttgcagctgggcctttctacatacgagttccagggccacggggccatgttttcaaggagccttaattgacctacattccctgttgtccacagagacattgggtagctctcaggaattccaaagtgccatagaattgctcttcacaatttcaaatgcaattgaaaattctgtatgtgcatgtgtgtctagggtcatgagttttagggtactttaataccaatcatttactaatgatgaagtcaggaccacacaaacacacatgcacgcctcatttgaagttactgaagcacgttttgaatgctcatccgttgcctcaaccttgattctgaaatcgaacagaaactgagcaagccgcttggaaatcacaacaataccactcagcagagcattttaaagcgtaagtgggcgcggtataaagatttcaccatttagttaattctccctgcgctgtcaactgaagtcccttgaagactctgagcccagagaggtatagcctttcctcctcccttgttcttatctggagccaggatcttgttaatggagagatttttcttctggctccagtaatttgccatacccctcaaacacagggcatgacatgtttattctgcagccagtacatgtgcgcagggcactttctagaccttgagaataagtgaaaaagacagcaaagggtcctgttttcgtggaacttatagtctagcttgaggggcattctgtagtcaagtttacaaataaggtgaattcaaacagggatgaatgaagaaaatatctcagggtgatgtgccagtggctactaggaccactgcagaaggagtggccagagaatgacaagtagggccagttactgaagtatctgggggaggacagaaggatttacaaggtaggaacaccccgatgttccaggttcagaagaaagcctggggtgtatctggagctcgtgagtgaaggagaaagttgtgtgaaatgagcaaggagaaaagggcatctagggagctgagagaaagggagtcagaggtgaattttaaacaggagaatggcgtggtcttattcacatttaaaaataaccactctggatgctgcaaaaacacacagaacagtacatgagaagtgcagatcaggaccagcgctgagggctgagtgggcggctctaactgccgtgcttcaagagtctctgctgtctcgggcagtgagaacgagtagccccattcctagccagctcacctctgctgagtgctcactttctgctcgctttgcctgaagagggtcttgtgcccatgacttacatctgctgtccttaaggctggcaaattatgctcatcaagacattattaaaatattcctatatgtgtcttcagattttaaaaagccacttttctgcaatacatacgtacatgtgtgtatcatatgtattacatgcatatgatatatatatatcaatcatatatttttaagcctcagctgagtacgatgcagaggaaagacaccaaattccaaggtctccaggaccactggcaacaaagaaagggggtttttgtaggactgtgtctccttcgacaccacatgcccatttgccatgggtggctactccccagctctgcagagtgaggccaggcaggaatttggacccacaattgccacatagccaggattttctagagaagccaggaatctggaatggtgtgccagaccttacaatgttaagcttttagttaaaggttaaacaaacaaactgaactcatctatggccagaatggccgctgatctcagattggtgacaggtgattaggaaacctcagtgtttctccagcagggttgcgacctttgcagggggagtttggccaggtgctttggcctctggcctcagtttcctcatctgtaaaatgagagaattttacagatgaggaaactgttttacagttttacattttacagatgagaaaatacctgaccctgtttgtctttctgtagatgctctatctggagaagttttaagtggacttgagttaataaagtacagtaatatcccttgtgcaggttttggctatgcactagataacctgggtgaaagcagaggcttctctcatggtggtgaattaaggttaaaagaatgtggtttcaggccgggtgcggtggctcacgcctgtaatcccaggactttgggaggccgaggcgggtggatcacgaggtcaggagatcgagaccattctggctagcacggtgaaaccccgtctctactaaaaatacaaaaaattagccaggcgtcgtggcaggcgcctgtagtcccagctactcgggaggctgaggaaggagaatggcgtgaacccgggaggcggagcttgcagtgagccgagatcgcgcggctgcactccagcccagcctgggcgacagagtgaggctccgtctcaaaaaaaaaaaaaaaaaaaaaaagagaatgtggtttcagaagtgtaacctgttcacatggccattttgaaacatcagctctttcccatatggataaatactggaatccacaatggatggcattgcttttattaatttgaagagaacaataaatcatagtttggtttctggcagccgagccaagcctgttaattgtcggggtgggcttgtggtgacgggcccactgccatttatcaggagcttgacttgagctcttttgcgtatttcaaacttatgggtcaaactgctcggccttcgtcttaggtttactcagccacttctgaaaacccatctattataaagctgcgaccccttagccatgaattatgctccccctgataatgtcttacattatgaaagattgttttctttatgagtgtgggatttgagtgaataaatgaaatctatttttaccacttccaggtaaacattccaagttgttatgtgatggcaaactaggaaatgagaaaaatgcgtgaacacttttatggtggaaactggttggctccccagtcacactcctctgtgcaaatgtttcagtaaaatcagtaaaatatttgaagtcatgtagaaaatgcatccatctttctggcacaaacagaacaacattaccatttaattttgcatagattcactttgtgtgtgtgtgtgtgtgtgtgtgtgtgtgtgtgtgtgtgtgtgatatgaggaaaatgataaccagatttaaataatcactttctctgagatgttgtatcacattctacgggggctgtgcgaggctgcctcttccctgccaggtgaccttggggtggagctttccttgtcacagattcattgtgtgcccactcccatctgagggcatgagtttggggtgaggttttaaagggtctcccaccgctaacttgtctttcaaaattccttatcaggaaagaaggaaacttttagatttttttgttgaagtcgtggctataaaagaagagcagtttgtccttttaaagaatatatatatatatatatatatatatatatcttttttttttcctttcttttttgagatgaagtctagctctgtcgccaggctagagtgcagtggtgcgttctcagctcactgcaacctctgcctcccaggttgaagtgattctcctgcctcagcctcctgagtatctgggattacaggcacgtgccgctacgcccagctaatttttttatttttactagaaatggggtttcaccttgttggcgagatggtcttgatctcctgacctcgtgatccacccaccttggcctcctaaagtgttgggattacaggtgtgagtcaccgtgcccggccccttttaaaatttttattgggataataataatgctagtatttgtgtgcccctgtattccagacattgagctaagtattttgcacacatttcctcactgaatctgcccccaaactttataaggtacggtcatgtgctgcatgacagtggttcagtcaatgacagcattaaatgatggtggtcccataagattataatattggatttttaatgcattttctatgtttatatatacttagattcttaccattgtgtcacatcatatcaagggcacattctatcaatgtgatttatgacagctgatgttgatcttgatcatttggctgaaatagtgtgtgtcaagtttctccactggtgtggttactttcctcctcctttccatactatactctttggaaggaaatctatgcatagcctgcctttaaggagtggggagttatgctccacctcattgagggttgcctatctacataaattattcttctgcactggagacttgccacttatccctcatgtatgtatttattcaataacttacatcaatatgaactcataggtatttatgttatgctttgagttctaatctattactattttatttattttgttgctcaaattgttcccattttggccacttggagctctttcagctggcttctatgcccctttgacatattccttaacaaaagtaaccttttgagcacttctgtaatacttatggcactagaagatgctccaggctcatcatttatatttcccaccgtaatcccacaatcaataggattgtacaatcacttctccaaggagtcctggttctgatcattgaagaatgatacaagaaaccaagatctgggtgttaggtgtgcttattgctaccagggtgtcctttcttttaggccctcctagctgacagagcaaataagtatatgcatgtacactgacctgtgcatatgcacatatctgtaaatatttatatatataaccaggtgtataaatattaaattaagcatgagctcctcttgatgtgttcgactctaacccatcaccacatggatcattctagcctcctctcactggttatttgtaaattcccactcccatggtaagacacctggaccaggattttgacttcaggtcagtctacctgggttcagtctgctttcttgacacctagagaagggctttcatctacccacagtgggacagagtcacagatccttgacactttccaaggccagacatgactgctcagatgtagaagtacaagtttgttgcatgcccttctgcttctacgccagacccaggcttgttctcaggacttctcagccagttctagctttgctagtttctcagtgggtttgccttatctagagcagaggccaattgcatagtgtcttgtttctatgcaaaggcatttgtgcttttcccatagcgtaggcaagccagcgacaaaacaacagaactgtttacaatactccagctgttgagtgcttaaaccctctgtaccttccctaattgattgaatgcttaaaccctctgtacctttttcccagttgagattgttgctcactggggaccaggatagagccatcttttaagtctctatgagtttgtcctcgggctagattatgaggcttctgggaatctcctgcttgggcaggagggtggtcgtgttcatgaatggttgagcatgtttgtctgtttgggctggtgcccatgtgccaccttcccccagctgcctctctctgatgtcccttcccaaatgcctgtgctggtgcacagtcccctccagccagagctgttattatttggagacctgctgtgaaggctgcatctatcagccagctgatgggtgcctgtggagatatgtggagcctattttctgattctttctgcagcctctgatgcacctggttcccttcagcccagaagtcagagagtgggggctgcttgaacccctgatgtctgagagccccactcgcattgtttttggagtctggcttgctggaagtcacagagaattacatacgattgtagttgattcatacaaattttttgttagcagctgaagtgatcttttggaatgcaatttgtgagttcatagaaatgtgttctttacacttgacagtaggtttggtaatatgttctgctgatggctgggtgtggccactcattgacgagtggctttcttctaggggatactgggccagacctcctcgagccctgatacctgccttcatttctagcacccctcccccatcgcaccccattcatctccataaggcttggccagattgatccctgttcttcaaaatgctcatccacggctgcccctatgcctttggatggattgattcctctacctggagttcttttacctcttttcagcaccccatcctcagaaaagtagccagggtctgccatcaagggggctagcccagctggggatgtaacatgatttggatttgtgtcctccccttaatcccaaatctcatatcaaattggaggaggggcctggtgggaggtgattagatcatgagggtggatttccccattgctgttctcatgatagtgagtaagttctcacgagatctaatggtttaaaagagtgtggcatgtcccccttagctctctctctctcctgctccaccatggtaagacatgcttgcttccccttccaccatgattgtaagtttcctaaagcctcccagccatgcttcctgttaagcctgtgggtcagtgaaagtcttttctttatgaattacccagtctcggttagttctttatagcagggtgagaatggaccaatacaaggtgcttgtctctggtgtgtgtggggagaggcagactctcatttccacacagtcttctactgtcttattatgaccatattcacagccactgtgacattttcctttgaaatctttgagaaggtgccgcccaatgctccttatagatatactgctgcttttgcttattcttcaaaactcagcccaaatcctttctgctggaagtcaggttgcctctgactcaccccacccctcaagtgggagttctgcccacccttctgttagcacttttctcccactgtcagaatgatctgtctacacatctggcttcccacacccgattgagctcctagagaggatggagcttgtcttttattttgaatccctggcacccagtgcagtgttgagcacatagtaggggctcaatagatgtttgatgaatgaaagtggaaaagaggacaaagctcggaggaatcggtgttttgtgtgggctgagtgtatgtacatgcttctcgtatgttcgtatttgatagcctaggtccttttatgaggttgaggcagaactctggtagtgtaatcaatgatcatgttgacagtgaatccaaatgttaccttattcttggatccaaaaatctttctctgttttgttgcctcactaccattctttggagtaggtggcagaggtgaggggggtggggacagtgtttggacttagaatgaatcagcaagtatttacttgcccaggtttgtacaaggcatggtcagggaccccaggggacttagcagatactgcctctgttttctaagcaccaacggtttcactggagacccaagcctggttggtctgtgggtgctgtcctcttccagtgcaggaggaagctttacagataggtgcccctgaaggagaggctactacaagaatggtttgggaggtggttttgaagggaactgaatgtctaattgggcaggataagggcaactccggggagtgaggggcgggaggaggacagtctgaatggaggtggagaccaaaacaagtatagtgttgtttttatgggatgttgagagggcagcaaacctggcagactctgggttgagattggatggagccagttatggagcctttgcaatgtgcttactgcaaaaaaccctctgttttcttctgccccctaacactctcagtgtgactgaagagatttttgtctaccaagtgaatagtattggctattgagttttcccatttatattactcatttttattactcctttcattactcaaggactactagtcagtgactcagcactcccaatcagcatgaatattatacccctgagtggatggaattccacctccttaagaagaaaaaaaatgttattttagatagcttgaacaatgattttcttggttatttaaaaacctaggcagcagagtttagacttgttctagaaagcccaaggaagtcattgcagctctttaagcagagaaatagcatgcactgtgagcataccataaaactgtccatattgtttgtggggtggcagaagataatggttgtttctgctaactaactgacttactgtgtgccaggcatgtcaatgagcgttccacatacattaactcgctttctccccagaatgatcctggtataaacttaaatgtttttgtttcccccaaagtcatatgttaaaatcctaaccccaatgtgtgcattagaaagtggggcctttggggataattaggtcatagggtagagctctcatgaatgggattagcacccttataaaaaaagaccagagagcttcagctttctgctctttgccatgtgaggacacaggaagaaagcctccatctgcaagccaggaagagagtcctcaccaagatccccaccccgttggcaccaggatcttggacttccaatctccagaactgtgagaaataagtatttgtcgctaaataaatctttgtggtttcagatatttagctatagcagatcaggctgactaagagaaaccccataagagttacatactcactaatctccgtctctatccccaggtctcagatgctgaaatagattcccaaaacttaagtagaagttaagaagtcaaaccttgcagaaggtcttacagctagtgaaggactgaatctgagttcagacccaggaaattcgtctgaattctttatgagtacattacatagtcatcttgaagggaacagtaaactgagtggggcttgccactggatcaagatagacagtgccataatcgggccagagatctcacccaggccccagagaaatgaaagcatgtgtctaagaaggagacttgtacacaaatcttcatagcagctttattcataatagcctcaaactggaaatagtccaggtgtccatcagtaggagaaaggacaaactgtgatactcatcaaatggaacactactcaactataaaaagcaaaaaaggttgcacacaacaacatgatgaatttcagaaacattacactgagtgaaggcagtccttcgcaaaagagggcaacattctatatggttccatttatgtgaaattcttaaaactaaaatatgatggaaaagaactcaacatcgtttccttctggggaaatgaaagtagcgattgacttgaaaggcaagagggaatcttctgggatgatggtagtgttctctatcttagtagggttttggctatacaggtgtatacatttgtcaaaactcagcgaatatacacttaagatttgtgcatttcactgtatgtaaatttcactctaaaaggaaaaaaaatgaaacaaataccaaccctggtcaatgatgtgttcactgaaatatttagggacaagtgtactggtatctgccatttattttgaaatgcatatgaaataaaatgtatttatatttactgctggatggatagagaggtggatagatggatacatttgtggtaaagcaagtatagatttgtggtaaagcaacattagtggtagagtctgggggtaggagtatgagtgttcattgtaaaattcaactttgctacatatttgaaaactttataataaaatgttgaggaaaaagagatcccacccagttggagtcctttacataaagagagcttatgtggcctccatagggataaatgcagaggtctgtcagaggtggaccaccccagaggaggaggcaggtttggggtccggctgcagcgcgtcaggtgagaagaaggcttagggccaaaatgcctgagggatggctgcagagtaggctctggacttggatgctgcagttacttaggatgctataataaaggattacaaacgaggtggtgtaaagcaacagaaatctattccctcactgtcctggagattggaagtctgaaatcaaggtgtcagcaggccatgctctctctgaaggctctagaagaggatctgtcccggccgcttccagctactggggattctcagcagcccgtagtattccctggcctgtggctgcatcactcccatctctgcctccatcatcacatggtctttgtctctgtatgtctctggatatcttcttttcttatgaggacaccagtcatttgggatttagggcttaccctaatccatcgtgaccgcattttaacttaattacctcggcaaaaaccctatttccaaataaggtcacatgctgaggttcgaggggagaagaattttgggaaagaattattcaaccactacagatggatgaccagccaacctgggtggcccacaataaaagagaagcatcaagggaggactggggcaagaaagagagtccagggctggtggacagggaggacaccctgaggaagatagaaaaggaaaccagtttacatttggcaacagaaggaaaccagggcttgggagagaggaaaacacggcgagtagctttgcaggaaagggctgtgtctcaacctgggcctctctatccatttatctcctgcatatcttaaagaattaaaatgtaaatatcggaaattaaatccatgggtacagtgtaaatagaggaggcttttacagaacagacaaagctgttctttttccttattaaacagccgtgggtgggaaagcacgtctgtatgcacaggttttatttgagatggattaaggttcgtgatgagtgaatctctgaaggattgcaggtgcagttctcataagcccgcaaaagttcagctccttatctgaggcttatccaaacctgatgaaaccttttaggccagcgtggaggtttgggacctccagcagttgaaagttaatatcctgcatcaggaaaccacctgtatcgtgtgggggcgttggggagggaggtctataaattaatgcagactccgatcagaagcctgctgtggtttggggcttcctaggcttggaccacccactctctttggtggatggattacaagttcagcccttttagctcttgcagaggaggagttaatgcatcctagttcttgggatcttttaccacatttagttctcacatcagcttataggatctggctccgtgacctgccactgctgtcaccacactggccttcctgcagtgtgactccctcacttgctcactcacttccacgggcctccatctggtccctgggacctgttgtccaagcccacgcatgcctcagcactccggaataatccgcctgtagctggccactcttcattaggcagtcacatcctcagagatgcttgctgtagccatcatggctaaagtataacctcaacacactgccccgaaactctaccccatgtccctgtttaatttctttgtagcacttctagtgggtttagttgtatcccccacaaaattcatgtccacctggaacctcagaacgtgacctcatttggaaatagggttagtcgatgtcttagttcatctggaactgtgtgtgtgtctgtgtgtgtgcacgtgtattatatataaaatacacagatatacacacatatgcagatgcacgtgcacacacatgtataaatgacagacacatatatatacataaacaatatacacacatacattccaaactacgataaaataccataaattgggtagcttataaacaactgagctttatttctggcagttctagaggctgggaggtctaagatcaaggtgctggcagattccgtgtttggtaagggcttaatacctggttcagaggtggcaccttctagctgtgtccttatgtggtggaaggagtaaagcaggtctctggtgcctttttggagtcctaagggccctaatctcattcctgaaggctctgcttccatgaattaatcacctcccaaagcccccacctcctaatactgttgcctcggtgattaggtttcaacctgtgaacttcagggagacaccaacattcagaccctagcaatgaaggatcttgagaggaaatcatccaggatttaggataggccacaaatccaaggactggttgttcttctaagaggagaggacatggagagaaggccacatgaagacacaggcagagactagagatgtgctgccagcagaagcaggaagaagcaaagaagagtgacttcctagaaccttcagagaaaccttcagcatggccctcctgacaccttaattttgatcttctggactccagaactgtgggagggaaaaaaaatatatatatatatatttataagtatttttatatttatatatttatatatgtattatatattatattatatacagtattatatatataatatataatatatattatatatagtattatatattatatatagtactatatataatatatattatatatagtactatatattatatatattatatatagtactatatatatattatatatagtactatatattatatatattatatatagtactatatatatattatatatagtactatatattatatatattatatatagtatatataaaaatatatataaatttataaatatataaatttataaatatatattatatatatatattttttgagacagagtctcgcaccatcaccctggctggagtacagtggcacagtctcatctcactgcaacctccacctctcaggttcaagcgattctcctgcctcagcctccctagtagctgggattacaggcacctgccaccacgtccggcaaattatttgtatttttagtagagatgaggtttcactatgttggccaggttggtctcgagctcctgaccttgtgatccactcacctcagcctcccaaagtgctgggattgcaggtgtaagccaccatgcccagctgttttttttttttttaagacatcaaatttgtaaatttgttgcaatagtcctattaagcaaatacagtagtcaacactgtctgaaattacttttcatttttttttacttgttccttgctagaatacaagctacagaagtgcagggccctggctgtgatattcatccccacatcccagtgtctagaacagggccaggtgttattgaatcaggtgtattgaaccttatgagtgttcaataaatatttgtcaaaataattaaccttgtgagataggatttgttgtcttcatctctggctgatgaaacatacattcagagaagtttagtaacccaccccaaatcaaacggggacagagtcaagattcaaactcagattttctgttcttaggtttcactgaatagggtttgcaagtttgggcctgagctgaattgctgggaaccaggcaggaaaatctgagtgcccaaatgctgatttctcttacctttccctgatatagcaatcagtttgtcctctacaacaggagttggagatccctgggccatggactggtactggtccatggcctgttagaaaccaggctgcgcagcaggaggtgagtgaccggcaaaagagcattaccgccagagcttcacctcctgtcagatcagcagtggcattagattcatataagagcatgaacccgattatgaactgcacatgtgaggaatctaggttgcacactccttatgagaattgtctgattatctgaggtggaatagtttcatccttaagcaatacccccgccccttgcatggaaaagttgtcttccacgaaacctatctctggtgccaaaaaggttggtgaccactgctctacaagaatgttaagcagatattaaaaggctgtgagtttgaaggacacagaattagcagtctggcatgctgtgtgtctcagtctggctgtgaaagcataacaaaaaagatagtgctaagttaacagggcaatttaaaacaaagggagttctttgtgaaggtattaaagaaagctcaatgggggaggtttttctatacttggccatgaaggaaaagaaaacattactttagcacaggggttggcaaactatggcccaaatgctgaccacctatttttgtaaataaagttttactgaaacacagccacacccattcatttacatattgtttctggctacttttgcactactgtggcagagttgaatggtttccacaaagactgtatggcctgcacgataaacgctgaaaacatttattgcctggctctttacagaaaatgccagggaaatgtctcttgttccttgtctgccttctttcctgtgtcttgatagcagtttttaatcagaagtcataatgagtggaaatttcagaaatggttctcagtctgtgtggggaattaagatgaagatattgatgatgaaatgagctgaccaatggcgcaaagatgctcctaaatgctgatgtatcttcttaattcaggcatgtagcaaacacttattgatgtcctgctatgtgtgaatcagtaggccaagggttgaatcatcaaaaaaaaaattaaagttgctcagtgggtttgtttcttttctaattattgaacattggtaatccacagatgtagggtaattctgtatcaaccagaatacttaatcattcagaaacccagctctcgatctggctaactattgtgtacttagttgcatatcgacaaaatctataccagaaattttaattaacctttcaaactccctttcgatttcttcaggataaattagaaaacagagtgtctactgggttcatctgcagacaggggtagtttatagttgacccagcaaggtgagggtgggggtcaggaatgattcactggaaatggctttgtttgcttgcctatctggtggggaagaattcatgggttatttttagatattgtgttctcatttatcagtccactttggcaacattgatttacctaagagactcaatttgtaaatagtaaaacaaactcaggggatatttagaaactactttctgcatattcagcaggtcaagagactgcaaagtattagtaactcaccagctatcctgaggctcctcatttaaggttttatcatgagccaccttttttttttttttttaaattttatttatttatttttttttattgagacggagtctccctctgtggcccaggctggagtacagtggtgcgatctcggctcactgcaagctctgcctcccgggttcacaccattctcttgcctcagtctccggagtagctgggactacaggcaccctccaccacgcccagctaatttctttttgtatttttagagagccaggatggtctccatctcctgacctcatgatccacccgcctaggcctcccaaagtgctgggattacaggcatgagccaccgcgcccggcccatgagccacctttttatagaaggttaactctccttggctcaggtccagggctggcacaggtaatctggggaggcaggttggtctggaagcaggtctaaatgcaagaatacctccttcaaggttgggttagagagggtctgcatccctctctgtctcttctcaggtaacaggacacagaatttccccaacaaaagcaggatttgtgtctcttaggagaccggttcttctctgctggctacatcagaaaatacaacacagatgtgattgatggtgagggattagtgacatttccgtgaacttgggacttgatgaaaccctttatcttttattcccaaagtgtggttttgttcacctcatctccccaaagtgtgtttggttttatttccctttgaatggtaaaggatatgttaatagatttttaagaatcaactcaaaaaaccccaaagtcttaaaaacgctttctgtttcttttccctccccaaactttaatagcccctggagtgggtgtggaggtggcaggggtcctttgtattttccaaacccgctgtttgcagaaatggctgttatgactgcagcaacataattgctcttaaaatgcctcaataataaaaaaaatctatttttattttgtaatcttgaggctccttggcttccatttttccaggccactttagtaacttctgaaaattagcctgacaaatacagtttcccagcttgaccaaggaacagttgtttgttggaggggttggctgtgtgtgtggaggggcctgggagagatggagggggtaggagttgtacaaagccggtggggatttgattcttagatggcagctgtttctgccttctcttgaccacttcaaaggaagcataaagtatagaaaatgcactttccaacactcccccgggactgcctctgtttccccagccttggctgaaaatgaaagggaatcatctcttattcctgttctgtccttggtgcccataactgcttacaggactggccgggtggggtttccagcactgtggagggttcagccccgcactcccatggaattgtctttgcttttctgaaaccacacttttaagaggatgtgctcagggtcacaccagatgggcaggagctggtcagctttgagatagggcgttgctacaggggcgaaggtgcactaggcagcctctttcaattctcagagtctacagtttgactctgtggattcagcctccaaacaaagcgagctctgtgtttgccttggacgattcattcacccttcaccaggccatgaatcgtgttgatgtgatttggaatgaccccgaaagtggggcctcttggggagaaccattcagatgggttttctggagctggtggtgatgctgagggcaggtctgtggaatgcccctgacacctgaggttccccagcagcctatgctaccccctttctgcaggcaaaaggcctcatatgcacacctgtgcacacccaacgggcaaacctaaactcttagtctttggtaggaatgaagatttatttgtgtgcattcaggtagatactcctggcccatagagacaaggaatggggatgggggtgcccattcaaagctggggcattgatatcagagcaggcaaaaagccccaaaccactaagaaattaaattacttcttaagtcacagacaaggacgaaagaaatgattcatttggactatgtagtgttagccaggcaactcctaacctttttattttattttattttttagatgaagtctcactcttgtccccgaggctggagtgcaatggcgcgatctcggctcactgcaacctctgcctcccgggttcaagctattctcgtgtctcagcctccatagtagctgggattacaggtggctgccaccacgcccggctaatttttgtatttttagtagagatggggtttcaccatgttggccaggctgatctcaaactcctgacctcaggtgatccgcctgccttggcctcccaaagtgctgggattacaggcgtgagccactgcgcccagccacctaatctacctttaactgaaaactaactcagacttgcttacactgccctgatccctgaataatcaggtctttatttttcttttacatgctttagctcgctttaaaatgttttgaggatatttggagacttgaggagacagtctagttaaaagcttgtgctttttttttcccctggcaatttgtaagttgccctttcttatagacagaaaaggtagagttacaattaagtcagtctgtgtgatgctgtgtagagcgtcattttttcacaatgtgctgaaaagtttattgcctggtgacaaaaaagtcactctgatttcattttcaaaagttgaatttaaaactcagaatctagtttctttataattatgcttcttatttggcaacatatggtgaaaatgtatacggcctatcaatgtgaaagaacagagccgaggctctagccttttatggtgattacatctacctgtatgggggctttatgtacttacaatttgaatcatttatagatgcacactcaacacagttctagcataactagtactgtgggttttttttgctgactaaatgataggcaaagcaattttcaacaaatgtctcccagtaggctgtcatcatagaaggcttgtaatattgctttttaaccttagcaatggcagctatccagaaattattgcattgataccaaactgccttgcaccaggcaattgcccttttctccatgggaacccggtgaactctcaagtagatgcctgctcccctcccctcggattctcttgttttttatttcagggagatcttttacctgttcttgttcagctgtaggtagccaagcacattgaaagtttaaaaatacagcaaaataattctctggattgtgttattatgcctttaatgcattcagttaacatttggagctttgtcaccagataaacggtgcacattggtgcacaaagagaaaaggaagggctttgtttcccacccctcttagacagagacagatctagctttcgtctctctttctccttctcttcttttcctttctttcactttcagaacctcttgaaatgtctttgggggattggtagatcacgagtctggggttttgggaaggatttgttgaggcttctgggaaagaacttgaaggaagcaaatgtcctggggttgtcccaaagaggagatggagtggagggtgggatcctggcagcattcttcaggcttctgcaggacctttagtttctgggcctgtacctttaggggagctctggggaaggccatgtacccaggctccctttccttctcctgtctgtagagcactggcttgggataaaggccgacttcttgagagcacattgctctttgtgaatttcagcaagtggagtgcgttgatccactctcatgtccaggtagtgagaggagccatctggtgactactgacctctagaagttggatttcaaacaccctctaagtgttgagtacacctgctctgtgccatgttgagcaccaagcacttgaaaggtttggctttatgagtgcaggggaattgccagcagttggcacagggcttattgaagagaagtacagtcaatgtgttgaatgaatgatggcttctcattcggtgggagaatgctgttgtgtccagtgccatgttggctgcaggcttggctcatgaagcattccccagctgcatcccagttgctgtgctttggttttctcctgagttctggtcccgctctctgcctcgcctggggctctcatcaggccggaaatacctccctagggagcatttgtcttctcatagagagctttgaccatcttcaccttcatcaggaaaagagaccttaaaaaaaaaaccctggcctaatgcatttgccttgaccttctataatgatgagtgttataaatggagaaatagataactattctatatcgatggttcaaagaaaattctgtctttggctaagaaaaaaagcattttactggataacactggaaatataaactgtaatagaaaatcaaactcaaagcattaaataaaatagtggaagtcagtggttctcaacctcctcttatttccattgcttaaaagagatttcattcaataataatgaatgaatgaatgaatttcagaacctgtttatgtaataattctgctatgatggacacttaaagagaattaaacttaagatagttcatttatctagtgacaaatgtaaatgttgcacgaaagtgtgaaacgtgtttggagcgtagctggagtgaaggtggcgggggaatcaaaaaaagagggaagaagggatgagtgtcacttctctaagacatttgggaaaagaaacatacatgaatacaccaaagagcatgctggggctcaggggacgttactccttgggtaaacaggacgtgttggtcaaggaatttccttggaaatagtgtttctggagttatgatttggatgaacaaaggcactgtggcattaggtgccacctgataagatctgccccccaaaacagttgcccttcgtgggggaagaaggtgtatcccacctttaagtctatgaagaggcataaccatttttctgcttgcaggtaattcattttctggcccaggaagaatgctgtgatcacttgcctacttttttttttttttttttttttaagagacaaggtctccctgtgttggccaggatggcctggaattcctggcctcaagcaatcctcctgccccagcctcccaaagtgctgggattagaggcatgagccaccatgcctgcccccacccttattttttttaaattgtgataataaatactgtagataacataacatttaccttttttttttttttttaaacagagtctcactctgtcactcagactggagtgcagtggcactatcttagctcacggcaacctctgcctcccaggttcaagtgattctcgtgcctcagcctccatgtagctgggattacaggcatgcaccaccacgcccggctaactttttttgtatttttagcagggtttcaccatgttggccaagctggtctcaaactccttacctcaaatgatctgcccgcctcggcctcccaaagtgttgggattacaggtgtgagccaccgtgcccggcccaacattgaccattttaatacgctcgtgagtggacaattcagtggcattaagtatattcacattgttgtgcagccatcaccaccatccatctccaggactttttcatcatcccaaactgaaactctatacccattgaacagagagccctcattctcccctccacccaaacgctggcaaccactgttctactttctagctccaagaattggactgttctaaatacctcttctaagtggaataataaactatttgtccttttgtgtccagcctgttccactattgcccacctttttaagacagatttatcacagataaagagactgcatgccagagagcagggacgcaggtcctcattcctccgaaccctcagatcccatgggcacctctgcatggggttgaccccccatcccacaggtctcagcttaaatactgctgctgcagagaggtccctcccccaaccattccacctgaacaagtccgcttccctcttctactggcccctacatcctgcttgctccctttcatttcctctgtcccagtatgtattatatatagggttgtggtttcctcctgattggctgactgggcaaccagattataagatctgagaggcctgggatgtctactgtctagattcatatctgccagttacactcagtgcttaccacccagtcagtgctcagtaagtacttgcagggcgtggggaggggtgaagaatgcatctctgtctccagccctggccagggctctgctctgggggcctcagaggtcaacgcaaacttactgctgccttttttactagaatcctcactgccttcatctagattttccatggccaatgttgagatttcaacagttacatttcaactgctgccctttcatagcctgacaagggtctggatgctttctttgtgcctttctgtggatgggtgctcagggaagataaatgaattttaatattaacctaaagaaaacacagttaaaagctaaaacttgcatagaaaagtcaacccttgcattcttgggccagataaaatggcttttgggtgagttccttcattggattatcggtgccactaactcctagattattatgttaatttggctttattaatattaaaaataagatagttctcaagcctggagaattagaacgtaactccttgaataaggctgatgtcttagactgttagttttagaagggatgtcactgagcacttcgtccaacttactgtatgaaggagaaaattgcaggcaggtgacatcaggggccacacagggtcctgcagagatgctggccgagcagacactggagcttagggctccagcctcatgacctcaaatggacatttttgaatgaaaaaataatagacaaatacgaagtattcacagaatatttgcattcaggaggagttaagcctttttctagactacttggtgcttttattaactgatgcaagtattgcattcatcatttttttctactttgttgcctttaaaaccctgtcttccattcaaatgtaatgctttgatcatttaaatagcacagttatctgaacacaactgtgaaaaacctcacgttattccttcattgagttttaacattaaaattcccaggaacattagtggttcttgaaaaagggaccgagacgtgaccctgtgtgagcaggtcgccttccagttttcaccatagcagcatggaggggcactagcttgagctgaggtgcaagaagcacttgaagtttgctttcaagctcgcaagggccggggtatgaattgcagtgaaaattgttccatttctttggggagaaagtcctagtccttataaatatggtattctcatttgtcaagagaatcttatttcttttatgttatgttcacctgaaatacagtaggagtttgcttgtgattaattaagcagatgataaatggcacttaaaatgaacattcagcacctcccgccgccccccatgtgtagacagaaaacagaggtaattggatgggaaacagtatggcatttaaaccttgccttttttttttttttttttttaagagcctttcctctgccttatgcagataaagagagaccggcctttcagaattgtgtaatgtcccagacatatgtggaaaccaatcagttgtgcctgctccatgccctcattttgtaagtgtgcctgctcaattgactgttggcaaaactgtgctcagtggcacatcagtcgttaggagctgccaccacctctgtgtgaagtaacgtggcttttctctcttgccacttagttccttggggaggttgcttcggggagttacatttcaccattggtgaaacacaaacctgtttggaaaaggcaaggttgtctgggactgtgttaaccacatgaaccctcagaagcacctctccttcccaaggactgtcactggtacagtgaagcctggtgccatctccggtgagcgctgggggctctcctccctgtgctgccactctgggccctgcactaagggtctgggcaagctatagaatagctgccgcaagctggtcctgtgttccaaagctctgggaagaaattccccttggttcttgctctcccacctactacccccctacctcccaaaaataataaagtaaaataaaatttaaaagataaaaagggcagctttcctggaggtataccagactccatgtctggatatccacttggggtgcagcagagtccatgcctagatatcaatccagtcctgtgggacattgtgagcagcacaattataattaaaacagcgacaataataatggcacttaggctttattgccctgctagtgttccacagactctgaggttagaattcccgtgcaaatgatttattaaggaagtgctctctgaagaaactaataacggagttggggtggggagcaggacagggagggggagaagccacgcatgggagcagattcaaatgaggccctgtctgatcccaggaggggctccagagcataaataatccctgagatgtatcctgcccagaggcaaagagctgggcttctgaatccaacactagtcagtcattgattatggggcacctggcctcagtggggagtggaggtgtaaacaggctgggcagcttggtgccaggggtgctcctttgagggccacaggtgcaggctctgagcagcaacacgcatggaagctggtgagtgggttcaaaggaggtgcgccgggatggggtgctgtcttatgtagcatcacaattaatgtgggtggcactgttaatagcctgtcttacagatcatcagctgagcacctctgtgcatcaaatacacagctcctccaaagcctggagatttcataaagcaggtgaggaaactgaggctatgagaggttaggtaaggcatccaatatcacaaagttaggaagtagcagagctgggatttaagcccaggtcctgtctcctctcagtctctctctgtctgcctcccttgccgacgcattctcataccaccatgctgtatgttacattgcagtaattacagcccttcactagaacaagattctctccttacattcagaacagctaagctctgcaggctttaaaagcctcaaggaaaaaaatatatttttcgatggaaaaacacacacaaaaaagcttgtattttgaggaacagaggtgctggattgatgatgccacctctggagctacatgagggcctaaaaaaggcctgtgtcctgcactgccctacagatggactgtgtctgttggggacatgtgggcccttggtgagagctgtcccaccagggagactctacccagggctctggttaaacagccaggaacaccggtgaccaatgtgacctattttcccaggacctcctgccttaagaactggaactagccttatgtccaggcagagaaattgccctgagacaggccccagatctctgctgtgaccctctgatgagacatgttaaatagagcctgagcagctggccgggaggcccacctgtagtgccacctcctcttgaggtcagagcctggtgagcaaagcagctttttctggtggccagatgtcacccctggcctgctgggagttggtttggggctgtacccagggccgcaggtccctgccaggcctcatgaaggaagatgtgttgctccactggggaagcacagtcattcgtcattagcatggagagtgagggaatctctgggaatgggacactgatggatgctggcatgtgggcccagggataaggctgtcacctgccctcctccaagctgcgtggacctctccattggcagctggccaggagataactggcctgggcagcccataacatttgaggcctcccctatgccatctggaggctttggtgggcagctcctctgatgcctggagatttcataagccagttgctagagggtcaggaaagctgcctgtctgagtcagtctttacagtgtagggagaatcacagggtctgttactatgcatttcatgaacaattgggctgatgcaaaaacaaatgactttcttagaagacatccagagggagtgggtaccacattttgtgaaaatgttccatgcagcctcgggaagcacttccagcagccagtgccctggagtgctcccaagcagtgctgtgcagggtagctggccgagtcagtgaccttcacctagtaaattccaaggcaggcagtggagtgattcatctggggaactggagacctgtcccaggtcctgatagtgagactgaagcatttccctggggataatgagagggaccaaacactctctcagccttcaggagcttagacggaagttgggatcagtaagtgggcagagatgctgtcctgccctgttacagaggagcctgggagcaaggtgctgagtgttaagagtaggtgagtgagcaagaggcagagaaggaggaggaagcaaaagaagagagaagaccaagtgtcccaacctgccagagcccagggcctttctggagaggagagggctggggaaagggagaaccagcagtgctgttctctaccctccctgtgccatgccttggtcttcatccatcaggctctgccctcttggtgcctaaaactactcaggggtgggagtggggccatgatttcaggccaaccaggtttcacattcacataacttgctcttgattttgaggaagtgaacctctgtgagcctgagattccccatggaatggatataatagagggaagctcatggggctgtggagatgattccctgacaaacacatttaaagtctcagtgaggataggctgttagaattgggttggacccattgcggtaagctccctgaatgggagttgatttccagtgtggggtactgtctttactcaccaagtcttgtctgactgaggagaatcaactttgaaccccaggcccagcgggtaaaacaactttcctcatgcttctggagtgcactgaggaaagatgaaaggaaaggaaattgatcaacacttgctgtacttgttccctctgaggaaaagaatgcatgtttcctttcaatactcaagacttgggaaacatcaaggcggcaaagagaaatgaagagggcaaaatgtgtctgtccagccagacatttgggaaggcccttgggtagccttgattccaaaaggtcagttacactgtgccaggtcatcacagacacctggactgcctttggctggatggacgcatggggaaaccagcatctggagatgtcttccaggagcgctcagctctggctgatacttgaaggggatgtcattgtttgataccttagtgactgtaactttcagacctgggctttgctcacttcctgctgcccatctaagaagggacctgggtatctcttggaactggcaaagagagtcaggttcattgcgtttatctcctttgctgatatttgggaatgggatgagctggatttctagcgcttctagaaatctgacatgaagcagatggcagtttgttgacacctgtgtcactgagctgctttttgggtcatttctgatttagaagatgggaacagcttgatctggttggaaccagtcttagcatctagggagttccttaatgtagtttggtgaatgttactggccacagtatcaagggctctccagatctgctcattctgcaactttcacaagtgtttgtttaggcttttgacttctgggggctgggggtatggaagagagtgattacaaaaagagtaatattcagtccaagctctgccacttaaaatatttgctcttaactaaatatgcaatacatgttttctttgtatggtttctggacaaaatatagttccagcaagttagttgctgtattaattactattattgttatcattaggtcagttagtcattccccttggtttatggaacactatcatcattgcactgtacaagggacagtccttttcattggtttatctggatttttctccctgcactccccatttctgccctcccaacctttgccctccccatctctgccctccccaccacccccagcccccagttacatatgttaaatctgtgttctttaacatatatgcattcttgagcaagatactcatgtgcccatctttgaaaaaatgcaaatgatatttcactacagagcttgctgagtttctttccatttttactcaaaacaaaaagatcaacttggccaggtccagtggctcacgcctgtaatcccagcactttgggaggccgaggcgggtggatcacgaggtcaggagatcgagaccatcctggctaacacagcgaaaccctatctctactaaaaatacaaaaaattagccgggcatagtagcgggcgcgggcgcctgtagtcccagctattcaggaggcagaggcaagagaatggtgtgaacctgggaggcgaagcttgcagtgagccgagatcatgccaccgtactccagcctgggtgatacagtgagactctgtctcaaaaaaaaacaaaaaaacaacaaaaaaaaacctcatatttttgtgtatatagctagctcactgcctctgcttcagaaggtttttgataaattcttaaaagaaaaaatgaatagctcatcgagatattattgtggccattttatagataactaaactaagaagctcagtcctccagcatgaggacaggtgttgagatggatggcagagctgggccttcctcctgactcctggcccagggtcctttccgttgtgaggccagcagtggtgacttgtgtctgtaagagtctggccttcgtggtcctgtgggtgcatctttttcaacttcttgggccagaggctgagcacctgggcctttggcatctccttgccccattctctcattctgtatagatgactgcctacaagcatttctacccccatttcctgatgtctgcttttcaacaagagatagcagtacctcccacacaccagagcagaaagtaatatcacaagcaccttattatacctataggcataagaataataacatctttgtacctgggttcccagaaatggagtccagtaggcttatttaagctcattattgtcatccacctcaagagcgtcatcaaaattgactctctaccaggaacaacattgtttatggactgtaacttcatggggtgatttagaaggatggagaagattgggcttctgaacccagtcccttttcttgctaaaattatggatccataaaaggcttatggaaagtattcagaaatagaacaaagatctcaggaaaaggttgctttctagaaaaagagactgcagacacagcttatagaagggtctagaaagaacgttatttggaggggtggtggaggggtggtggaaacccagaggggatggaacgtccaaatgaaatgaagagctccaaccccagattcaaaacccaaacagagctcttaaaaagaaaccatgaaagaaagggatagaaggaacctagaaacaggcagagaggccaatgattggccgtgggtgggtatagaatctaggaagtgaggataggataattagttgtagagagaaaagttacgaagttgctgacagaattggtagtgactgaatattgagtgaaggttgatacataactttaatcatatcattctgttatttgttactctgttaccatcctttttatttagtaactgaataatgagcaagagagttgatattgatgaagaccttcaaggcacagtatttatcatgggacccagctttcttggaatatgtgtcagggagcatagattcacaaaagaaaattttatatttgtgaggacagtataagtatttggcttgtatttatgtcctcacacgctacacaaataggttttctgtccagtgtgccacaatttatgctgcagagtcttattacaatattgtaaattgagctatgtatgaattttcctctggaaataccattattttttctgaatgttcacctcagccaggcactttaaaacctttgagtcaaaaaggtggtatctgaattaattatatatttgttcagaaagaaatatttgctgactggcatggtttggaataatgattattaaggaatctaattcatttgacaaattgcggattgccggagatacaaaattctcagtgtgggaaacaaaatatctcctttgctaggtcttgcttggtgggtgacaccaagcatccctgtttcatttccagaggatggtgtgcaggaccaacctctctgggctaatgaccctggaaactctagaatttgcaccttgtctttctgtaggcacaaaacgtgcatctctgtatacagcatctgctcgcttccaaagccctgctgattcttcagaaccttcaagaatgggacagttcacctctagccactatttagaggttttcctagtgctgtctttgtgtggagtgtcctttccaagccctctcttcctatcaaaaactcatttatcattctatgcccaaagcagatctctgtgtcccaaagcactcaacccaaaaggcccaccatatcttctgtctccagtgtccagctcaggtgtctgtgtaaacaaaaggcagtatattgagacggtgaagagcatggattctggaacgagaacacccaggtttaaatcctggcactaccacttaccagctatgagaccttgggctagtcacttcatctccatacttcagttttcttattgtagtaaaactctgcagcataaattctggcacactggtcagaaaacttatttgtgtagtgggtgaggacataaataaaagccaaatacttatactgtcctcacaaatgtaaaattttcttttgtgaatatatgctccctgacaatggtgatgaaaatagtgatgaaagtacttacctcgtagggtttgtatgaagacttaattagttaccattttcaaggtgcttagatcagtgccttccagacagcaggtttaatgtatgaaataaaatccagagatgtagccatttggtgctgaggctgtgattggctgggttttgggttgtgtttggtcttctcgtctggactatacgttgctgaggggctggccagcctctgcttctgctgtgtaacttcctctgcatgaacatacaccgtgcgcaccagcagtcggtaaccgggggagcagatgggatccaaccaggtagcaggtacctggcttggggagagctccaggctcctgaagcaggtgctctccaccacaggacagagtgcttcgatgcacaccagaccttcagaggaccgactgagattcttctcttagtgccccagagaagatgatcccatcagagaaggaccctaaagagaatgagagagaaggcccttggtctttagaagagaccagatggtattgttctgttagagtaccactcttccttctggagtatgtttctccagcctcgctcagggctcccttggtttgagtgtatttgccgatgctggcgaagacacacaccgtgggtgaccccagtcagatcagagtggggattcatctctgccctcttctgggcatccactgcacggtattcacctcttctagaactcttagtgaagttgttcattggatatgaatgtgttttctgcacccaattttgaaagcatagattgcatccctaaactgctacattcgatttttgaagtggtacactcgccgagtacctactttgtaacacacagaaaagtgtaactcagcctgttctcaacaagcttggcatctggccaagagacattcaaataacaataaactcaagacgtagttaatgaacagtacaagacagtacagacaggacgtactgtaggagtttgaggggagtaaaacgcccccccggccccttgtgggctcacatgctccagggaagggctcttggcacagccagcatccttgtgtttaggggatgcaaaacaaatagttcctaattcagctttatttgaaaacctcccagtttcccagttgggaaaaagccaagcccaaacaagatctgcatgtagttcagccttaggaacacgacaggcagaactgtcctctgcttttcaaagtgtgcattttatacatctaattttatatgtcaactgcgcatactcagagaaagataccaaagtctagattttgaaaatgcaactgaaggagtaactgttggactctgccgttagtggatatggcagaattagctcaggggcctggggtctctagagggtttgcttctggctttgagtttgtaccatggccctggctctctggtggacactttcatggcacattccctttccagctcaggtgctgggacacttggctttgtcctcagtgggccaaagtgtgcaagtgcatacacttctttgtcagtagggagaaatagcagggagtgggcaagttgttgattattaagttatagggatatttctcagatattcaggaagtatgtttacgtttcttctgcatgtgtttcattttcccagctaattgccatctcctcgatggtacatcctgctcctttggagaatgggagtggagaatttgtgcctcctttccccattcttcatactctcatctgctcccagggtttcagttacccacctgtgttatgacaacagccaacactagccaagaccctcctcccaagctccaggtccttatttctaatgcttctctctgagcctcccaagctcatgagcacccctaaccccaaggcctgccctgttgctgtgtttcctattgcagatagtgatgccaccttggcctgagcttgtctgccattcctgtgtctgttctcttagcccagggcctcattattttgcctagaccattgcataagcctcctaatgggccattttctctctgtctcctgcatcctgtcttctacaccgtcactcaggtcgcctttctaattcatagatgtgctcctgtcattgtctagtcagaagaccctggatgactcctcattgtctgagtagggagcctgcatttcttatcagagcctgtgatattcatcatagtcaggcctccacctttcttttcagcctcactttctgccccatcctctgtgttctagacacacttgactttttacctggccctaaacaagccaggtaaattacagcctctctgtttttgttcccattgtccattgatctctgtctcccttgtttacctaatgaaggccagttcattcttcaagaccagcttaaaagttccttctctgcaaagtcatgtgcctggaccaccgctccactgcagcgtctgccactgccacactgcatggtgatctcttggttgtctatttgttcctggaagttaacttcctgaggactgtcacagagtcttatctttttaactccaaagccttggccatggtaggcccaacattgctggttgtgaggaaggaaggaaggaaggaaggaaggagggagggagggagggagggagaaaggggtgtgttaggccattcttgtgttgctataaagaaatatgtgaggctgggtaatttataaagaaaagatatttacatggttctgggggctgtacaggaagcatggtgctaggcataggctcggcttctgtgaggcctcaggaagctttcaatcatggcagaaggtaaagggggagcagcatttgatgtggcaagagatagagtggtggggggaggtgccacacactcttaaacaaccagatctcccgagaacaccattgcaaggacagcaccgagccatcagggatctgtccccttgacccaaacacctcccaccaggctgcacctccagcatggggtttacatctcaaaatgggatttggagtggaggtccaaactatgtcaagaagtgaaagatggaagagaggaatgagtggatgcctttgagagtccttaagtgttcatgcaggcacttttgttccatcttcccaaggtctaaacatgtcacatacttttttcagagcgccgacacgtagtaggctcttagtaaatattggcagatcgacatttttcacaaacatgtgacatttatagctttaaaatccttgggctataaaagcataggttcatactctttctgctgataaattaacaattctgtttgtcatcttttccaaataatactgcatttgctgcattgtttgtggcggaaacgatcagcctgcatcagacattagtagcccctattttttttttaattcacttaggaaaaagctgaagacagatcatttggtaaccagctgggaactccacctcacatgtgggcctgcttttcgacttcatgcttaggtcctgcaaagttgaaatgggtaggtccctttggaaaataaggcaatacacataaaaggagaataaccaagactttcatttcctcctgaatttgaaaagcagtgctgctgaatgctttgtttccttttattaccatattgacgtttacgttttgtaactatggtcatggagcagtcccttggtgaggggtgggaggtcaccctttccccatgataggacaatgccaaacaaagggaccctgacgatggtagaggtctgggctggctaccttgccgatttttctgaagctttgaatgtagcttacgaagcaaagctagcgagaaaattctggatggggttcccaggcgaggattgtaacgagcataaaatcaactaacattaatctcgccctttaatgatctatgcatggtaatctaacattgcattttttcctcctccttctgtccttggcggaaggcagcctgctgagctcctgcttgctcaggcttcctgataaatgtcaagccatctcttggagctgggacgtagttagacagctaagaagtcacatatttcctccaagttatcctctttcccaaggatatggcaccatgttgagggtaaagcattccacactaggcacagaacagacactattaacctggaggaaagctgacatttctgccggctgccgcagtgttggtattttatttgcttcccttggggcctgactgcatccttcgtcttcctggtgatgtgcccaggtgaagcttaaatgccatgtacagggtttctaacaggttgcggaagaaagaagccgcaacacacggggtatgcctgagtgagatttcattttgagtcctacgaaagagggagcaaggactgtgcacctgcccctttaaactgattaggacagcgcatttgcaggcaggatccgtggtggggcctttctcatcagttataaggaacggtggtgcaaatcttttggaaaaaatacaataaatccatagctcactcagagccaattctatattatattttgctttcaacgttgagagagaaaaatcatgttttaaagcttattaaaatgttacccatatagatagtttttaaagataatttatattagcactggtgcataaccttttaaattaataattcagagctgtgactagaggtttcagtaatctctagtagtatattatctgactgttccactgagaaattagcacttatggactaaggtataaaattgaaaaatctaacccatttggtagtctgttgtcagctatgagagccttcttaaatggaagcctattagtgtgagaattctgatttctagaatcaaatctgttttaggtcattatggagttttataaagaaaggcctctgctgcctaacaacacattgaagtcttaaaagtaggcagactattgatttttagcaagagttttactgccccagacgctgaagaatgattctcgtgactaaaatttataggttattaaagagaagaatgcagggaaaagactagttggaagattcacaaaattagctcattttgtctgttagattccacttagcactcttttctgaaatatagacatatctgaagctgaaaagtgttacttggttacatggcaaatttatatagaccaaaaatatactggaatcatattttagctcacaaggacacaatcactttttgtaggcttgcagagaaagggcaaagcaattttttttttttttgagaaggcctaatttgttgaaaagaccagggttggcagacctagccactgactgactttttttttgaaatggagtttcgctcttgttgcccaggctggagtgcaatggtgcgatcttggctcaccacaacctctgcctcccaggttcaagagattctcctgcctcagcctcccaagtagctgggattacaggcatgcaccaccatgcccggctagttttgtatttttagtagagacagggtttctctatgttggtcaggctggtctcgatcgaactcccgaccttaggtgatccgcccgccttggcctctcaaagtgctgggattacaggcgtaagccaccgcgccgggccaactgactttttttaaccggggaaaaaaaacctgttcggcccaactaaacagatatatatcagaaaactttctccagtttgagttggtatttaaggcagcggttctgttctgtttggttttgaatcagtttctaggcctccgtttagaatagaggagactttctgaatcccttgggagttatagtcctatcttgtgcccttaaaaacgatgaatagttattggaaaggcatacggtgaaagcaataggtatactcttcatcatatatgggttaaaatataaagtgtaccatatgccagaggcaatgttgtgtaggagaaatggcggaactaggaaaattagaagggggcatgttgcctcagcccccttggcaggtgtgacactggacccttggtgcctcattgtctttatctgtcaaatgaaagccacatcatacccccatcaaccctccaatcaacacagccttaggactgtcattcagcctctcccatactgggacggcagacagcatgagctcagccaccaggaaaagcagtggtcccacagcactggtccccaggttctgaggtgtgcccagtctccacggctgctcaggtgaggatgagatggaatcatctatgtggaagtgcttttaaatgtgtattgatgtaagaaacttaacatacagcaatttccaatttaaaaaaagaagtacttgctttcaataccaggcacatagaatatattccacaaatgcgtgtgttatgagaggagaatttctgtatccagattactgttgtctcctttaaagcagacctccgctcgaagcccattcaggatgatttcatgtcagttttatattcttatacctctgggtgtctgcagcagtctcgcaaggggctcttggcttctgactatgcattttcttagacctacctccccatgactgccagagatgttccaaagtgcaaactgagccagcgggtctgctcccactgtgaggtgctggggcgtgggcaccctcaggtggcgactgccccactcagtgaggataaggcccccacacctcggcctggacacacagccatatatctgctgagtcctgctgaccctccactttccacttacacatgcccgtcccccagccagtcggagctactagaattccccagatgtgccctgcctggccgcttcctgcattcatcccgttcagcctagccctccttctctgaaccctctgccccccaacccattcttccttcaagaagggactcaagtgccgtttcctcttggaagcctttgcatcccctattcccactgaatctggagttcctcctcatctctcattgacagccttactatttgtacagtaatttttagtctctatatctgccttccttaatggactctgaccctattgagcgtagggttcctgggccttcattgctctcccataccacttcaatggggaacagatcataggctcttggtaaatatttcccgagtaggtgggcagatggatgggtgggtatacgtcagctcccttgtcttacctctaatgtctagtgtgtcagttgtcgtgagcaaacggcacagcagagggattaggaattgtatgttttattaatactcataagtaatcctggctcctgctcgtcctccagcaaaactccaaaggctttgtaaagatgatagaattgggaacatttaaccgggtctcatcttctgaagagttctcagggctgagggtaaacaccgtggaaggacttgacgtgtattctagggacaagggaagcattcagaatggagctttggggatctgagtgattacaggacagggaagaagaaaaaccaccaagctgggcatgcaatgattgtatcggggctaaacagagttcctttgctgcgcctccctctgctgataccacactgataccagcagagtgacctctcatgaggactcctctttaattgtgagcaggagtgactcagtaggtagtagccttcagaacctcagagaccatgggagatggcaggtgaaaccgatgactccttgatctgagcagaaggaaaattcaaggaaagccgctgccaacatgtgcttctgtctcagcagcggctaacagtcaccatcattccagctgtgtatgtgctgtttcaggaagcctaataaatctggtgatttaattacacgaaattacttaatcagagaaattttatgctacaaattattactttaataaaccagagagaataaagaaaaatttcttgaatatctttgccaaatcagtctaggcatccattttcaatttaataactaatagcagaggagattgaaatagatgttattacagatttttacaaggcaaaatatatttaagccggatcagaaggttaattaaaattatagttgggtcttgtcattaccaagctactctttttctttggtacagttgctccgagtttagcgtctgtttgataaaaatgcttaaaatggaatcctcatttaaaagagaattatactccgtattatttctgagcctgatctcatgtacctacgtcggaaataaatgcataattaaccctttttcatgataaattaacattcattttcctaggattagtcggaaatagcataatccagggcaggttttgctttcattctaacagtcccctgggacctctaacactcttaaaggattagtaaagcctgtgattcattgtgtgtctatgtacatgaaaataggatgcagttcctgactgtcagggagagaggttttcctaattgacagcttttataagtaaacgtagaaagattagcctgcaaatactgtgagggtgactttggagacctggctgggatgtgttagcaaaaggatgatgtgtcctgtgaatattgaaaattccaaatgcattctaccaggatttttagacaggaggttacagcagctgttgaagtcaaggcccctggagaacagataagcttttaggggaagttctttgtctggtctaaactcttggggttttcttgcttatctgagcccacttttatgaaccaataggtttacatttacataaacagtgtgggttattttatttgatttattaagaccgggttgaaaaaagcggaggcttattggagaattgaatctgagcttccctgagtttttaattcaaaattcccaaagccttaatgaatgtgaataaatttccatgaaaagtcatggggtagggagcctgtattttaaatgcttagaggggaaaatggagtccaaagagacttctgctccattacttagtaacaaatagggtacaggtttcctttggtttggtccaaaacacagaaatttagaagagcaaattgaaacaccatctgttgactaggtatgatacctggtcatattacaggcattttacatgaattatctcaatagagaacttgaaagtaaagagaagacatttgtgagtagtgtaacccagagagagaatggagttcattgccccacttccttttcaatgacacacacctagtagatgcttaaaacatgttaagaattctccttggatttgtccttttagtggaattcctatcaagacaggctcagcatcacatagcagataaccatggtggtgagtctcttcctgtcctatacttccatgttgctcatggaggcctttgattagcaattgagacaggagagttccctttaccctctggtgggacttgcagcaggggtggctcctttgctcagctgcttccacgtgctcaaaccccttatggtgggtggtgcatgcatgtgagtgggtgcaggagctggggcgagtgcctttgggcactggcaggaacaaacccccataccagcccacagcaatgtctaggggttgccagcaacctctggagccccagagggtgtgtgttacaatcagtgctcttttagtatgtgctgtctgtggatggctaagtgttacacagctcagtggagggtcactgtgacagcttcttgcacccgcacctgggtccttgtctagtgcccaagaggaatgaggtcacatggacttgaaggatggtgaatgtggagattttattgagtggtggaagtggctttcagtgggatgtggagctggaaaggggatggagtgggaagataatcttccctggagttcagctggggactgaactcttctccaactgaccttggccaaattctgtgaccgtagtctctgacatccagctgcctcttctcctcttgatgtttggacacttcttctcttctctccttttctgccacagcgctctgctcctctgccagtggagctttggatttttatgagcacaggatatgggccatggtaggccaaaaggcaacattcgggcgggaaaacagggatgtgaagttttcgtttaggtccgcaggtccagcttgagggtggagccctcgccagggaccccaccatcttctacctagtatttccctgcctcctgtccatatcaaaatgattaggatcagcttttggggaaggtactttttagtttatgttttaacatttaagatctagcatagcctttggaaggcaaaaagtgaactctagtcatcaagtcaggggatcttgatgttctcaggggcactggatgagtttgtcagattcttgtcccataaagacagtggtccctcttgacaagtgaccctggagttagtcctgtgtcctggagttggaggcagcattcaggggtgatgagggaaatcagtgggaggtgacagaggggatggggcccagcccactgcccttgctgcagagaaacttcccaggggcaaggtatacttaattaactgccctgtctggaacccatgtctaaatatcactaagggttttgttttcaaagagaagctattaaagttatctgaagtactgagaaattgtttacatagcagagttcattgtgggttttatatttgaaagaaaatctgatacgagtataatctgcatgctggatgtggatggcttcaagaaacagttggatcaaataaaactaatgatgaataaaacaaccatagcagcagacaatatatatgagatattcagcagagcccatggcctctgctggacagacggtgggaaggggaagctctgtgggggccctaaaagaatttcttgttaaccccccgaggttggcccttcctctccactggccatgatccacctgaagggaacttgagcatttaattcaacagaccagcatgatacttcctcctgtggcctgatgagcaagtggagtgagcccaggcctgcagagtgacacaacagtaggtagacagttgcagaaggaaatagctgacccagaaggactctgggccagggccacccagcatgggaactggtttacacatgctatggaaactctgttttgatcacatgggaaacttcaggagctgatttttccctgccttgctcaatcctcttttgaaccctatcttaatgataacatggtagcgggagagggcagctctttcagaaggcaaaccccaggaaggcagacatttctgctttgtctgtgttattcactgccctattccaagaacctagagcagtgccttgtacttagcaggtcctcaataaatgattgttgaatgacaatcacacttgcctgtctgacctaaaaaaaaaaaaaaaaattccctggtttttgaaggtttgaaccactgactcttatttatgtattatttattattttaataggatacaagtggtttttggttgcattgatgaattttatagcagtgaattctgagattttagtgcagtcatcacggaagcagtgtacaccgtacccaatatgttgtctatattcctcaccctccccccaatcttccccaccaagtccccaaagtccattatatggactcttaacattttaagaatttcatgaatcaggactggattttgcacttgacatgaaggctgactctcatgagtatttcatagcagtgcttctttgaggatcatggatgtaaagcagcattcctcaggttgtgtcctggtcacttagaatgcttgattaaaatgctatctcctgggatcctccctagacctgcaacttgagagtatctaaggttggagcccggggacctgtattttaaaagtcaagctctctggactgttctgcacgttaaaactgagagctttggtcttaggcttgtgccaaatgagtctaatgcagaaactgggaaggaaaaaaaaaaaaggactttggttacaattaattttgaaaatgaactcattcagcattctgcagacattacatgccaggcattgggcccaatccacagggattttaacaggattgagatagtcttcaccctccgtaagcttaggatctggccagagagagatgaaactagggatcgccatcaaggagaaagtaagaggcttatgccagaccacgtgttagagttgttccaaggagaaaatacggaggggcaaagggaaggcctaatggagccccacctgcaatgctgggtgggatttaaatcattggcgatgggaggataagtttgaatcctgggaagtattcatttgggaaagacttttggagccgttggcaaattaggaaaaccttgaaagtctgatgttggggaggaagttcttctgctatttaaaggttaaagaaaatatggcttgagaagacacagttggatttgagattaagaagattgtggtgggccgggcacggtggctcacacctgtaatcccagcactttgggaggccgagacgggcggatcaggaggtcaggagattgagaccatcctggctaacacgatgaaaccccatctctactaaaaatacaaaaaattagccgggtgtggaggcgggcgcctgtagtcccagctactcgggaggctgaggcaggagaatggcgtgaacccgggaggcggagcttgcagtgtgccgagatcgcaccgctgcactccagcctgggccacagagggagactccgtctcaacaaaaaaaaaaaaaaaaaaaaaaaaaaaaaaaaaagaagattgttgctatccttcaagggaggaaattccatgttttggctggaatcagagtttaaggagtgggaggaactggcagggaaggaaaggagactgaagtgcactggagcctcctcccttcttgtctctagggtgtggtagaagacacttggcggtgggatggcattcacagtaagaccgagggtcagggtcacatagtagaggctgcacggccgggggaaggtgttgttgggaaaaggagatccgaatgtgtttatgcccagaagaaaactgtggagagagatgtgttgaagatgcaagagagaagtgaagtggtcccacggaacggttgtagacccaggagcagtggtgtggtggatttaaatagccacaaggtaaattagttcagccattgtggaagacagtgcggtgactcctcaaagaactaaagacaaaaataccatttgactcaacattcccactactgggtatgtacccaaaggaatataaatcattctcccataaagacacatgcatgtgtatgttcattgcaacactacccacaatagcaaagacatgggatcaacccaaatgcctgtcaaagatagactggataaagaaaatgttgtacacatataccatggaatattatgcacccataaacaagactgagatcatgtcctttgaaggggcatggatggagctggaggccattatccttagcaaactaatgcaggaacagaaaaccaaatactgcatgttctcacttgtaagtgggagctaaatgaaaagaacacataaacacacagaggggaacaacacacaatgagaccttttagagggtggagagtgagaagagggagaagatcagaaaaaataaccaatggatactaggcttaatacctgggtgatgaaataatctgtacagcaaaccccatgacacaagtttatctgtgtaacaaacatgcacttgtacccttgaacttaaaagtaaaaaatagaataaaataaaaataaatcgccacaaggtcctattttcctctcccttcaagcccctctctctgtctctctctttccctcatgagagagaatgtgagtttctctcttgtgagtgtgtgtgtgtgtgtgtgtgtgagagtgagagaaagagcacatgaaagagagagacagagacagagacaccaaggcagaacaactagaaacctcataagtacacagtgagggccaaggtttcttgagcttggagagtaacagcaattcaccaggttgattcctgattggaagtgatttcagggaccaaggaaaatgctgtttatggccatgattgggtagctgatctacattatcatgtgagagagcaggaagtaagtttcatgtgagttatatcctggccctgtgcttgaataagggttttttcccttgggacagcctcagttttataaggagagaaatggacccaacatttcaaacatatggaagtgacttcttattatccacaatagggggaggatagttgagagatggagacaaaatgtcgccacaccatctccatgtgtctgctattttgagcattcctgagctgtgtttggggactaggacgtgttaaaggcagaatgagacttaagatagaattgctgaagacactgaggctctgcttgattcaaaattcacctcagactcagagatttcaggacccaaagctcttaggagctccgtgtttccagagaatacaaagtctgaagaacaattctaaaattcaataacacgttattaagaactgtctgtcccttgcaaggtggaatgagaaggcacaatattggaaaggagtgctggttacatacttaaaaagaacaacagttattatgaaaaacttgttttaaaaatcgtataaatggtttcacaggtggaggacaaaatgcctgtgatactttgcagtgacctccgcaactggaaagaaaataagaaaacgagggccggcttcagggggatggcagggtctggcagggctcaaactccgctaaaggcaacactggattgctgctaaagtgaaggaaagaccttatttttcaagtgcaaatcatgtgtgactttaacagtaagaattccgtcaagtagtccatagaataaatttgcacacagtttaacataacgcaagtatattaaataggatctggcattaaaagacccaacactgaatgagaatccgaaaataaatgcccacgttctctccagaagaccgttcaccctgaagccttgggcattaatttaactgaatgaggaagccactggggcagctgcccggagcttatttgatttgtgaataaacaatgccttcatttcaaatgctgttcactcttacccaaaccaaagcaagaccaagagcacaaaagagactaattggttacatagtaactactgaaaaacaaaacaatatgaggtttttgggggttagtgttggattgggtttttttttttttaggaaaatgcagaacttggcaagtactgctaatttttaagcccggtgaatggtaggatgccgcaggttatgtcttgcagttaattcttacagaacattcaaacatccagcaatgaggagttcgggtatgaaggccatccagtaaagtctagtctgtgggcttgtcagcttgagttagccagcattccatctgtggcaagcagggcctgtgcgacattggagaagggctgagaagagtggccgtcctttgctggttcccttagggagctcctgacctcctgctgccacaggcctcttcgggagtgggaatggtgtcagtgcaaaggaagcaccaaggggttcgatgggaccatttatgaagcatgtccagcaaggacttgctgacattgcgcaagatctggtggcatcccatgtctaacatctccgtggtgctgggacagacagatcaaactcggggacacagacccttggaggttcactcaagttagaacccctcaatgagtggagcaatggggaggaaatatgtggccagcactggcggagagtgtgaccttatggctcatccagatcccctgcctccgtggctcacaaacttaccgtgtgcattccattctgaaaagggaagctgaagaccaggccgtgcgagaagggactgtgttctctgggtctgtgggcctgctgcaggccaccccatgctgggggagtgaccacagcacagcccgcggggatggtggccttgtgggaaaggcgaaggcatgcttccaatgagcaaattgtatttattcatgaatttgcatgaatttcaagatgctgcttggagtttgcacttagcaactgacagcccaagaagaaatgggccttgaaggcaccacggtgatgctggaaatctgagtctgtgaataaattgtttcccaacaacatattcaatgggttgagaacaaaaaggcttgtctgcaatgtcgagctatgctttggcttcttgtgtttctcgagtaagtgcctggcatgtgggcacttggtgtggacaggaatgaggaagaaaatgttggcctgagctcccatgagtctttttcctccccaaatcatatgtgttaatggagcacggggttatgccctacccatagatttttatggtattttctttccttagagccagagaataactagaggtgtttagtgaccttctttatgaacaggttcctcttatgggtcattacatcgattttcctcatccaggcctggggtgattaagagtgaggcaggtggcctttcccacgctatggaccaggggttgcctgccagcagcagcatgtgacattaaaatggtcaggagcacatgtgactgttacagagaatgaggtgccatcttcccatcctgttctgcatgcaggtatatgttcagacaggcgactggaagcccaaatctgtccttgtgactcaagtcatatttctcatctgtcaaaggcaggcacaactcttgcaaggactttgttctaagtcatagtccttttttttttctttcttttatactgagatatcatctacataccatagaacccaccctttaaagtgttttttaagtatattcataaggttgtgcaaccatcacaacacaaagttctttggaacaatgtataattgtcttttaaaaagtctatcctgttagtggaaagttttcaacacggatttttcgctgtgagctcctccattaagtacagtgtccaagtgcatgtgtatgtgcacacgcgtccctgtgcactcacatgctccagagcctccgcagaccaacctctttggaatggactgtgaggcctgatcatgggagcctggcaagaagggaccccagagccagttgagggtgggaagtcctgccaaggatgcgagtaccgcttggagaggtggtcggggaggccccagtcctccagccaccccatgaccaccattaacatggctttggcctgtggcgagatacatcccctggactctgagactagttaatgctctcgtgggtcctttcggatctctggtctctttctccctagactctagtccctgactcttctccagcttgacactgcctgcttagatccatgatatgggtcaaatcaggcctggctccgctgcctccaggtccaactactgctggtgaacccagtcttggtgccgtttagattctgggagagctgatgaaacatgatatgggctgcatttgggaaaattccagcaaacaaagtcaggaaagagaatgttgttcagaaagcttgagcttgaataagagctggcaaatagaaaacactctggaagactatcctcttctcagcaagggggttattatctgagattgaagcctgaaataattctcaatgttataaatggctgtaaatggtgcttcttgtttgtacagggccaagtggcccatttgaacattggcctataattttttcttttgcacaaatggcagtaaaattgtatataggtgtatttgtctgttttcacacgctaataaaacatagccaagactgagtaatttataaaggaaagaagtttaatgggctcacagttccacatggctgagggagcctcacaatcatggcagatgaaggaagaacaaagggacgtcttccatggcggcaagcaagagaacttgtgcaggggaactcccatatataaaaaccatcatatctcatgagacttactcactaccaagagaacagtatgggggaaactgctcccatgattcaattatctccacctggccccacccttgacatttgggggttattacaattcaaggtgaaatttgggtggggacacagacaaaccatatcaatagggtatacattttcatgccaaagttggcgtcaacttcctttctgatgcaagaagcttcccatgctctttttattatggaaacgctgctgcttccaaattggttcttgcagaacatggtggtcctcatcataaatgagaatctccatatttgggagttagaaactgaggatcttggaaaaacatagcacatcaaatactgtgtgttggggcagaagcactgggctggagaactgaccttccagtgaccacacggagaaagtctagagtttcagaaaattgtggagcatctgtttcccagactgtgcttcaagatgcctgtcctacccctcctgtctatccagtcaccctcaaagatgaagcccagcaccagggctcacctctcacctcccggttggcatcccaactctgttttctactcctgagttctgcctcccaggctcctcctccaggttgaaagccatctggtctctctggctgcaggagaccatcttgcccagaattctcctgagaaaggagtatgtcctggtttctgcttttgcatggatttcctttgaggagttgagcagtaaattaagatcgtgtaacccaagaattaagaatttattgttgttattgacaggtgccctcctttctaagtagttgaggaacccacactggcttgcatagaattggatgtggcatgtgagtggatattcagatgtattcatggctgtgtgcctggtggtccctgccacttgggggttgtctaaatgcatgatttgttaaaggcaatacatccttttgtgaaacgtatattgcccattaattggtcattgatctccaacccatttaggacagttattcttgcagataattgtatgcctttgtcatgttgtataacactgggtcttactttattgcttgtggattatggtttcatcccaggcacttgaatgatgtctaatgatttcttactgacattcattcagcaaatattccttgagcatctactgtgagtgagatgaaataccaaggacgtgaatacacagagatggataagtgatgtttgctgccttcagggcattttctgactgattgcagaaacaagacatataccgaaataactattatgggaaagtgctaaacacccttcttttgtcatgttggtgggaatgtaaaatagttataagagttttggagtataatttgacaatatcttttgaaattaaaaatatctttcctttgactctgtagtgctgtttctagaaatttagtgtacagaaatgtggcacataaagacataaattccagaatgtttcctgccacattatttgtaacaactaataataaaaaccaaaagacaaaaaccaaaaggcttttatatcctgcaataggagactggggaataaatgacagttctcacaatggattcgaatgaagctgatagcagggattaggcagttttatatgttggccaggaaaaatgtccctgatatactggttagtgaagaaaaagtaaatttcacgtgattttgttttggtaaagaaaagaacctctgtatattggaatccttatggttcagttatcagtgggaggtgggattaatgaccattttatatgattgataagctgtggagtgataggtggtcttcacgttttgttttctgaattgacctaagagcagctctggtgggtgggaagacaagggagatgtgctatcccttcaaacctctgtgtgtggtcacctgtggcccacacgccacagggcttctgacctcagccttccgtgcagccgcagtctcccacttcacttgtccatggtgggctgtgaacctaacaaaagcagtgcagggtgtagtgcaaggtcagagtgttcgtttccagccagccctccacattcacatccagacccagggcccaggaaacactgaaccttacactttgaaatgagggccttgctgtggggacaccctgacaccaagctctgtgtgtggcatcagatcagtacttcccctgttctatgacatgtcctgtgaagtaagagtggggaacacagcagactgcatagtgtggcctgcacgaggatccactacatggtagcatataaaggctctgataagttctgcagtgatgaaaagtgctcagctttcttgaaaccagtatgacccagtgacctctttattcagatccaagggacacacttgggaactgctgggttaggggagagatgagactagaacgagctgggccagtgtggggtcctggtgacactgccctcctcagagaggtagggtcagaaggtaactaaagtggtctactagggatcctgactttagtaactctgaagtcaggtgagaaactggtttgtgttttggtccctactcattgattttggttctcagttggattgtccatagttgaatatagccaggatgcatgttggcactttttaaaaaaaatgtggctgtatcacgcctgatgacttagaggatggtaaagcaccgtttccttcaaatgcaaagcgtttgctgcggaggatgggatgcccatgcgtttggtgagaaccaggggtccagtctgtgtgctgtgattgggaggaccatgtgcatggctcataggggctgagactgtgttgaggcctcagcgctgctggcagagctgtccctgtgcccctgtaagcttgccttggcacccactgcctttgcagccaggatgaccccctctggtactgggctccagctttctgcagagcacctcattgttttgcccactgtgagtacctcttgcagtggggagaatctcccggacttccttgtttgtggtggcctccagcatcctgctgagcagtggctagacatcactgtccccaggctgatcctgtcctcccagcactgctggctttttctctggaataatggtgtcccttcctgtggtctggccttactccacattccacggccttccccctcctcctgacctgccatgggaggcttgaagtttaattctaggttgcatagagcaatctctttgggcctgcagagttttctcatgaataaaatggggaagccaccttttctaccctttcctaaggttttttcctgaatcattcattcattcactcaacaagtatcttttgagctaggcactatgcccatccacagtgccagccctcatggagtttacaatctatttatagttgtatattttctctgtgtacttggtgatcctggcagcagggaaaccttcaatcctggggtgattctctcgctaaattgccttctgggcagcttaccaaccaggaataatgattctgctttccagccacatggccatttactctttgcagagaacatcttcctttgctggtgaggggaagtgatctgatgggagttctgcatcaacacagttcagggactattcctgaggaagtaggaatgacaagccgtgtaccactaggactagatagtgagattaacccagagaccaggaaccttccttcaaggaaggcttctgacccaccaggcttaaagagtaaggaatggaggacttttgtgtgttcacgttgcagtgtttgtgcaaagccaggggatcatcagagcatctaagagatgcttctctcaccccatcaccagctctgaggttcaggacaaaaaattggacagtggcagtccattcgttcattcctttattcctctgtcaggctgtcattcattgtatacagtgctggaaataggaagcttactaaggtagttctatagcaaggaactcccagtttcacattcaattcatgtgaacagatactgtgacaagtaccactgaccatgtgatggtgttgtgcacaggaggaggggaggaggagtctcatgggaggagagggtggattggtgaggataggcaggagatgcttctttcttcaaggatgaataggaaattacttggagatgttcaaggcatggggacagcatatgcagaaacatgaaggcttgaatgaacagagagctctatcccttctgaggggctggaaggcacagattcatgggcattgtggtgggtaggatggtgcttttagctgccagtcaccggactgctggtgtgctgggtatgcccaagcattgccaagcagctggttccacagggtgcgatcagcagtgtttctgccccttctggacatctgatacccagatctagcagcttttgagtattaggcccttaaaagaagtcattaaaattctactttggcatagacattgaagacaatttgatttcaagtcagccagcagcatttcctcaataaatgacttccaaatattctacttccagacttcactgtccactcacaaatggcgcccagagagctaatgccagaggaaatgtttggattaacctttcctttaaattcttaatgtttaaaagcaccttttcacggagttcttaccttattccttgtatctgggagagcaatgcgggttgcagctgagtccattgttgtctgatcatttgaagacagctctgttgctagactctgcaaaggagttatttcggcagttgagagtagctagttataattagctggcattggcaatgttaaatttataaatgagggcacccccttgcaatgcgttgggggaggagataatgaagcctccccctagtttggaaacacaatgggtacagctaaaattaaagaacaaaagagaaacagtgtaaagcctgcaatgaaatatcatctctaattgggttttccttccacaatagcagagattaaatgcagagtatcaacttaacctttccatttgctgcttttgtcagccaaaaacagatggttaacatgatttatatttttgttcttattgtagatcttcaccatttaattggaatcagattatcaggctattttgtaaacaacctggaattgaggtgtttgttttatcactgaatatgataaataaagaatgagtggggatggataacatgtttggctgaaccagaaacacattgcatgggccatgttggggcaaaacagatttttgaagcagttctagttgtactccagaattcaggcctccacactgtttggggtatgtgaaaggtttgtaaaagcatgtaaatatcatttgtgccctgaatgaaacatgcaaaataaaattctgtttaaattcttcacaaaactgaagaaaatcgtttaaacccataacttcgtttgaaattcctcctaatgacctgtcatttcctccttttgaaatgatcctattacattaatcagattgatgtagtggtgatagattattctcattcaaaggaatactcttgtgttgtccttcccaatctaccatctagaatctctaaccaagaagagttcagaaagtgatggctctgttccctgcctttaggaacacacagttttgcttggtttgattggagctttgcgttgcctgctttcagtggcgaaagaggcccatttgtgaatggaaatatcgtctccttcagtacctgctccaagtaagactgattcacatgggccactcaggcctgcacggggctgatcgtggccttctttgttttctagcgtttgcttttggtgggtgtgctggagagcctgttcaggagagggcttctccctcccttactagccagattcataaagcagagttggttttacaaccatctattttttaccaagcccataaacatctatgtctctggcactgcctgtggctccggcgtgtgtccagcatgatgatttggtggcacagagaggggctgtttacaccccaacagccaaaccttccatttttcatgaggcactaggaaaataattgtgctccttcccattttcctcagcattggtttccaagctttgcctttgttaccatattttgctgaacctgaccatgctttaaggataaaatgtgctcggaaaaattggtgaattttgtggtgatatgtacaatcatcttttataatttaaaaaaattccattaatatgtatctgttctgggttgtgggagacaagcctttgttttccttgaggccttctctagctgcttgcaggtgacttgcagcaaatcattttcatcttgggaccttctgtcagcaccccatgaggaaaaacaggtgacaggtggcatcagctgcttgcttcttccttccctctgctagagggggaaagatttagaaggagggtatgtggctgtgtttggcatggctctgttaattgctaacaggttatgagagcccaagagactggatgaagtaattgtgctccggccagtcatcagctttgtgaccttggcaagttattttgcctgttttaaatctatttccctatttttaatatgggaattataatacataaccataggattgtcatgagtattaaatgagataaagttcttgacacattagagttctgggaagctattcacagtgtcattatttttaaatgggactaaaaatggcaagaatttttgctttactattaatatatgtggcacataaatatcctcttccagaaagtaggtaaggtctcaagcagtcagttgtattttctgaagaagccctagcagggttcctttgagtaggggatccctgtgcatggaatcatctccactgatgagtcagcagtggccaagagcacagaggcacagagacctcaaagctggaaggctcactctggccgggacctggtctaatatacaggcagatacccattcctctctgtgccagcctaggacctggcatactgtaggtgctcaataagggcttgtgatgaaggcattaggagtcactatttttaaagttaacttcagttgccattcacagaatagtgaacaaatcataactatacagctagatgcagttttacaaagtgaacacagctgttgaagcccagccaatggagaaataaagcatgaccaggatccagaagcaccctcctaactccttctagtcactttccccacaaaggtagccaccattctgccttctgtcagcatggattaagtttgcctgtttgaactttatataaatggaataataaaatatatactttttgagactggcttcttttgcccaacatgagttcataggactcagtcatgatgttgcatatagcaataatttgttaattttaattgctgtatgtttttctatcgtatgactacattgcagtttatcctttctacagttggatatttggtcgtatccagtttggggctataaatcaagcagcaatgaaaattctcatttgtgtcttttggtgaacgtatagacacattcctgttgagtaaaattgccaggtcgtaagagaatgcttatattcagctttagtactgccagacagtttagacttccgaagtggtcctaccaattggcactcccaccagcagattgtaagagtgatggatggacacactcatgtttgtttttgtctcttcattttagccatcttggtgggtgtgtagtggtatctcactatggttttattttacatttccctgatgtaatgatgttaagcacatttctgcatgtttctttgcccatttaaatgttctctttttgaaatgcatgtttgagtgctttccttattattatttctttttattgggttgcttgtctttttctgattgatttatagagtgcttataaaatctggatataagtcctttgtcagataaatgtattaaaaatgtctcctcctatgtggtagcttgcctttcacttttcaaatggtatcatttgatgaacagaagtttacttaatgcagtccaatttatcagttttcccttatgctaggcattctttgcattttattgaagaaatctttgcttactccaagtcattaatatagtttctcatttcttatagtttctcatttcttagaagctatattgtttatgtccacacttggtcaagccactactttttaaaggattctcaaataaatggaagctagccaaaaaataatgttttaaggcagtggtggtttaatttctaaaccagcagacagcactcaacctgtcaggaactctggggtcatttaagtgggatgtagttgacaaagcctgttgctctgcaaaggcttgaccctgaccaggtaaccatgggagattgatcacttttcacatgtatcctagtcctcacgtgcacaaacctactcttgctctagaaattccagaaagatgtataaagggaggaaggatggtgaaatggtaaccctgggtgctctgggaaatgcttcattctttgtttatcagtcagagtgtagctcattctgtctctgcaacatttgagaaccttcgtgtccaacctctaaacccagtctcctggctctagaacttcatagatgactggctttgtagtgttaaacaaatcccttaactacctcagcctatttcttgatctgtaaaattgggacaataaggaggccccctcggagtttttatttgttggatggatgaatggatggatggatagatggatgcatggatggatggatggttcgttgctctaaccattaaataagatcaggtttataacacacttagtccagctctgacacacagttcagtgctcaataaaagcacttgtcatctactgtcttcctaataaacagtaattacttgctgaatactaaaatgtcatcagcttagcaaatctaatgtagcagatactaaaagaaacccaaattcttttaagaagttcacagcacatctttgccttgtgatcatggtcacaaatgtgtgtgagtttgaaacatcatcaaaacaaaagacacttccttggatatttaaatcggagcatacccaactgctgctgagggcatgtgatatggtttggatgtttgttcgtctgaatcgcatgttgaaatgtgatttccaatattggaggtggggcctggtgggaggtgattgggtcaggcgggcagatccctcgtgaatggtttaacaccatcgcattggtgatgagtgagttgtcactcagtacacatgaaatctggttgcttaagattctggtccctgccctctgctgggcctcttgcccctactcccaccatgtgacaccacctgctcccctttgccttccaccatgactgtaagcttcctgagcccagcctcaggtacttctttatagcaacacaagaacagatggatacagtgtgcatgtgctttctggtgaacgtttctaaaaggttgtgaagacggtgatgtgtgattccacagcgtggggtactggcttattgcaataccctccaaactggtgctcctgcttcctctctggtccatcttacatcatcatgcccatccattaaaattatctctttaaaacatgaatcgaatcgtgatttcccattgcacttagaatcatatccaaactcctttccacacagatgaatcagtgtctaatcttgccccatcagcctttcccacctggtttcctaccactgtccactcacacgctatgctccagacacagcagtctccttaatcatttcttcaaatcaccaagcttttccctgccctagggcttgcctcaactcactccacctctcaagtcacctctcagggagctcttccctgattactctccctaaagtggagtagaagagtcaactcctcatttatcatattatttcctccataaaatgaatcttgttcatttatttgcttgtttgcctggcttctctcttccactagtatctaaactgtatgccttatttcaggaacacagtcgatcctcaataaacaaagaaatgaatggccattggctatccttaaggccaatggtctgccaggtcttcactgtgtggtgcgtatcctcctgcttcctccccttggtaaccatcagttcctggtgccccgttctatgtcatttgcaaattccataggggctctccctcttccctctattttcccattggagcttacagcccctcaactccccagcagatctatgttttcattcaagtctctccttaaattccattttatccaatgactaaagttacttctctagtctctagttaatgatcattggctacatccccccaagagaagagtcagtggtggtgatgtagtggggtgccccttccccatttggccttctaacaggtgtgggggttactgacatctctgccaggggtttcctcatgtcaccaattcagtaacataaactgccagagtgtccccttggaatgtttcttagtcactggtttcttgattgtggctaacagaggccaacccaacttgcttcattcacagagaggagtaagaacctaggcatgtctctggaaacctaggagcagaaagcatgcctggagcttgtacagatgcttgccttgatatctgttccaacagtaagcagtccacagagagtagcagtaccaggtttctgggagaaaagtattccattgatccaggtggtgagcccagtttagtcagatgtggctcatgggaaggactcccaggggatgttctttaaccctttttcccgtttagaaaaaaaaaaaagtgcagctcaatgccagtgctcatttaatcctacataaacatgctctttgaggctgaagcaaatctgactgattttcgatgcgaaaataaaatataaaaactgttcctggagttatttctaaacagaactaacatctgaatcatctgaatcgtctatttcagaaaaaaatcagattcatcaaatgaatttttggccaacaactgttcgggaacaatgttaacatcacgtgtagggatgctacattttctaggatttggcatttttcagcaattgagaattactatattttgtaagtggaaattccactactaaaaacagaatgctataaataaaacgatgttttgtttccaaagtcaatatactagagtgatgcaaaaataataataaaagcaagatatttcatggcaaagttatctcagggtaaacgctgcagccacaagtgccactggtgaatattcttggggcagacaggaaaacagttacatgggaaaccgttcttagaaaggcatgggctgttcaaacacccagaggggcatgtcctatgagacccctcagaagcatttccatgactcccacctaagagatcacatattgaccgggaactgcagcaggaaaggctgaccagcctgatctgggaatgttcctgatggaaatgaagtagggccagagtttttttttaaggaagagcaatgtgacagcaaggacattagttagaggaagctcggttatcaaagtggaaggaggaggcaccatctggactccaaggaccactattgggatggcttggagggtggtggtagtgggagaggaggagtaactaggccttcaggaatgcagcagacccagaggttagtgctggtgttcatctgcctgaattcaaactgcagccctaccacttagcctttctgggcctccacttccttgctttgaaaatggaggaacagtgtcgaaagaagaatccatgaagagtggtgagttggtactatgttggacatatagtaagccatcagcaaatattaataattaagctctagaaggatataactgcatctgccttccagggatcctttgcggagtgcttggaacatactaagaaggagcgtttctgcatgagtctctcccatcccttggtaccctgatttcaagctttaaaataatagtggtcttgtttttaatcataatggtttgataataggaagccacactcatatcctacccagcctgaggaattaagggactggtacttgtttttatataactaaaatgtacataggagggaaagtcctacatcaattccttcatggatgtcctcaattaaatcattggaatctgtatcattaagatagactgagtccattaggtagacaggcaggtgaaatctacctgaacttattcaaaatgcttggaaattgttcatcagtaatgatgtatcaacgagagaatacgttttatatttctaaaattataggtgtcttcctacaggggggaatgtatcttcttcctccagtgtgtagtgagcagttttcgtgaacacagcttaacaccccttcagctatgtgttccctttgatccctagcttattaaaaaatgcaaatccaaattgtatcttattaatgtgagcttttgtgttaaagctgtggggggctaaaaatccctgtttctctaacatgtttggatttttaatgtgcaaagagcttgattttctgcaggccatattttctaatcaactgttatgaaggattttttattgtgctgctatttcttgctttcttggaattcaaggagataaagagtaatgacttcattgttataccctaagtattctcgagcatgttgagatcctcaataattggctataacatctcctgttttccaggagcatcctggaagcatattttaaagatgtgtctaatgttggaggtagttgatccagagaacttactgctcattgccaacaggcttgtggggcatatgggaggtgacagtgtccagccagtcccttttctgaatgtgtacaacagtccttagacccagtgtgctcttgttattaaaacaatttcttttctttaaaaaataaggtgcttgaaatttaatttgaatcaagttaaaaattgatcccattagaatacagctgcatttttctcacttgtcccatttttagttcagccagctcttcattctctcatccttcttctcttttcttcgtgccctggaataagcttcttcttgtatttaatgattattcttcttaagatcaaagccaattacttcaaaaaagccatcacatggaaatgatcattttatatttatgaggctgtccatatgtaccccctagtaaagctcattctggaacaatcttttgagcgtgggagtcctggcagggtggaagaagcaagtgactggtgaatgataaaactaacaacagccaagactattggcgtctgctatgtgctaggcatatattatctcatttaatcattaaaacaacccctgaggtttgtactgttattatcatatccccacttcacagatgaggaaatggaggcacagaggtgaatgacttgctcacatttgcatgatcacaggggtcagaagtggggtacagccctgggagtcctgttgagagtcttcaccctcaatcactgcacaccacacatgcttccagctatgggaagaagttctgggttcttctcctgactctgctattagctagctaactgctgtgcctcacctttaaattagaatattggactagattctctctgaggtcacatttggccctgaagtttttaattcttagtaactattttaaagtgttgtaaggtgaaaccggaagacaaaaggcaaaattctcaacagtccctaccccccaccccacacacatgcacacacacccatgcatgcacacacgcatgcacacacacacatgcacacacgcatgcacacatgcatgcacacacgcacatgcacacatgcatgcgcgcacacacgttctttgccttcacactagataaaaccacagtaaaaagaatctcaactatcacatcctactgtacttcattttaggcagaaaatgttacaacttgtattccaaaaaaaagccacctgcggctttctgacacctccactggggtcccccggaagcggatatctgggggaggagcgtgcgtgaggtttgagtgagaatagcggagggtctatttttaacctgagaccttttgcagagtcgctgcctcttctgttgtctccagttctaggaaaggagctttcacctccgttctcattcagagatggctctgtggttcataaaggaaattttctcttggttgctgttgaagtgttctacaaaaagaagtttgatgtgctctgtgtgaggatggcaggtggcagctttctgtgtcattctttgacatgtgccagctgacgtgaagtgacttgtggtgacagagtcacactaggcgctagcactttcttttttcttgataaaacaggtagccctttctgtggggagtcaagagctggggcataagctagtgtcttccaggaaaaaaaaaggactcatcaccatgcgtgtttttagatgagatggtgcagtgtgaaccaccagctccaaccaattgtgcagatgcgcttgacctttggtgactgacagctgccacaggatctgtcaggctgcccctcctactactcccctccccctagggccaaagggctctctcaaagctatttctgcagaactcccattagctgttccccaggagatttcgggacacaagcgcactcagcgtgttctctgtttctgtctctgtttctatctctttttctatctctacctcttaatggaacatttcaaatatgcaagcaaatgtaaacaacaataatagaaatgtatgtacaagcccacctttatcaaattgttaacattttgacatatttgcatctgatctctctctctctctcacacacacacacacacacaaataaataaataaattcactacagatcctttttcatcccatgatccccaggggtgtatttcctgtgaagctaatgaagtttaagattgtggcacctcccttccacaagccctaggagaggcccttgtagtgcatttacatgaatatatgtttttgtaaaaatttgtaaaatttgcaaaagtgagagatttaactgcaattggtgaagatcactgtcgcttttcactctgagctttcttccctccacgttcccttctgtccagcaggattggacaggtctcagatatgtgagcatctggctaaggggcagttgattttggggatacatttggctttggtttagcaggatagaattgtagggttcccagttacttctgtgtattgctaagttattgctagatgtccctgtggagtggtggatggcttccaggaatactcccactgtctatggtgctgactcaccagcaacatgacatggaggaacaggattagaggtcatacagggatgtgaatgtgtcctgtggtgcccacacttgatgcttgagaagcagagtttgaaatgtgtagagccattagcttgtctacggaaaataataaatcaaatcattaaacatgtcaaattataagcaaatgattctagtctcattgacaattactcaaactaatatggttctcctatcaggaatgtactcgatgatgtagcatatacaattataaacacatcatatttttttctgtttaaatttctctattctttttcttaaagagagtcccctaaattgtaaatgcttctatccccacaaaacctgggatctgctcagatagtgaattctgtttctctcctgatttgttggtgtttatcattctcttgcatgttttaataccttcgtatgtatgaaaaagataaaattatcatatatactcacatatgtgtataaatatataaatatgtgaatatataaatatatagtgactatatattatttatacacaaatgtgagtggtgtgtgtgtgtgtacactttgtttctaggtttttattctttatataaatgttaccattcagtacaaatacttctacaacttgcctcatttccaaacattgttttgagatttatccatcttgatatactatagctcttgttcattcattttcattgccatttgtagtatttcattgtgtgaatataccatagtttatttatcctgtcttccatcactgggcatttgggttataatagcgactaatttgaagtaaataatgtacaataaaaatcttgtacatactaatatgtgtgagaagttctctatagctgttgtctttaaattctttcgctcaggtattctgtaagagaattttggaaagctgcctcctttcatacatttttacattaacttataaaatattttaacataagtttatgtagttggaaaggatgtaatttgcatgatattgtaatacagatatttaaagataaaactaaagatcacccttctcaatgcaaccagtgaaaatagtgtaatgattcgactctcactagcatccatttaaataatacactgctaagtttttccttaataattaagttccctttgttctttgaaattgaaattctattctttcctgtcctcagaattttctcttagtgcaacatatttttaagcttgacagtcttttttattgattacctcctcctatttctctccttcatattgattcataggagttctatgtgatttctggaaatcattattttgtcactttgtgagtccatctatcttttcctagtctgtggcttatctttttactttgtctttagaattttttgttgttgttgttgtaagtttttaatcttttttttttttttttttttttttgagacagagtctcgttctgtcgcccaggctggagtgcagtggcatgatctcaactcactgcaacctccacctcccgggttcaagtgattctcctgtctcagcctcccaagtagctgggactacaggtgcgcaccaccatgcctggctaatttttgtatttttagtagagatggggttttgtcatgttgaccaggttggtctcgaactcctgacctcagatgatccgccctcctcagcctcccaaagtgctgggattacaagtgtgtgccaccaaccttggccaaaattttaaccttaatgtgattaatttatcagtcttttctttatggtgtggaggtattatatgtcttgtttaaaaattgctttactatctcaaaatcataatctcctatgttttcttctaaaagttttaacattttgtttttcacattttaatttgttaatttatttagaatttattttcatgtacggataccttatgaatctaattttatcttttttcaagggaatactcagttgtcacagggctgtttttaagtagttcattctttgccagctgatagtatttgtcaattcatacatatagattatgaatattatattatgatatctatatcattccttgggtgtatttgcttctttagttttaaacaagaaaggagtacgttttgcttagctgacattatctcgtattcctcataggtaactagcacagcatttatatcccatatcatttttttagttaatattcactagcttgaattgaatttgaatgtgtagtttggaatatagggtcaaaatttatatggcctggcatgttagtaaacactatgaatgaatgaatgagtgagttaatgtgatagaattattgaaacatacttgttataacttagattattattgtgttatcctgtgcttttatatacagaaaatatatctctatctcattaatgaacttagctttctagaaagtcattttcttttagcagtacaatatttcttaaaacatggtctagcagaatcacgtgcaaagtgtgttaaaatgcagatttcaaggtctcacctcagaccaactcactaaatcagtctatgtgggagtcagatgcaagctccccaggggactgttatgctcaaaaaaatttaagcatcactagtttaatgggatgtcattcagagcctctattcagatgttctaccaaaccgagcagtgacaaagaacatttaggccagcacacctcttttagcaaagccgtcaacacttgcaggtcataacacattagagtggagagaacattggcctaggaccaggatacttgagccttatattacagcccccttctaaggtcactgataatttcatgatgtgacctcctgcaaatttcttagttctctgtatgttaatttcccatctgtggctcttccagcttgttagagagttagagttaaattcgccatgttcattgcatgggagagagagagagagagagagagaatgaatgaaactaggacaaggaaccctgccagctggtatctttttctctctccataaatctaaataacattcaggtagcagttgcaacgtatggatattttgtcatcggctcagagcaaagtgaccctttcagaaatttggcttgggcaactgccattgctgctgtttgtagattgtcttgggcactcagacagttgtttacgcagactgcctggaggttagggtatctgtcatcctatactaaagacaactaaggaattttatttaaaccaaccacctctgtagtagagtcttcaagccttctaggtccttttttttttttaattaaaaaaaaattgaactgacagttccagtttgtttgagaagtgctctgcccagtatcctaaaacccagcctcaggaaatggttcatcacaagtctctgaaatactccagctttccctctttgtagtaattcaatttgaatgaatatacacttggagtatatgaaccgtacaactggttttaagtagggacaaagctgggatcgtccccacctccatcctgtatggcacaatcatttcttatttcattctgttcagcactggcagcaattaaagctcccaaaatatggagtgttttcatcaagtaaagcattaaaaatactggcccgtcagagtgggaagtggacctgtgctttactgcaactattcttcagctgcaatagggcaggaagtcgtgaatagcattcatttcatgcagtggaaaaataaggccaatttcagctttaatctttattatgaggagtctagtccctgttggaatgtaatgagtggatgcacctcatttagcttaaagtaacagatctatatagagttgttaatttgtagataaatatgggttttctactgttgatgtttcttgatccacacaaagtggttatattaatactgaaacattattaatcaatagtttgctctttaaaaatacatcagttagactacccaattacctttaagtatatatcaaagggcacaaagcaatctgacgtacacgcaaagtccattagaagctaccagacatattaattcaaatttttagttacaatgaaccttacagtgtggggacacatttctacttttggtaataaacaattactggctaaccgaaacgctgaaatttgcaaataacattttggagcacggaaaggtcttggggatttttgtgaaaatgaaatccacagatgactttattttacttgaatccaacttataaaagggcttcaactcaggactgtgaactgaaagatgcacagggcttttctcctatttgttgaaggggaaatgagaattctcatattttggaattaaacatgaccagagtggaagtggctttcaaggactgcaggcaaaacctcctttgagattaaaacacaacacaccaaaataccgagatgtgtataacaaacacaaccacttttccctcctgctgcatggcggggcattgttgatcaatgtacttgtgacaaatgcccacaatgaataatcctgcactgcttggtccacgtccattcagcaaccattcgtactaatggaaagctctgaatttgtgccaagaggtaagtaatcttttgtttggtcatctagcaacagcaataagctttcctttcaaacttcaattctcactgctaacagcccagctacacatctcttgtctaagaagatctgcctaaccaacttatttaccagcctggcacctagcattcacagatgttcttagagcttaaaaaaaaagaggtcgggtatggtggcttatgcctgtaatcccagcaatttgggaggctgagatgggtggatcccctgaggtcaggagtttgagaccagcctggacaacttggcaaaaccccgtctgtactaaaaatacaaaaactagccaggcatggtggcaggtgcccgtaatcccagctactcaggaggctgaggcaggagactcacttgaacccgggaggtggaggttgcagtgagccgagattgcaccactgcactccagcctgggtgacagagcaagactctgctccccgcccaccaccccctcaaaaaaaagaagaggacataggtccaaaatctgtgaatgctgtttccccatctctcccccaaccccctcggtttccctgcctctagttactcattgccaggaggcagagcatatactctcaaggtacaggaatgtgattaatagtactaggctcactaaacaaagctcgcaactaagacctggatgccctgaggagcttgctataatggtactggactttgcagcctcttacatttctaattgagttactttgtcagaaagtggcagcctcatcacatctaaaggaggtggccaagaagaaacatacccgagacccacatttaaacatcacgtacctgcattgttcattttgggatatactctccctctccaccttggtgtctgtccctgggccattatccagcacaagccatttactgaatcgtgtgaggtgtaactgtcattcaacacaagtgaaatctttacgtgaacattagtcactgttttagacatgttagcttcaagtggaagcagtcagttatagactagaggttttatggctacattattaccatcatactattaggttttcagcagtagcattctgtttgatcgatctgtgccaggacattgatgcatagctttgttcttcaaatgtcaaatatgtgggacttctgaactttatgcatttactgacacactaatctcctgtagatatcttttccccctctgcagtgttcagcttcagcaggtgattgtgattcctttccttagaagaccatgtagggcttgtaatcacatttataatttcctttctattctctctcaaatgcggaaacactcctgagttattgacagtttaaagaagtctttagcacacaaagaggaccacttgctggtgtcaagaaatagatttagacatttgttttttttttctttctgacatgcagacctcataccagaaatgaattaccaatttcagagtatatgttagatttccagaattttggctttctgtgaaattatgctatttcacctgtctttcctaatgccacatttaattttcaatttttttacaaatatatttctaagccaaatctttgaaccgcatacacttcaaccactaccatttcaatccccaaacatcactaaatatggtcccacttatactatcaaatagaacttctcatgtgcagtacttgaaggcttgcagaagattctaagggatggatttcctttctgttaaactagtagctcgtaaatctgccactggagatcatctgtttcacataatagatcaaacagaaactctgagaaagccttgccctccaccaaaaagccactggacttccattttgtttttattcaagaacttcccggaaggctcagtatagtccttgtaaatgccggtttccttcctgagtcaagccagtcccctcttccaccttcacacttctaccttaggaactattctaccatatttcctaccttaggactctctaggttctcttgggtcagttcattagctaatgccacgggaagaagattgcccaatctttcctggcactggaggcagctctagacacaccaggagaaattctcaggacccatttatcattcattttttgaaggccaaagggtaaaaggctaattagtatctgtgttggcaatatcatggtgagaatgctaaatcacagaaatctggcttcctataagtctttgtgtgtcttaaaatgggacctcctgcaatagagagcctcatccatttagtgcaagggcagggacccaggctgtgctccgatggagcaggaatccactgctgctgtcagccctctatcgcttccccactgaagggcagcatggttggccattctgaggccagtagtcctcattcctctcatccctgaatgccctagccaaaggggcacccttgccctctggcatgtcccggggtgctgcaggaagcattagcagctggactgagcccaggcacttgtgctgaatgtgattctgatctctccaggcacaaagcggagggaatcatcttgaccccaacactcacattcagcttcagcctcacacatgcttaaatggaaccattcaagcaagcgtttctcacaaaaactagctagtgtacaagtccaaatctctattagaaaaggcacacttgaagcctggagtccttggtagaatgcatgcattttacctaaacctactttttattgagcaaatagctaggtggaaatgtcagttctggatgctaggcttgttctcatttagccctgggatcttatttgatgtagtgctcatgtaatcagggacacaacaaccccaaaaccaacatgcttgtgtgaaaagctcaggaatgccacgttctattaggttggtgcaaaagtaatggcaaaaaccacaagtacttttgcaccatcctatagaagtaacctgagagtgctggattactcacctgcttctacctgcctcagcaaactctcagccacagtcgatggacaggagccaggtggaagagcacctcctgtggagaggtggcttggtgcccaacaccacgagaatactgctgaatttactccgcaattcctgtgggagacagagtggcagattaagctgcagagatgcaatggaggtcctgactaaggaattttaatgtaaaaattctgaggcttaaacttcattcttcagctaactggtgtcgtccttccaatgggaatctaacaagagttataccagggcttgaagagcaagcatgtgaatgtattggaaccaatttaaagctcaaaacaaaatgaacaggaagactcaccaacactccattaaaataaaacatgaaggctcactgaggcatgcagctgagccgtcagttcttttgttcttcctttgtctcaagctcatgagagaccatggtgggttggtggggcagttgtgaaggtgtgtgttgggtgggtcgggggggggttcctaccatcttgctttgttttaatctaccttggaagtatgtgttctagggccccctggtaaatctagtctagccttaattatgaagtcacacgtgaaacatgggcaaagaaaaccttcctgtcaacaagatcttcatggaatgaggacggaatatactgtccactagcaggcagctcttaaggaccacattcctgaaaatcaaatagaaagccaggatttagtaggaaaataaggaagagtgcaggtgggcataaaaaaaaggtttaacctacagaaagtcagcgaattccaagtctgatcattggaagtgcctggaagttgtgtaaaaatacacattttcagatggtggccaggcttggtcactgaaggaaccaaattttggttttggaacacttaaaacctgtttccatgaacgagaaataatgtactagtaggtgaccaaaaagcccttaaccaagcaaagttttattaacccaatgggacaggaagcacctccatgaatgaagcaaaacaccattaaaaaatacatacaggccgggcgcggtgactcaggcctgtaatcccagcactttgggaggctgaggcggatagatcacgagatcacgagtttgagaccagcctgaccaacgtggagaaaccccatctctactaaaaatacaaaaaattagccaggtgtagtgttgggcatccgtaatcccagctactggggaggctgaggcaggagaattgcttgaaccctggaagtggaggttgcagtgagccaagatcgtaccattgcactctagcctgggcaacagagcgagactccatctcaaaaataataataaatacacagagcccagaattcacatatctgactattaagatggacatttcttcttccttggtcctcttgagtgcagctccatttactgtagactttctgcccagctcctggctctcttctcacaaactggccaagcttttggctactgtcttttaagaaccctgtaaatgtgaagcgctgcaattattattcatgcagcttttgtttatctttccagaagaaacaattgagctgtagcagatgagtgatggttgcagggctgtggtgacggtaaaagccactgcaggtggagtggcttaatggggtattaattgggaagcaggtgaaggcaaataggtagcacagcaggtatgtaaataggctcgtgggaggaaaggcattgaattttatgctctttaactaaaaataaagacctgatatttagcttatctttgctgaaatccgcactgtgagggccctgacaaccgccgacatcatcaatgattcattattatctcagcatcatctaggctacttaataggatcttcagcctcttcatttttcattgtttcagctgattctttggctttagaatgtatgcttttccttctctctatgcataccgaggccagaacaatgtttgtagattgtgtagtagaagtgacattcggacctgtagcctgccttctggtggcatctttttgctctagctgttgggaggaacagagcaaatgtaccgtgtgactatggataatgagcctacgaagaacacatacattcaaatgaatattctccttcaaagtagtcaccttgagaagcgaaacacttattcctggaccatctttggagcaatggctttttgggaaagccaatgattattttcagagctgacgtctcagtcacccacaggaaaaaatccttacatatattcattccttattttctactcctgagcattgtccaacatcatggcctcctttattcatcacacttagtgctaaaggatatttggcttttaaagtcccatcctcaatgcaggggactggatgttgctcagggattccaaagaacacatgcctcaggcttccaggaaagagttccgtgaaatgtcccaagcactggcagcctctttgggacaagtgttgactagctactcagcacagcacacacagagataatctgaaagctgggtatgctagttgacaagtacatacacattattttaaggatacctttttatttaatagcaacttagaaaattgttaaaaacaaatcactccatatttctcttccaattagtcttctccatggcaatacactggtgcaaagtggagggggaagaggggggttttggattctttgttactcggctggctcacatttgttgttttctctggggagaagcagcgtcggttttaaagacatgtttagccttttactgttgaaatagctaaatatcagtggagctcgcacaggctaaatattagtggagctacagtttgtaccccataaaatgaattaggtttatattatcatgcagatcttttcctgtagttgaagtgctcattaattttactgctaatgagatgttagcaattaaatacctttaattaatgaaaatcagacaaaagcaagggctgctctctgtgccttcataaaaacgggaaatgtttgtagatctcattgtgaattttgtctgtagaaggaccacaaatctgagatattttttctggtccagagaaagtcattaaaagatttcacttttagaaaattaaacaaataggcattttgggatgttataaagattatctgagattggggggaaaaaaagtatccataactgagagccagtactacatgtaatagcaaatttcatggttgaagatgcaacaggattgagtacaattaatagttctgtagccgttgtagagttctgggtaggccctgaacacataattagattattaaaaatggcctgtcttagactgactattactaaattgaaatccaattatggttttatgattttgctgaaaaatatttagctgttttgcttgagtcctcctagaagatcatttcctctttgcatcaccatttgcacatgtcacaatacattttccaaacaaatctgacctcaattatcttggaatcaatcttacattagataaaatatattttaatgagtgtttttatgtctaatattataattgtgcctctctatacttgaggaattaaaagatggcgatagaagtctttgcaaatatctttttaatgggagacatgcatattttagaaataactaaattgtgccatcttaatacacagaaaggcattatgctcaaatatgtgcctgagtgtgtggtaagacaaacttgattcggttttcagtaattggcaatggaactgtaataaagcagttgtttgcgaagagacaggctgagaaatttcatgcactcctgcagtgtggatttaaatgctaagttaaatatttatgaacccgagatttttatagttgatcattgtatgatttatacaccgtaattataattaggttgaaagagattttaaaaagccagtttcctggtagccaaggccattaaataacgctaagctgccaaaacaaaaattaggtgggaacccagccaccaagttccaaatgcctgtccctccatctgatgtacaatgaggcactacaccttaccaggcgcctcacctgaagcatcaactcctgtatcacctgcaaccatttttcatgcctttgtttcaaagctagttgaacacaaacaagtagaaaacttcagagatccaatgtataacaaaaggaaaaggtggaggaggttggaaaggttaattaaaaatgtaatgatcccattttctgggacagcactattaatcattgcgcagcagcaagcatgtgacttgcacaccacttacaggagatatccaattttttaaggtttgcacagcagagggtgcaggcaagcgacagaatgtgcgttaaggaaatggaagcgctaatggataaggctagcccatgacttgtggttaacaaggggaactgtctttaccagaccaaagaattatttccaaacttacaggtattcaaaataattcagtcactgtgagccccagagaaaacttgggtatggcttgcagcttaatgtagttgtgtaaggtatgaaaaaacagaactaggaggaatttcatcatcatgtaatacaatatgtctgaaacagtgtacgaatgacaaaatgggttccaaacagccaacatgtgctttttaaatgtaatttttagcaccctagctggaaaaagccaagctcttgaaggatcagttacaagggtcacaacctgtatgatcaaatttgccatacgatccgtgtggatatcagaagcccagactgtcactgtgagcttgcagaaaagtttgcctacacctgtgaagatttggcatcttttacccattttttaattttctgggaaaacacattagagggagcctattagaagaagaacagtagttatattaacatagtaattaatcaagtcagaaagaaaaagaggaaacaagttgtgaattcaattctgcagccttaaaaagaaaggcagaaagatacccagaaattggcaagcatgtgcaaacaaacgttcttttattgtcttgtgaatttttgcttcgtaaatcatatctcttgcaggccatgcagattttaatatatttactgttttattctacctcataatccatagaaatagatttctagttgcttgcatctgtgtttcatcctgaatcgtttcaactggttagctggccctggtgtttgccaataacggtggcattttctaagtgtaaataatcagggctgctggccacagtgatagcctcttacttgggacagtgtgaggattgtatttgagataaaggcagttccttgctccagaggaatttagaatatgaaagcttctcccatgacataattcatccctgacacttccacatctcgctgtgttggagggaccttttacatttgctctgcctgcaggtcagggctgaaatcattggtccatgtactcctttggagccgcagaccgcggagaggccagcgcctccaagtgcatagaccctctggctggggttttacattctgtccctcatcaccacattttattctaaatatttgacgttatagtcagaaaaggcagattacattagaaccatcaaatcaaagagccttaaggcttgaagggaccttagatatatcatctcacaaatagggaaactgatgcccatggggggaaagctgacttgtatgaaaacgctcagatgattggaccacatttaaaacccagatgctcctcactcctaatccatggctccttcagcagcacctgaccctttttgtcctaggttttgggatctcaccctcggttgccatgaatgttatacctcccatggccaagaaaacaagaaacaagtcaccaccagatgtgatcacagccagagaggcttagaatgatggtaaagaaagcaatacgtaacctgcaaagtgacaacatggctgtgtggaatttgaagtgaaaatctggttaaatggcattctcggtaatacagagccgaggctggagaggagcacattagctgagcacaacccactcgcatatgcactcccccaagaaaaaaggatttctagtaaacagcgttcattctgagaatacttcccattcagacagcgtcccagacattctaccaagttaaagaatgaataacagcagatggagggagagattagagggggaggggaggggggaaagcaacattttaatgctgagctctaaaatgagctgtggagaggatggcagttagagttatagtaaagctgttcagaagccttcccacgcaggcgagaaggcgcttgtgcccagaccgtaaaacacaggcgggctcctgatcctccgtgcggtgtgtgagctgatggagggctggctttgactccaagggtgtaaattgaatcattctcccctctcctccctgtgccctcaagtcattgaggtagtattttcgtgcactgggggatccattcaatagatatagaggatcaatcttcttaccgggtgaaaactcaaccctaatttatatatcctgtgatttcagcagtgtttatttttaacttcattgcagtaggatccgcagtatcagggccccggagagagctggaggtggatttgtgagggactaagttagcgggcgaaaggaggggaggggccaagagtgatttcccatgtgccgtgcgcaattgcccatgtgaaactttttgaaaagagtaataataaggtaggcatgaatttattttttccaatattttattatgaacattttcgaacatacagaacagtggaaaaaaaatatggttaatgcatatatactcagcacctggattccatattcacatctgaatgtgctgtatgagcgcccatatgtccatcctctaagtttttaaaattcatttatgaatatactgcccctaaacgcttcagcacacatatgactaaccagtgttcaatatttgtttaggctatttctttttgtgttttgttgttgtttgtttgtttgttctttgagacacactttcgctcttgtcacccaggctggagtgcagtggtgtggatcatggctcactgcagccttgaccttctgggctcaagtaatcctcccacctcagcctcccgagtagctaggactacaggcacatgccaccatgcctgggtgatttttaaatatttttgtagcgacagtgcctccttatattgctcaagctggtctcgatcttctggtctcaagcaatcctcccacgtcagcctcccaaagtgctgggattacaagcatgagccactgtgcctggccttttttttttttttttttttccttttgagataatgtttacataggcacaaaccttaagcatactatctctgagttttggcccaaactgttcaacacaagccattatcaaggtagagaacattaccatcacccccagaaagttatctcttattccttcctagccaatcctcacccccattccctggaagcagccagtcttttaatattttaaaaatcataaattagttttgcctattcccgaactatatatataatcatactgtgcgtacttctgtgtgtagtcttttatttatttttttgagattcatccatgctattttgtgtatcaacagttcatctcttcttatttctgagtagcagtccacgtggataactgtggatagatcacagtttgttgagccattttcctattgatggatacatgggctgtctccagttttgattattatcaatatgctggtataatattcttgttcaagtcttttgtggacatatgttcaagttctcttggataaaaacctaaaagtagaatttctgggccatagggtaattgtatgtttagttttataaaaagctaccgaatgtttttccacagtggttgaaccattttccattcccaccaacaatgtatgagaattctaggaacatcacattttgttaaataacatttgatgtcaaattttaaccattgtggtgagtgtagagtgtatctcattgtggtttcattttgcatttctctgataactaatgatgttgaacacatttcagatgctacttggccattcatttatcttattctgtgaagtgtctgttcaaagatttggcccatgtttaattgggttgttttcttatattgagatttgggcatttttaatatattttagataccagtcctttgtcagacgtatgttttgtgaatattttctccagtctgtggtttgtctattcattttcttagcagtgtcttttgtgaccagaagtttttaattttgatgaactctaccttaccaactttttatcttttatggttattgctttctgtggtcttgtctcagaaatatttgtctagctccaagattatcttatgtttcttctaaaagctttatgattttagcttttatgtttaagtctgtgatccatattacattagtttttgtgtatggtatgaagtagggattgaggttttttgtttgtttgtatttgggtttttcttttttaaaaattattatccaattattctagtaccatatgttgaaaagactctcttcccccattggatttcttcagtgttgctttcaaaaaaatcaagtgactgtagatgtgtgggatatttatgagttctctcttcttttccattgttcaatttgtctatgcctatactgtaccacactatcttgataacttaagctttatagtaaaccttgagaaaggttagtgtgaatccttcaactttgttttccttgttccagttgctttagttattctgtgtcctttgcgtttccatataagctttagaatctgcttgacaatttcaaaacattttatgatttggagataattgtctataagcttatatatgagtttaaaaaattggcctagtatataccttctttgttgtaataatattagttgtctttttaaagttgttaaaactatataagctattaagttttaataatattgagccttaataatcataaagtattgagtattttgatccatgaacatggtatatatttccatttatcaggtcttcaatttttattagcagtgtttttatttttcagtgtagaggtcttgcatgtcttttgttatattccttttaagtgctttttttttttattcattgatcgtgctgtaaataaaattatttttcaaaatttcattttctaatttttttgcagctaacatatgaaagtgatggctatgttaattagcttgatttcgtcattccataacattaaacatatatcaaggcatcacattttacttcataatatatataattattatttgctaattacaaataaaactcttaaaaatgaagcttgtagactcaaaaaaatcctaaatactctgacttgatcactacacattttatgcattaatgaaaaatcacatatgccttataaatgtgtacaaacactatgtatcaataaaaatagtatgtatttttcaaagtacaattactttttgtatattaactttgtaccctgtgactttgctaaactcacttattatttctagtagttgttttgtagattctttagagatgtataggacatccaatacaacattgactataagcagtaaaaggggaatcctttgttcttgatcttagtatttgaccatgaaatatgactttagttataggtttttcatagctgctctgtatcagattgaggagattcttttctattcttaatttgctgaacttttttctatcatggatgagtattgaaatttattgaatgctttttctttatctaatgaaatatatggttttcctactgtattctgttagtgcagtgaattacatatatttttaaatattaaactaaccttgcattcttgagataaacccaagttggtcacgatgcattagccttttaagatattgctaaatacagtttactaaagtttggggaatattgttgcatctgtattcgtaagcaatatcagtctattattttcttcttttgtctttgttcagttctggtatttgggtaatgctgacctcaaatgtcaagttcggaaaggttataaaaatattttgtgtgaatgagaatctgaaataaaaaggaagtcagatgttcacctgtgagctatgaattaatagttttttcccctttgaatattccaggttgcggattctagaatttgtcacaggctctgaaataatgtaaggagatggtgctctggcaagagttatatatagatgaaaatagaatcagtagaaagtgaggctaagtcacacctactgctatatgaagtaaactttgagcaattggtttagacataaaatgattcaccctgttccaactttgtacaaagcctttttaaaaaaaatattgcttttctaataacattaagaggaaaaccttaacagcatatgtagttttaacaactttaaaaaggtattattataacaaagaaggtataacctaggccaattttttttttttttttttttttttttgagacagagtctcactcagtcccccaggctggagtgcagtggcgcagtcttggctcactgcaagctctgcctcccaggttcacgccattctcctgcctcagcctcccgagtagctgggactacaggcgcccgccaccaagcctggctaatgtttttgtatttttagtagagacggggtttcactgtgttagtcagggtggtctcgatctcctgaccttgtgatcggtccacctcggcctctcagagtgctgggattacaggcatgagccgccgcacctggcacactaggccaatttttttttaagcctgtgtataagcttgtggactccttacagagaaaaataaatttcctagatgttacgtgttgactttcgttatttttattatgatgttatttgaaacttataaacataaaactgtaagctcttattcttggcttttacacaactatgaaaacaacacacataaatacaaacagaactttgaaaacaatgaaatgcaggctaataacattaattgagtgtaagagataatattattttgctgaaactaaattggtgcttacagtctgaatgtagtgctcggcttctccatgggtccttttgagtttggcaggcctgtattactgagtgccatgtattgactcgattcttcaggcatttttctccatttgaactgtttgttcttatctcactgaccacttccttgaagtattaatctagctctgtgtctctgttctttcccttttagccagagattataaagtgccattcaacatcaatacaaatgttaagtgtaggtagtgaaattgtgtaccagtacccagccttaaaagtctgatccagaatatggtcatattaatttgttttagattatcatcaaaaatgcataacttagaaatctagagaactgttgactttcaagaatataaatcactgccctgggctcaatagcaaaatgttagaagtctcaaaagaggagaaggctagaagtgtcaccaaggcccagaggccctggtggccctttcagggcacatggcgactatttcactcctgagtcctgagaagcctgagtgtggaaatagaggagctagagaggagcaggcatagaaagagcgagatggagaaacagtaccaggtgtgcttgttaaagccgggatggatgtgcagctgccaacttcctgtactccacacccaagaagggctcctgtcttgcttattgccttctacagcaaatttcttggactctgatgttacaggaagacacatgaacctagagcacaataaaatatgactcatggcgccagggaataatggtgtgatttcagatatttacatatgggttttctgaaagcaagacgcatcttcagtagaacagggagaattgttcttttcctaaaatgttggacttgctttgtgtgccctttgtctatttatgtacaatatttttaatcgtagcaagaacattttgcatgcaatctaccctcttaacaaagttttaagtgtacaatagaatattgataacaatcggcacagtgttatagagcagatctctagaacttattcatcttgcatgactcaaactttattccctttgaagagcaactccccatttttttttttttcattttcttctccagcccctggcaaccatcattccactctctgcttcttttgagtttgactattttagattcctcctatacgtggaatcaggcagtatttgtcctcctgtgactggtttatttcacgtagcataatgtcctcgaggtttatccatgttgttacgcattgtaggatttccttctttttctaaggctgaataatataccgtgtgccctttagacgtgcagcaaatgcactgccctatctttcagtcctacctaaccgaactgtgccttctctcttgtcacttctttagccttttgtcatttcctaaatgccttcctggtccctatcaactgggggcacataagcagaatgaaaggaggtcatagaatccatgaaggggctaaggcctgaggaggaacttgccggggtgtctcatcccacagctgtgcagtgcttgtccaacacctccctgcccgctccagagaatcactactacacctcatcatcactactccatggaccaccttatatgttgtttctggaaggttttttccatcacttccctctccctgcagaaacattcctctattggggacagggctgaattcctgttgtccattcatcctttaaccttgctgttgggcttggccttggcctgcctgcccaggcaccgagtgggccctgcctccaccatgctctcgctgcagacagcagagggcaggcggtgtggacagcacagagcaggcagtgtggacagcactggcttccctggtggtatgagtgcacagggcttgggcagaaggcagcatatgctctgtgagcttcctggagcccattgaaattctattcaaaatacaagctgaatttttctaatctagaacctcagtactcatagagcccacgtgttgtctgtggtgagttaagtggtaattgagaggtttgcagatttttatgtgatttatcctggttttcttccaacgccctgcgagctaaaatttaaatacagcttcgttgtggtggcttcttcctgtttagagaatctggcataatattttgtcttctgggctcaaataaccatgtaattactgtgtaatcatatagtaattagcatgtactatatgcatttattacataattacattcttggaggattgtatggcaattatacttgcattcagcatatcatgaacaagtatataatttgttgtttttttcttttatcctaatttcagtttactaaccaggggctggaagcttattctcctgttgcctcatttgcatgtagtggggcaggtgcccgagttttggcctcacctagcgcctcctaattctacatctgtgggaatattaggggcttttgtgctgccgtagactcctggtatttgtactcctagcactttctcttgtcatgaagtcattaagttattagcttcaaaactcattaagttctagagccgctggcaatgccagataaatggcaggatctcaattaaaacagagtaggtgagaacacagagccgagcactgtgaccatgcctgtctttctctgcatttgcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcaggtaagtgggcactggcagctggtgattaatgaggtgacagggaaagtcttggcggctgcttcggctgccaagctcccttttctgtgcttctaccaaggtagaggagggaggggagcccagtccatttgaatggattggcaaaaatctgacctctgtgtctgccacggggttcttcagaagctattcaggcctccctgctggggaaagttcccatctttaacctgagaatgctttgagggatgctggaatgaggtaaaataccactgcctttcctggatacctctcaggtgagagggtcacctggggtgaggtgaccttaaggcacacacctgctgctcaagtcctgagggctgccagtgattaagtcgagaggagctggctggagctttggaggcttttgaccttcaggggcagaaacttggaagagaccagtgagagggactgagcagtgtccagccttggggagaactttgaatgcctgggtctgttctggactgttctgtcgctgtgaagaggtcaccttcccacttagctcatctcccagatctcagcctccaccagaaacctgctgagcctggatgatgttgttgaaagcattcacttctttttgctttttggccatttctgaatttactttgatatctgaaggagtccatgaatacattttctgtgtttaaaaaagaaaaaactggccgggtgtggtggctcacgcctgaaatctcagcattttgggaggctgaggcgggtggatcacctgaggtcaggagtttgagaccagcctggccaacatggcaaaaccccatctctagtaaaaatacaaaaaattagccgggcatggtggcaggcgcctgtaatcccagctacttaggaggctgagacaggagaatcgcttgaacctgggaggtggaggttgcagtgaggcgagatggcaccactgcactccagcctgggcgacaagagtgaaaatctgtcttaaaaaaaaaaagaagaagaagaagaagaaaagaaaaaccacaggcctggcgcggtggctcacacctgtaatcccaacgctttgggaggctgaggcaggcagatcgcttgaggtcgggagttcgagacctgcctggccaacatggtgaaaccctgcctctactaaaaatacaaacaatagccaggcgtggtagtgcatgcctttggtcccagctactcaggaggctgaggcaggagaattgcttgaacctgggaagtgaaggttgcagtgagcagagatcatgccactgacctacagcctgggtgagtgagaccctgtctcaaaacaaacaaaccaacaaacataaaccacaaacagcaatatagacgtaggtagagtgaaaagataaagttacccttcactctgctcccattcacccccaagcttcaggcagtcactgttaaccatttcatgtgtgtccttcccagaacttagtgttgaattcaattgctgatcgaagcaggtagatttggggtatcatattgaaaaacagctgtactttgtccccaggtagaagccctcaatatatgctaagccagtggacaagcagatgggtttatgaccatgtacttgtttcctattggttccccgtttctaaaaagccaagagcagaaaaaataatgtctgtgatgttgaagattctgagtttctgttcaacttaagttttattctggtagaatgggaacccactctttccttaaaccagctgtaataatgaccaaagaaaactgtaagtccttgtcatctgtataaccctctcatgctgaagactttttgggagtaatgtttctcctcctttctaaaaaaagttggaagcaagtgacctgctgtatgaggaaggactcggatgaccaagcgtcttatgaactgagtttgcatcttgggaagaaacaggtgttccagcaatgcaatacaaggacccttcctcacttccaagcccctgtttcattgaggccctcttagctgtgggctaggagcagggatgggtgtgccagaagggtcctgagaaagaggcagagcctcagcaagccaggaacctggggaagccaatcaattagggtgtcgaagcaccctctgctgaagatgaataaaatgaatgcagccaagaagctgtagggagctttgctcggggtccagcgatgggatggagcagagatcctgaagatctctggatgtgaaactccaattcctggccccctgtagtctctaagcagaagggatccccattctgggagtaggactggatttctagggtcttacttggcttaatgccagacagctcctccctgtctctataataagatgtgatcttgtccactgatgggtccaagccaggagacctgggcttttgttcctgcctcaagatgggaagctgtatggggtagaaatggagctgtggatgagtcttccatctattgaacgatggctgggaggtgggagaggtggtggtgatggagcctttccttcctgttctcccaggtttatcttacacaagatggccagagaaggtctgagacctcccccacacatattgagaaagcccatattgagcagataatttgcattctctggcttgttcttctaaaaagagagtatcctttgagggttggtgagaattcattagatcaaattgctttcctgctaagctgtagtgagaatagctgggagttgagaacttagagggctctgggggaggcgatgggaggaacctgcagataacaggatggtttaggtgatgtctagggcctcaggctgaggaaggaacaagtttcaggaactgtttgtgacatccctgatagcagggagtggactcagctgacggcacagaaatgtacaacaggaagcagacagcccttgtctatgtattgactttgcccgatcttcctggagtggacagcagccaccatgcagtggggtgaaggatccctgggctggatggtgggactagtggcgtgtctgtgctgctgccacgtttctggctctgggagaagctcagaggctgtttaggaatccagatctagactgtcctggggccctacccagtgaaatttgtctcagtgtgattgatgggttttatacactgtcttgagcctttcctgggaaggtgaatccgtgacttccctggtgttacccattgtcaagtgatttagcccataatttctttccagagcctggatttattactcatgattaccccctccctctcagaggtgctaaatataatttgagctgctaggttggctagcagtgtttgcttccatcagattttattactcttgtctttaattttatgccttttatcccatcccttctcaatccatctctgtgaggccgttgttgttctacccagagtagcagctggtactagctggagctggaggttctttgggtctcacattacagttgctataaccctaacctcaccactgatgtgatgacttgaggtctcatttgaatagccccaaagggaagggatggcaagagggaaacttgcttcctaaaaaccatattcttcgaaagctcacactttcaaatgctccatttccatcttaacatcagcaaccatcaaagagctgttcaagctcattaaaagctccctgaatttaatattttccaactcagggcctacaggtttccttccccagggtccgacagtgcctctgcacagaacctgtctctcttccgcctcatgccttcaaacagatgggaagcaacattagcttttccgtttgactttgttttcctttttccttttccattttagggaagctgacagattcctttccccttgaggtagttggggagagtcagagcctgactgtttgggcctccaagcttgtctacagaaaagcaaatgcagaggtattattagaagggtgtgatggaatttcaaagcctcacagtcttcccccgaagcagtgcctcccctgccaggtttcctctggttgcttttcttagtgcctggaaggatgtcaggactggtttgggccgaatggaagcataaccttttgtgcctgatgcaaatctgtgtaatttaaacttatactttccctcctgtctgagcgctggctcaggtgccacaaatatgttcctctctctttactgttttaattaacagctcaggtacctcagctattcttcattaccaggcggtccagcaccttccccttgggcatgctccctcatgtttccatcgaagaaccacagaggtagactccaaaacgccttctgcttccagtgccaagcaaagagggacccccaagcctgcgaagccgcccgcttgccggtagctttagctgctgccacatggggtcgctgttgagaaaaaactcagggtgtgcttggtggtttagtggccttgcccttctggggcattcagcacgtgcagcagagctgctgcatccttgggtggctgagtgacaacacctagtttatactcacctatgcagccattgtttccaaagcatgacattttgctctggggagctacatcctaaggggttccaatcagggccagccctccaccttgaacaccagtagtccacgctctacgttttctggcagtatgttactaggtagaattgaatgcttctcttttttcttttatttaattattattttttagagacagagtctcattctgttacctaggctggagtgcagtgttgcagttgaggctctctgtagcctctaactcctgggctctagcgatcccctcatctcagcctcccatgtagctgggactacaggtgcatgctaccatgcctggctaatttcttttaattaattaattaattatttttagagacagggtcttgctatgttgcccaggccgctcttgggctcctggcctggagtgatcctcctgcctcagcctcccaagagttggaaattgaatgttacatttgcattcctctttgccaacagtgctgggtcaagggtatctcactccttttagaaagattctgataatgctgaacctcaaaaggaaattggtcagcggctctatgtcctcagtccccaaggttctcttgaccctgctggagatatgatacacttgttcttcctggtgtccaactctctgtccccgtagtctccaagagtggtggctttgatgaaatcaccatatatggttctaccattccccagggatcaaggaccctatcattgtatcttggaggcctgggggatttttagcagaaccaagaaggcctcccttggcacagctccaggagaacagcacatgcaatttccaaaattctgcccttgtcagccccacatttgccacactgggggtgaccccgtgacacttagaggaaatgtaatgttgttagttggtcgatcaggcaactggggaacgtgtcataaaaccatgcagcgaatttctgctcccataatttatttggtctgacagtgttagtgcacctttaaaaggtgagaaatgtgtttcgtttgcctggaatgagacccccttcacacaataaactgtggatcttagagatcaaggacatcctctactgtttgggcttaaattcctgagtcaaaaactggatcccacatcactatatccgggcttgccttgacatgcagcaagcgcaggagaaaatggctcagaggataattaatgcctaaaactagatgggtagattaatttggcacttaattttattttacgctgattcattcacaaatggaaatcagcaattagacaatgcaaacttttgaaccatggaaagaaagtttctagaatatgagaaaatacaagtaaaacattttccagttcatttgagcagttttcatttcaaatgattacatgggtgtctttagcaatgcattcggagtgctgaatggctcgtttttaatatgccccacctgcacgagctgcctgctaccctgtctgctctgggggccgctggactcctatgtgcctacagcagattcatcaagaccctgagagaagggcaagcaggttctctgacatctgctgctgcccaccctggtgttctttgactccatcccatggggaggggcaccttcctgctggctcttccagagtgccccttctgcctgcgccacctcctgatgtgcatgtgtggcccttcagctccactcagcagcagcagagctctatcagctcgggctctcagaggtaacctgagccctggaccaggcaggagccagctatgacctgcccagctatgacctgccttctctctcattcattatctctctgttggcagaggtgggtgtgaagccatttgtctgcccctgctggagcctgtccctgtctagttttactccctgttctccctctctccagctggtcccctccctgcatctgcccaagctcagggtctctgcctcgttttcctcagcacgtctttcttcacctgcccaagtcctaccaatcactttttccactcttggctcagagagagaaaaaagcagggactccttgtctttgcatttgcatattgtgttgatcattgtggacagatggactcatggcaccagaccatcttttatcgtcttcgagtgtgaatgcggatggaaaaggaatggaatggaatccacctaggaggcccaaacagagagcctgtatttctttggggaagcagtgtcacagcagagggtctcaggagccatgttcagatcaggccttggtggacaaggagcagggaagtgaagcagaagaaggggagcttagtttggaggggacacagtggttgaggtgggaagaaggggccttggggactgtcatggcgtcagaggaagaaaactcggtgccatagaaaggcaagatattggggcctcctgtgtcagaggggtgctggattttatccatcaaaggtttaggagagcatcagagagctcccaggtgggagcaacatggaggcagagttggagtggtagagatagtggctgcgatcaagttaggaagctcttgcagttgacccatgagaagcgatgagcgcagagtcccacaagaacaggacaggaatttgggagacccactggacaccatggagggtactgactaaatctttactgaatgaatacatttaaaacatgactaaatctcagagaaggggctgggatataggggtggggttacaatcattcacatagaggttgttgttaaagatgcttggtaagatttgttcctctagagaaagtgggtgagaagagaaatggaccaaaggctgaatctcgggagcaccaggtgtgtggtggaggtgtctgaagaggacttagaagttggagagttggagaacccagcaaagggccttgaaaagccaaaggggaacagagtcttaggaagaaaagggagatggtcattggtgtcaatcactcagagaacagaggagaactcagagggacacaatttagtacataggaagtatatccgtccatctgtttctccgcccatttctctctccttccatttatccattcagttttccattcatccatctgtccatcatccatctattcatacctttgttcctctctccatcaatctatctctacttccatcccccatcccaccatctatccatccattaatccatccactcatccatttatctatccatccacccatccacccatccatccatccatccatccatccatccatccatccatccacacacccacccacccacccacccatccatccatctggcctgcacttactgtgccaggaataacaacctgatatttcacctacagtgcagagaggaaggcaagcacacacacagtcatgacagcatggtgtggcagtctctggcaggaagggacaaagtgctatgggaggtgagaacagccagcttagagtggctgttagcaaggcttcctggagaagctgccatctgagctggactggccaatgactggcatggaagagagtcacaagacaaaggcccaggactgtgggtttgaggaaggcataggaagtaaaaaaagaaaacaaaacaacaacaacgcattcactgggtgctgatgatgatcactgctgaggtacacccacacaaacgtgatctctcatcagaccagccaccctgcaaggggatgatcagtggagtggccagcccaagggtcaccctgcttccacacagaggacgtaggaatcagctcagtcttcctaactctgaaacctggtttctgtcactatttccagatgactgtctttcatgataggaatacaatgttcttacaccgttcagcctttactacctttagttccagacagccagaatgataattctggccagcctctgaatccagacactctttatggctcagcaactaagacagcatcagtgttaaagacagtttttaaagagaggtagaccatcatgtccataagagcctcttagcatcgtttaaaaaataaaacaaaagctactcaggtaatacaagctcattaagttctttatcaaatttccttttgaacactcgttgcttataatagagtgctttctctgtgacagcttactgatttcaaaagagtcgtttctacaaataggaaaaaaatacccttccaggccacgctggctttactattaatattattagctcaattattcagtccaggcatatttattgggcacaatctgctggacagtgagggtcctgcatgtgtgggtggtgcaccccctcccaggcatgcacactcacctgatttggattccttaactccctgctgaaccatcactggcagtcagtgtcctcaaccctcacctacctgaaggcagtggacatcagggatctggctgtgtctcacagagcagatgaattctttgctgtcgcagagcaacaaccagctctaaataatccatggtgtcaccagtttggggtcatccaggtgtttcaccttcctgccttctccctggcttgtggccattatgttaatcatcaggaagccctccattttgtggattgcatcttgagagtacattgctgcacctgtaatcccaactactccagaggctgaggtaggagaatcgcttgaacctgggaggtggaggctgcagtgagtggagatcgcaccattgccctccagcctgggcaacaagcgtgaaactcaatctcaaaaaagaaaaaagagagagagagagtacagtgctggtgaaaggtgtgatggaagcaagacctctggatctttaccagacgtgaagaagaggaggtgggcgggggtactcaaagggggtctatgggtccctggacttcagaccaccttgttcaactgcaggtggctgagggagacctcagctgatctcctctactgctctgtgcagcttgtctctcttcaaagagaacccttctgctctgtccaccagccacctcctgctagcactcgtgaagtgcacaggcatactacaccagctgcaagcccctcaagcccaggcctgaactaacccaactggataaatttcatgatcatttttttttctaattcccagggaagggggtgtttccgtttcctacagctgttttcaaagatgtttcatccacggagcaacaaatggggtgcaaaagaatggggagaaggaagacgtcaatagcctgtgacccagagcagtctcatcttcgcgtggggaaatctgtccccttagttacaggctggctgtatttaaggagaggagcatgtcctgtgtttaattagcattcagtgacttaaggagggctccctggagggcagggcagggctgggctgggctgggaagggaagtgcgacatcagagaacctcctcccatgcatgggctcatctcaccccaggaacctgactctgggaacctgccaggaccctcttccatgctgccaggagggtcctctggcagtcacctcttccctcggcctccccacctcccaggccagtgtgggcctgggtctcacagccaggcttagagtcctgctccacccagggagactccacactcccccacacccatcccaggcattaccccaagtgaggatcctgcagtcacattggcatttacatttctacagggcatttccaactcagtgaatgggaaattgctcgtcatttccaaaggcaattaattatgcaggaaattttgcatccaagaaaaacaagaatttaaaagaaccatcaatgtgaaaaagtaccataccatgctggagtcttgggattgttttcccttccccagtagttgtcagtgtaagcgtttgcgagttaggcagacctgggcttgcattatggttttgttagttcttatgacaccagccactggaggcctcagtttcccatccataaatggagataatgactccatcttcacagggatgcagtgaggactaaatgagatatttttgtgcaagtacctcagcatgtgcctgccatctaacccagaaaattctcaataaatatgtccttctttctctttcacttttccaaccagtttttatcagggaggacaaagcttaagattttaaatgtgataccccccagaacagagagagatctttgaagtagaacttgtgagctggtgtggtggtatgtgcctgtagtctcagctgctcaggaggctgagaggtgggaggatcacttgtgtccaggagttcaagtccagcctggactacacagcaagaccctctctctaaaaaaattaaaaataaaaattaaagtaggatttgtgagggggcagattcccattactctacacttctctgcacccacagcactaaacgtcatgtggaaatgccacatggctaagcttgatagtcatcctctttcagcctttgtaccattagggaaaacggaggggcggaggcggaggcagagtctagaggtgtttggagcatgtgtcatctcaagaacatttttgtcaagaatatacaattattggcacacagatacacagtaagatgtgagcagagctggctctgagactgctgggcacagagtggggagattcactattgtctggactgaataggcagtgggagccctctggcagcctcttggccacgtgcttcttctgtgacctggagtaactgtgaataaggggctctcagaggtgcttatgtctgagtcagtgatgtgagggatccagcaaagggcagccactgactcagtgagactgaatccatggccccctccctctggatgtttccatgttgtgaatcaccccatcttccccttaggaagcaaagccacacccgggggcagagttgctcgtcatataggactcagggagcttagaatgcacagagccggggacatggttgtaggaacgagtggatggcggtgacggtggtgcgggtgatgatgaggcgagcaacacgtacttggcatttactttgtgccaggccctgggctgagctctttgcagcaaccttggaagtgggagctgtcgttaccctccctgtcactggatgaggaggtgagatcttgaacaacttccacatcacccaagtggtgccgctggaaccaaaggcaatgaattatgcagcaggtgcagcccctctctgctgtcccactccatagtcaaggaacccagagggtctgtggggctgcggagctcatgttgccgaatgccgcactgcccatttctgtacacaatgtgcctgtcttgtaaaccacccacagaacttccagagacacccagggagagtggaattggataccggtggtgactttacttcttatttatgttaaaacaaaaattttaaagtaagggacctttggatcttgtcaagatagggcttaagtgctctttggcaaacatagttcatttatcattaaaaccgcgggtttcaaactttttggtttctggactcctttatgctcttagaaaattactgaggatctcaatgggcttttgtttatgtgggctaaatctataggtacttaccacactggattgcaggtgaaaagaggtttacatatttattacttcatttaaaaataacatcgagcagctcattacatgttaccataaataacagaacatacttttattaacaatcactatattttccaaaaaaaaaaaaattagggagaagtgtggcattgtttttacatttttacaaatttagcatctggctggaaggtggctgggagagagagagagaaaagtcattaaggtcttagtatgactaagaaaatagttatggtctcactgaccccctacgaggttccctgagactgccaggatccctagacctcgctttgagaactgctgtgctagatggaccagagtaatcttgggctggaagacttgtgtgtgcaccagcgctcctgaggtctcgttgaaccaagacagtctggggtgtgcgcctgccttgcgcccagctcgtttagccacagtgggtcaggatgctgaggctgtgggatgtctgccccagccaagcgctggagcccctccaggtggaaatgggttgagtaattagagaaccttggagcatctaccgtcagctgtgcggtcgctccggggctgcttggcaggctggagcactgagcccagcttggtttcttgctctgagagatgccctcctgacagctcctttgtagatggttcctctcttttctagcatgccaaaggatttcaccatcatattcagctcagtcaggcagaactctgggctgctgtgtaaaaaccctttgtgtccagaagggttcagtggagcttttctcttaccaagtaggggcttggggagagtgccacagggcaacctctggtgcttagaatgctggctggtgccttgatgtgggccatctcaggggcagcccccctctgctctttctgatatgtaatcatttgccacagggagaactaaatgatgacaatgacagtgtccctgggctaacccttagaatcggaaaagccggcaagctggaagtttcaggtcccgggaagcacccagcagtcggaattcctattggagagttagctggcttcatctaacagcttggagagggaatgccacctctccaagaacgttcactccagcaaaggagcttgacactgtcccaggaaacctttcagtggaaataaggcaaaatcgaatggacaaaatcgaatggaaataagacaaaatctttcacactcaaaaattcaagctcaaacatgtttagctacaaatacagtattatggcttgagaacatttgcttttttcctattggaccagctggtgttttgtcattgctggagattggtttgttcactggttcagtaggaccagacttccaggtgctctgtagggccccgagggccagagatgagggaggcgcctgtgcccacagagcgcacatgcagggacagtcaccggtgctgtgccagcccagcctcgtggggaagggtgggctcagggacttctcagaggcgcctttgctctggggccgtggatctccagcttttgcctgtgttgggatttgttttctattcatgaggtctagggtgaggcctgagaatttgcatttctaaagcattcccagtgctgctgctgctggtctgggcttaccattccctgctgccttagagaatgttggccaggtgatctaggctgatggcttcaccctcctctcaactgggtctgcaaagctgaaaatgaggagtaggcaccagatgggagtaggcttaggggaggacacaggagagggagcccctgctgtggctgggtgtgggctggcagcccaggtcggatatggggcacagagggcgcatcgcagcccaggaattcatagctgcgggcagggacaacacatggaaagcttccatgctgcattaaggttgggctttatttggaaggctgtggggaccactggaagggctctattgcctgctgatagttcttcagacacaaaggatactgagacaagctgatggtatctctagtcactgcctgggctggccccactgcagttgggaccttgccctcactgcacatgaagaagtagacagtctgttgtctctaagttgaccttggcctcagattggaatccgtttggctgggttatacctgaaaatgcaaagcaaaacacagggttttaaggtaattaaatcttcttcctaaaatggcctttggagcagtctttggcctgggctattcgaataaggaagctgccatgtttgctccactcttcttgtcactttttgcatgtagaagcacccttggttgtcaggagggaacgtgggatggacagggtctatcctcagtgcctgcggtggagctaggatgcagatgactcaagcaaacacacgtgtgttcaagatccaaaagtgctgtgattctgtgaaccaaggttgctatgaacccttgcctgtacaagtacatggtacatctcacccctcagtccacagatgggtcataggcaagggcaggtggtagatgcaggtggtaggaggttggattccatatcctaaagggactgcaccttctccttctttgttcctgtcccaccatggccaccaccttttacacagcatcttacattgtgggtgcttagtgatcatggtaattgaacggtttgttgccttttgaaccctgggccaggcatgtgctaggtgccaggctacaaagctgaagatgaacagtctctgtcctgggttcctgcatgctgaggtattttatgagtccatcctggaagccttgggctgagaactctctctaggtggctccccagtattcctaggcttagagaaagccggaaggggtgtgttctggtgtataagagatgccaccaaatactgcctgtgcatgggattttattaccaacccatgagggagagtgtcctctcctactggtgggcaggaaccctgatgtcagactaaaccccagctgccctgcaggcgtgtttcttctctctgcatctcagtctccctgcatgtaaaacacagacactaccagcacctcctccacaggcagtggtgaggattaaagcccatagcccagtgcctggcacagagtttaatgctcagtgaaatcccttgtcatcatgggcagcagagggtactgacctcagatgcatccagaacttagctgaagtctcatccccctgccaggtcaggttcccaggctgaggattccaaagtctgcctgattcctctgcacttgacccctcttgggaaggaggcgacacctgctgcatccctgcctctcagggctgtggttggagagaggcagcgggcacagggagcaccttgagtgtggtaacagcaatattcacagctagcacttcactgagcactgaactctgtgccagacactgggatatgggctctaatcctcacccctgcctgtggaggagatactggaagtgtctgtgttttatacagggggagactgagatgcagagagaccagacacccctgcagggcagttgggatttggcctgacattggcactcatgcccaccagctctgggaaggttctgcacatatgtctgctcttccagggcaggtccccatgatggtcgtcccggccaggccagcccctactgggtcactctgtctccagcctcaggagtggtccctgcggtgaaggaaggctgcttggggatgcgggtttctccccgtgggcccggggagccctacttctcagtgtatggggaagacttttgtgtcctcacttcttgacttctgggtgccctctgggggaacacagcccggggaaggggtgcccagagaggcaaggcctaggcccagatgatttcccctcctagctgtgtcgcaggactgcatttgagccctactgaacagtaacaacagatattattttttttatgtttttaagctacaagcgctattaaccaaaaagaatgcccactaattctgtcattcttttattgggcctagtaaagatcacatatccacctaaatcagatttgggcttctgcagcacatacttcacattaaaatggcagccaaagtccaagaactaaaatgaaaagagggaacattaattctttttcagtgctgtgcgggtgcgtatgagctcaagaagctgcggcttctttccaaaacctggctctgactctggcctgctccatgactttgggctggtcgtggacctctctgggacctcgtgtcctcaactgtaaaataaggcaaacctggctagtacggttactgctcaaaaatgacacaggtttgaaagcactgggcacagtgacaggttctatgtgaatgtagttggagcatttagagttgggctgctgctgtttctcctctgcacctgttaatgttgctgaaccttcagcaccaagtgtccgtgatgagtgttgagctgtaggtgattggagccttactctatggcagtcagattcgttcattcattaactcatttattcaacagttatttaaagaatacctgctctgtgcaaggcataattctaggtgctctccttctctgcctggtgtaggcaagaccatcagcaacgtgaagatatagaatagaaagtgacggagatgaggtgtgggcagcaaggctgaagctggcaccctgctcggggcgcagagccagtgaggggacttggtgggagggctctgggagagctttgagatcaccgtgaatgggttaaaataagccttgggatcactcggctgggaggagatgtggaggggtcagtttattagaaaatggcttatgtggaccctggaaatcagcttctttgccctaaagaaataaaaaaaggagaaacattaaatgcagcactaagagctttagttaaaatgtagaaaatggggttggggctgaggtgctgttgacaagaggatgctgagtgtgagaatgggttgctaataggagttacggaatttccccaaaaggggaaattgccatctggtgacaatggagtgatttattcatttgacgtctaatgccacaattccctgtctcctgagcaatagtgatattctcaatgccctatctaagaaggaagatattaggaactagttgtttgctaagctcaaagtctctgttgaccttactacaactttcctgaaagaaaaatgacctagtgtatatttactattgaatataattttccttaggaagtctgcaagcctattaaagattaatagggaatctcattttcatgtgtttctgtttaaagcgaacttgtgcaagtgtaggttgttagccattcagaaatccattcaccaccccctttccccaccccctcccagggctctcagaaactaggctcctttaatgagtggaaggtaaattaatattccaaggcacggaacttggggcttatgcacccagagatatttagctcttgtcgtttggggactggagaaagtagggggtttcacaaattattaaagtcaagagaacccatgccattttaattctgcatattctgggaacctccaaagaagcaaagtttgactgaggaagaccaggtagcattagggataatttctataataatttacctgtgttttttcctaagctcattagagttcagttcctctgactataaacatcaagatgctgtgatacttacctcaacacttccttctgagggtacagacagcaccttcttaaatgaacacaggcttgatgcttcaattgccagaccagtagagggtccacaggtagtggcctgtagaattgcttagacctgtttagggagtatgatttcattggtctataaaaaaaagggagtatgatttcattggcctataaaaacttgaggatgtttgaagactcacaggagtaatttctctttggtcttaatggtgggaataaagctgatattcatcatgactttcctgaacacatgaagaccttaaaaaaggggatcaattgtccttaggacaaagcatttcatatgccaagttatttgatgaattctaagggaattcatccagcatggtcatctctccctaggatttcataaggtctcagggtcagtgtggaccccctgggctggtccagagaagaagagaagacaccagctgtgatgaggtactgttcctctaggaatcaggaatagatgtcaacaggtgctaaggtgccaggtatatttaaccctaccaggaacattttgagggacttattatcattcagcctgagtatattaggtgtgttaggacattcttgcattgctataaagagataacctgaggctgggtaatttataaagaaaaggggtttaattggctcatggttctacaggctgtacaggaagcatggtgctggcatttgctcagcttctgcagaggcctcaggaaccttataatcatggcagtaggcaaagcgattgccggtgtctcacatggcaagagccagagcaagagagagagtggaggaaggaagaggtgccacacacttttaaataactgacctcccaagaacactatcacaaggacagcaccaagccatgagggatctgtccctgtgtcccagacacctcccaccaggccccacctccaacactgggagttccatctcaacatgagatttggaggggatgtccaaactatatcaagtggtgaaagatggaagacaggaacgagataattcctttgagagtccgaaagtattcctcatgcagacatgtcacatgatcggagcagaaccaagagaaagtggagggaggtgccacacacttgtaaaagatcagatctcacaagaacctactcgctacccaagagggtggtgctaaaccattcatgagaagtctgcccccaggatccaatcacctcccaccaggccccacctccaacactggggatcacgtttcagcgtgagatttgggtggggacacacgtccgaactatatcactaggcttcagagaagctaagatacttgcccagaatgtcatggctagtaagcgattgagctgaaatttaagtcctagtacatgttcaagttctgtatgaaaaccccctactgtttactgctttttagtagtcttttagttttctattggtgctgttaacaaattaccacaaacttcaaacaacacacatttattctcttactgatctatagggtcagaagtctgactcgggtctcactgggctgaaatcaaggtgtcagcagggctgagttctttctggaggctgcagaggagaatccatttctttgcctttccccacgcaggctcatggccccttcctccattttcagaaccagcaagggccaggtggagtctcacatgacatcacgatgacaccctcacttgcctccctattccacttttaaagactcctgtgattctattggtcctaccgggaaaatccgggatactctccctacctcaagatccatgaccataattatatctgcaaagtccattttgccatgaactgtaatggtctcaggttttaggaattcaggtccagatgcctttgagagcctacccaaaggtaggcattctgcctgccgcaagcagtttttcttctgagcatctatcttgtttttaatttgggggtatcatgagctagttgtggaattagttatgaatatcttaacccccttcccagtggttgctggaaatctctgaaccaaatatgtagttttcatccagccaggggcatgtgtacattttgtactagctaaaccactgcctctatcttacctttctgtggtccccaattctctcactaatttttatattctgccacatcacagctacatctgaaggcacttcaaaattccttctgaagacagggtgtgcgtaaataattaaatgaagccatggtggatgacctttgctgcccaggattcctgagcagttgacatggagcctcttagcgttccagaataaataccaggcgacttcaggcatttacttccgaaggtggaggtgctgctgaattctccatgaagcaagctcacactgtgttggtctagagttttaaggtgtggttctgctggtgaaagattcattgaacatctagatttccattttttcttgtggccaaaagccacaaaactgatttctaaagtttgcctgcagaaatataaaagacttattggataaggtttactcttaaagagttttaacatatttgtcacctgcagttatcccactgaatatctgagagctttatgatcctttcatcatccacaaaactttccatttcttttcttcttcaatttcttcccttaaaaacaagtactaccaaagctaaagctaggttttctgtgtgaatggacatagcatagtatgggtaatataaaacaattttatttgatttcgtgatgcagcacagggttgttggagatctttctgtgctcccattactacttagagttttcttgtaccatgaccatcagtttgcgcattgggataaataggtggagggcagtggattcctggcaaaagggcagttcagggacatctgatctaaggctgctgaaagccccttgcaagttggaatggattttcttgccaactaccatgacttgcttttcaaatttgccaggtagagagtacctgtcaagccctgtcaactgctctgtcaatgttgactgatggctgtcaatgttcatgcaaggtggcttcgggagggatgccaaaattgatcagatgccaacctagacttccctcggggggctactgcagtttgatgcaatcagaaaggctaaggaagcatcacctctgtgccctgcagcctgcttttgctgaaccctcaacctgcagagatacccaaggcaggacgcagggactgaaataatgggggattccatctgcatcgccggaactccattctcagcccatgaagctttgccagagcccctgtgagtcaggctcagagtgcagtgacagcagcctccatggcccatgtgctgggcaaaccacaaggagaaccctcgcagccaagagctgccaaggagccagaggagcaacagtgatcggggaagccccatgtatcaggatgaggctgagcagggatttgaggggagcaggaaatgatctgtacttggccacaggggcctttctgtcccaggaaacaaaggcattaggaaaggcttgaaggctgcttagaccttatggtattgtttctcaccaacatgtggccgctgtcttgctaaactgccatacgcacatcagttggcgaggctttaataatcccactaccagtgggaacctgtgttaaggggctgatgaatgcaagatgcacagagctttgcgcatctgcacctggggcatgtggacctccccagaccctttgcgtctccacactcagtcctaggtggggagagaatcgcagctcagctcctcagctccccagctccgcagctccgtagcctactcctaggcaaatactaggcctttgctccaggaagccagatgcacagcccagacagcaatagcaacacaaaataacaccccctgcaaaatgtatttaatacaggccctggtttcctgaaggatgctttccagatgtgtgttacagcagactgagggagaataggggctaaggtaattttctaaaaacagaaagaggaaaaatctgttttgtgtcactataccagacaattacctttccagtgttttagccttttcattcctggtctaatattagcagcatgtttttctaattgtttttattctgcaaaaggtattagcagttttaacaaacttactgatatttagtccttttaaaaatatatccctttgctctaagtccctgggaaaaagtagcttttcttaaagtgcctttattttatgagttcatgtaacagagaggctttaagtaacaccacagattcctcacttcagacttctcaaatttgttttggtcaaagttgatgcctttagttacatagatgtagcatgttgaaagtatgtaatataagggccaccaaagatagactaagacacagtgtatgtttctctttattgagcttgttgtgtgtttttccagcaaaggctgaacattagaatgaaccaggaattggggagaacatatgaagggatagaagtaaaaattttgggggcaactggtgtattctgggttctgggtgaggagctttatataattgtcatttaagtctcacagcagacatttaaagtgactgtacatagcaactggtatggcaccacagcactggtgccattttccaggtaaggaaactgagacttggagaagttgaataatttgctaagatgtgagaggctgcgtgaaaagtggagctgggattagacacaagattgtgtcactcccaagcctgtgcatcttcttatctaccatactttctttcctctaactgacccactgagaaagctttcagaaactaaatggtttgaagtgaaagccaagactttgaatctctaatgtccacgttgggtttagagaaacactccagcgacttatacaagtagattgataaggggatcctgtcccaaagttctgggtttctcctgagtggtcgatatggtctggctgtgtccccacccaaatctcatcttgaattgtagcttccataattcccatgtgttgtgggaaggacccagtgggagataattgaatcatgggggcagtttcccccgtactcttctcatggtagtgaataagtctcatgagatctgatggtttcataaggggaaaccccttttgcttggttctcattcttctcttgcctgccaccatgtaagatgtggctttcaccttctgccatgattgtgagacctccgcaccatgtggaactgtgaatgcattaaacctctttttctttatagattatccagtctcaggtatgtctttttcagcagcataaaaacggactaatacagtggtcaagccctgcagtgctgtgcagtccctggtggggtacaacagactcctttataaaggggggcctaattcactgatagactcactaccctcttgtcccatctgcatcctctggcgcctgctgtgctcttgcaatacattcaaagtacccgtcatgtctctaaggcctgtggaacattaggaagaacaatgtagtcaatggtggcaggggaaagcaggtatacacttgatgactgtaatacaatcccagagaaattaaagtcagcccccacacttctacccttcagagccattatgggcggttggcagttcctgttcctgtgaatgccatctgtggccacctgccatgtgactctgagcaaggcttaatctctttggccctcagctgtcttgtatgtgagacaagggatccactagaagaatcttattctcaagactcgaagaaaaccaagtcccttgacactgaaatcataacagtaggatggaatatgggtaagaataataatgctatgaaaacaagtgggttttccacccctctacattgattgctttgagcattccatagactgtatttctgaggtggaagggaaagctaggagcttaaacatgaagcaacgcactcaggaactttggttcatgagtcggagcctggatcccattcaacatcttacaattctcagtccaaggctcaattccaccaaccacgtgtcttatgtccaagtatgggatttgttctggaagaatatttaaaggattatggtaatccaggatgggttaaattgggcattactggtatgtttttacctgttttccatcacactactttcctaaaactgttgcagagaaagtaggtaaataattttctccccactgtcagaagaccatctgctgtttgagacaattctcctagatattattattattataatttttctatttccaattagcagcgtacttcctttaatatgatgctttctgcataaaccatggtttctgcagatttcctaaggccatcttggtattttgtctgccttttcctcttctttaagggtgggagattttctcttactgagagcgatacatttctacattagtacctattcatttccttttcattttctcggagaaaaacaatcagagctcatcattgctgtcgtcatggagatttcatgtctccagaagaaatccagttgaggagtttctttgttaatcccatactggacattcaagctttcttgtttgtatcccagcagcccaggcagggaagccattgacattgattacagtgtgattcataacccagggtgggcaggggaaagtgtgtgcagaaggagctgtcctggggcactggagctgtgcatacagtaggtgctcaggctgcagttggtgactggacagaagcagcagccagagctctaacaacatgtcagcatcttggctgtccacagcatcaggaactcaacacagccaccgccagcctcattatcttcctggtaaacctgtcctcccccatctttcccaccagggccccactgtctgctgagctgtcctcctctcgattctgttctcacccctccagtccgaagttttgactttcattctattgatatccacatttccgggcatcctcctttctttctcctcttccggccctcggttctttgctctggttcatggccacggtctcctagggaaccaccccttcccctcctggcaaatttcttgctcttcccattgctgctggaacagtgagggcacacagtaggtctgaagcatatctttgccgaacaatggtgagatcgaagagtcttcctaatatgcaaatctgatcatgttacttctcgggtttaaaatccttcagtggcttccactgcttttaagataaaaacctaaacccttggatcattcaaaggctttcaagacctcatcagcatattttcccatcactactcatttgatcttgtggcctgggcatcctgagtgagtgaccagtgatgttctgggcgatgcacctgttaagtgcagcagttgagaatgatctccggctctggcatcagattgaatgtggtcatgttctagctccatcacagagttctgcaacctagaaggagttgcttaaaggctccgtgcctcggtttcctcatctgtaaaatgggcttgattggaagtatcacctaataaggttgttgtgagaatccaatgtatgaatacatgttaagtcgttaaatcagtacctggcatgtacaaatacttcgtagttgttatgcaggtcttactgtgagtgtgattactttatactttgctgcttccttctgtctggaataccctgctctacctgtacctaaccaattctacccatcctttaagtctcagtcccaatatcacagcctcttggaaaccagcttctgcagctgtgtaatagtaaaaccttaagtggtagagtcagaatgtatgactttaaatcctcgttctgctactgactcttttattctagtctaacctcactaagccttggtttccttgactacagaattaggataataaaataacaataacaattattttgctgtcatacaaagtaaaagtttgtaaagatatacctaacatgtactgaacacttcattcatgctaggtattgttttagcggccattcattcttaccttttatcaagaacaaatcactgtattataataatctttttacttgtttttcttggcacctagattgtgggttatataagttcaaggacagggtctttttcatcattatatcatggcacttgacacatcagtcagtgggatggacaggaatccagctgttgtgtcaatacatgtgaccatttgcatgcataatttaggagatgttagaggattgtgatggtaggagaaggagatgttgggcaggaaggatgttttagtgggatgggggagtggagctcttttctttctttggaaagtactgaagaccagaggttaattgctattgccccatttcatttggcacaagggtgactggggatgggagaggaagcctgtcccagaagggttgggactcaactggagacatgatgcatgctttatcagtgggatttactaacatcatactggttcttaaatagagacgtgccagtaaatatttaacaaccagtgctccaagaacaacacaaagccctgatttatagtgtttgctggttaccgtggtgtaaatccctccaccatggccactttcaaactaccactgcaatgttattaaccaacctgcaaaattcctgaaattgtaccaactcaccagtgatgagctggccccagcatagcgctgtataaacttcttacttcagtgtttccatccgtaacatgtgaatcctataatgtgagtatcctgtctccaagtatagctgccagggggaggtggtcaaatgtgataaaacgtggaaatgttagtgttttaacagtgcctcatgtgctcacccttacatcaaaactctcttcccatccactggctgtgggtcatagggccaggatatgtgccgatgatctctcaaaaagcagcctgtccagagttctgctcagagcagtatattttgttttatcctcccaatcggggctatgctttctacagcagactgactcaattagcctttcattccagagtccaattgtgagtcaattccgaggttgttaagcaaaatgagtctggtggcattagtctctcgctgaaggacagtaatcctcatcacagtgttgttcagttaatagtctgctggagagactgtgagaaacaggagatgtggagagggagcgaccttttgtcttgtctctgggggacaggccgggagcattgggctgccaggtcagagagctgttcagcagccaggttgtgtgcagaaccggagccccagctgcctgaacttgcagttggcctttgcaaagttagaaacccagtgtcactagatcattaactttcatgaccaggaaaattcttttgaaattaacactcaatccaagctggatgccattggagccagttgagtaagcccgagccatctttagggatttcctctgaaaaacgaatcctttagccaggctacagaaaataggcaggttttatatctttcagtgtgttcaattaaagtcaggaaacaccagcaaggcacggaccgtggttgccactcaggtgcgtacacacgcgcacaccccagccacattcgcaggattttgccaaagcacttagcttcggcacatggccctgtctggggagacttatacaggagctctctgaggagtgtcaggtgctgtgcaaaggaaataaagcagatctccagcatctgctccgggcattcactgcaatggagtcaggtccccagaacatagagagcacacaagatgggatcagatagggaagcctgggcaagccttgtttacaagggttcaaggagagaaccccacacaaacatgcctttgcagcgaactgcggtcttggataattccatcaggtctttgaatgccctttctagttaaaattgcaggaaagggatgcataatgcgcttccttagaaacctttgtgatccccacacatcctatccgtcttggttccaccaaaccaaactcgtttatatcataaagtgtgccaagaaaatacagtctcttaggtggaaagaagtaaaacagctctggttatgtcaacagccaattctggggtgagctaaagacagaagagaactgagacagcctcccattgtctcccataattgccagataatttaaattcttgtgaagtccattgtgttcttccatagaaacagagcagttgtctgccgagatgacctcagaggtggcccagctctcattcaggatttctccaacagtatcctcttcagatggaaaaacagccagttggccacaaagggccctcttctccgcagaccagcgtgtctgcggcttctgtccccttctgggctgctgcatcttcactgccacccagggcttctgggtggactgcaccggcccctggagagattccaacctgcaggcagctgtctcatcttgcagcagcctctccaggcacagccttgaccacaggcccacccgcctagagcaagcctctctgtccctcttggcttccccttctgttccccaaaggcaggctcctccccagtgccactcggctggaataaatcactacccctgggctggtggatgagaggtgacttacaagacagaaacacacattcttaaagccagtaggaattacaggagcagatgggctgtaggatcctattttgatgccagggacacgtttctgtataaagtaaatattttcccagtgtggatctccggtgagtgtgtggagaagcatatttcctaaagatgcaaataagtctagtcagaaataaatattgaatggaaacttcaaagcctctagattcctccagttataggccctgaagacttctctctgaataaacagagacacacaggtgggcgagggctggggaaagggacatgagggggttgaatgagaaaggatgccaacagtttcttagctcacgttttctacgtattttgtgtgtatgtgtgtgtgtgtgtgtgtgcgtgtgcgtgtgcagaaaaaggcatatcaacaaaggaataaagaaaacatgtctgtccggaggcttaggatgttttaaagcacatttccaccccccaccccttttttcctattgtagatctcgccttgcggatttttttaccaactgccagccagagtcaaggtctgtcagcagctgtctaaaggaaaactacgctgactgcctcctcgcctactcggggcttattggtaagatccgagagaagcaggatgggagaagagtgtggtttgcatatacctgcgttctttccattgcgccttgctgatgtctgcagaagtgaaaatctcacagtaacctctgggctggggtttggatgttaaatccttgaggacatgcctgtaaaaaaaaagaaaaaaaaaagaagaaaaaaatgggataatggatgcgtgaaaggcagaggcaggaagcggggattactaaggagtggggaggctgcaagtgcgcagacgggtaaggcgtctcagttgggaaactgaccacgcagaacaaaagcagagagaaaaaatgtttggttatggaagaagaaagcgagtcaaacaaagttaattgaattagggaactttggagaaagggaagtcattcaggctggggaaatcaaaaaggctgcttcccagaaatggccctttggaaataaaaaccctaaatacaggggccctgcttgctgttaatgttcttggtaattcaactcccagtgtgcagtgggtgatttaggctaaattttttttcctgaaaacagacatagcagtaaccgtattttctgtctttcaagacccaaggctttagaagaaccatgttctcagcattctgagcagtgtgattacgcatgactgccgtgagagtcagaagggaagcaaacttggacccctggataccaggggctgtcagggggaaaggcaggtgtcccaggtaccagggacagcagaagccttggtggcagggctcatctcaactggcatttgggaaggaatatgcagtgaaagctgtggaagggtgaggaaaatcacagttgtcagaagcacgatggctcagccagggtgtgtgttcctgccggctgtctgtgtcagggtcacacacgtcaccactaggaagaacctctcccggagaatgacagcacagactacattctttgtcaccagagcatcttcagcaggcggctttgggaaaatcaataatggtacttaatgcagggatggacaggttcctggtacattctttactcccaactttttggaaggatacctgccctgctgtgggtaatagctttccccagatccccaagtattttctatttttattgattgggccaatgagtgtaccttccttaagccaatactccaaacttgcattcactctctccttttcccgagtaagttaatctctgctagggatgatgtatcaactatggaattgcagaaataacaaaagtagtcaaggcattctcattgtaaaaagtgttttaaaaatacagagaagcccacagaagaaaatgttgagtatctccaactcaactctagctgcatctgctaacagtgtctacatcttatggacgtgagatgtaataggtggtcagtaatccacagcaagtatttggttcacaaacagaaaagcagtttttttccaagctcctctaagtcaatggatgtagtccctgttaacacttcagtcagtgcccttcccaggtgtacctgctccttaacctctttatgaggggccaaggccaggtactgccagcatttccatgaagtttttcctaggcttggcaaaccttaaacccttacgcacctaaggatgatgaatggagggcccaatggcagaggcaatgcattgcagagaccaaaatgtctttctctgttgggtctggatctcctccccaacttctttctggacaaggcttattcctacttcttccatgtatgccaggggcccaccgtggcaccaggcatatccaatggccttaacctcctcccctagtgttcagggtgcctgttcctttctcaaccaaagttaggagttccctctatgcagtaggttaaaatgttcatcccaaggtataatgcgatgttatttagttcatgtcagtaaagaatatagggcaaagacagtatgcccttgactcagagaagtttagaacaaaattatttttctgtttgtgatccaaatacaccctgcggactactgaccacctattacttcttacatccagaaaatatataaaaacaaaagccttcttgtcatcagcgggcattgcctggtgtcggccacccaggagaagacatttggtttggattaagtataaataatttgtgtgtttgtgccagtttagaactcatcagaaatatcacgacaagatgtaggcaggaaggaccacccagcatttctttgagcaccattgagagtccacaggcaatactctaggagccgttgacttagagaatttccactgtttgtttccagttctttcactacgtggaagactttatttagatcagttgagaagaccccatatatatgtatatacactcagggtgcaggctaaccgctaggaagcttctagcttccctatgtcactctaaagaaaccatttgcttctgggggaagtggattcaaagtcctaaacaaaattgtttaagatatgtaaacccggctctatctatttatgaagattaatgacattttcaagaaaatgcaagggatttggcaactcatgcgttctctaagttaattctttcctactccacgacatccataccatttgtgcaggaaggaataccctaagtgcagctcaaggagttctgttataatttttaaagtaaatgtgtaaattattttatgtgctcaagataaattgccgagaaaatgcactgcttaacataatttcccactcagcaaatacaatgtctgtaattatccacggtgcatccgccgtcagaggaatattggtttctttttaggccatggaaaagtatcatcatacaacaataaaatgccttgtttttattcttttaggcacagtcatgacccccaactacatagactccagtagcctcagtgtggccccatggtgtgactgcagcaacagtgggaacgacctagaagagtgcttgaaatttttgaatttcttcaaggacaatacatgtcttagtgagtttgtaaaaaataagaaacaaaggagcaaacgcattttcttctccgagctccagctgtacctcttgtaccttgtgcctgtacctcttgtaccttgtgcctgtacctcttgtaccttgtgcctgcttcctctctctgtctgtctttctccctttctgcttagtcactgatggtaaatccagctccttttgtgggccaccccgtgtaatgcagcagggaacccagcaagtgatgaactgggtgctgctaagactgtgaatccaaaggcctgagagagcaagagattcaaataactaagggtacattatgtgggaaagaacgcttctacccgcagatcaaattttgatcttggcagcctgcggagagtctgttccaaaggttcttgaaacctgggcggaatatacaatgtgagaagctcagacaaattagatggggataggcctccaaggactctctgagaaaaattagaatgttaacatcaatagccccttggatgctcagggctggctcagaggagaagcaacaattcttgagggggataaactggcgatgcaggcaggaggctcgggatgcccgttatctctggaggcgagataagcactggggaggagggagggggctcctgcttgaaagcagaatccgttcttactgcagtgtccttaaggcagtttggaaacacgtttcccaaagggacagggatagagagaaatggacggatgtgaacaatgggcattcatcagactccaaaagcacggtgccaggactcacgtatatccacccagatatgcacaccctagatgacgatccagctgagatacttgaaaattgcaacccactctgtggcagccgccatttattgggtatcttctgtgtgttcaaactcactctatagcgagtgtaaaatatacattctcatttactgtaatctacacaagagtcctcatagacataggtggttttatcctgccatacagctgagtaaagcctggtaattcacataagcctcgcatgccagagttaggatctgaagtgtgaatccttttgcggccccctgtgtcctaagagctttgttcaccccgatgttgaggagcctgttggatgagaacataggcctgaacttcaggaaccatgtcagtctgacttcctggtgggaggggtgcactaagtttctgggaatcaaggctcagccacccacccctctgagagccctgtcttcaagtgccaatttctccatgatgcttggttggtagctaatagtttactatgcatacacacgcacacacacgcacacacacacaaaagcttttgtgtgttactctaaaacttcctcatcatttactttgttgataggaaaaattgaagtcatttgcttaccagacacttcaaataatgtggctgtagtcaattgctttgggcctcttaaaaataaaacaagcttttggattcttaagtgaaattcacacccacaaaagtagtgtcaagtaaggagaccttcactacgacattggggcataccaaggaatcacaacttggacctcttatttggtctcgactgaaaatgtgtgtgtgtgtgtgtgtgtgtgtgtgtgtgtgtgtgtgtgtacgtatgtatgtatatttcctctttttcacatccatctggcagaatgcaagttttaacgaagataaagcaatgacgatggaggtcagtgcaagaaaagattttgctcatgctggctggaaaacttctccctcacagggaaattaaagttgttcctgctttataacctttttggtgaaggagagaatagtctggtgtctcattgttaatgacttttcaataaaaataaatgcattttgtctgcatcaggggccaaagccagccagaatttttcacagtcattccatttccactatgactagatggggcacagagccccaaagacacagggccatcagttcaatctcttgtaactagaaggaattgcaatttgtagattccagcccaaatgtagaaacttaattctgctccgttcagattaagccaaacctctcccagattctcctttcatgaacacaactctagccaattgtttatttctagtttgggggaggaaacagttgtttttaagccatgtgcatgacagatgcatggggaagagacaaatgggatggaggtgaggttagatatcagtggctttcactcaggtctttattcagatggcaccttcaccaggaggccttcctggatccgtttatctaagtaccaactccctctccccagtcaatgcctctggcgctcccttgcttaattttctccaagcatttctcactgcctagtgtattatatatttcacttatttgcctgcaaaaccacaatgtgacctccatgagggcatggacttttatcttttgttgatgttgttgttcactactgtgtgccccatgcatagttcagtgcctggcacttagtagatattctattaacatttgaatgaatgaatgaatgagcaagtgaacaactgaaccgctgatgtggcaaggcaaacacactgggaaaagcacaggtagttgcaagaaactgtgagtctcttgaatctacatgttttaagcaaaagcaagggtagcagtggtggttcttctgggcatttaagggaactggtccctgtgtgcctctttctctgcctcacactcaccagttaagccatggaacatagctgggagcataaaaagcatttatattaatttgaagctgtttcttacagcccccaaaaatgtaaaggtgcagaaaacaagcttccaatttactgaacttaaaggataacaattttagaacaaaatgtcacttctaagaggaagattaggcttaaattattctgtcttgtatatagaaaaatgccaactaagagtcatatattaacaatttgcacattcaggtcccaaatggaggagtttggttttttatacaatgaatatgaaataaaaaaaaaccctaaatccaggccaaatccccgaagacctgattagaaactgttttttattcattttggggaggggaacaacacacaaccaatttaatcttgccataaaaacaatctaatcctatgaaattgtaataagcttttgaagttttacattttaaacttttcatttaagcagggctgctcctacctaattatgcagattttgcttggaagactggagcagaaagaaaaaaaataatcttacttaaattttcactagatactgatgagatttggggtagttttttttttttttttttttttaaagaaactggttccattttgcctgccatattaatgtgaatgccacggaattgcctcagtctcatgattaggattttttttaaaaagcactaattagtttccttttaatatagaatattgacagagcacaagaattttcttggaaaatgggacagttatgatcccaagtaacagtactgatgctgggtttcaaagggcttgactgatggatattttagggcaaggatcttgctcagcacctggcacgtaaacaggaacacaataaatatttgttgcattctgagcatagctaagtgtccagctcagggtgtaatgactgaattgatttttgagcaactgaccccaaagactggctctcagcatgtatagggcaaatggatggatgcgttttgttcagagaagtccaatgctataatcagaatttctagtgtgcctctctggctgtgtatatcctgtctgttacgtttgctgcttgactttgaaattggatttcctcctgttttactgcagaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggtgagaactgcgtccagattccttgctggggctcccttcctggtgggggggtgaaacacgggcagacccattttctgaaatgtatgcagagagagatgacgaatgctgctcgggtttgagtctcaaaactgcattttaaacacaaccagtgaagattgtgacctgtcgtatagtgcagagaaagtccgactatggaactgactctgtcgtttactgggagtgtggcttgtttctggccctactttctttacctatacaatgagggttctggggagatgcatctctgaagttttctgtgcgtggggttgtcaagttggcttggttacatatttattatgctgattctgtgttctctgcaaagcagcagcataatgaaaggaaaggagctcttgagtttgtcatcatcacatggcatggagtatttaactgtctctaaaggtaaaccagagacagtgttgctggttaattcccatgcagactgcttgacgggttggttcttcagaagcaaaagcaagtgctctttggcagtaggaggagccgtgaggaggcacaagctgccctgcaaacccccgcatgtggatacagtccagtgagaacggtcaagaacattctctggggttaatccaggtctgcgagggcagaaccacagcaagatagaagtggtgatttcctgtcttcagtcgaaagcagagtctttatcctgcttttttattgatttttcatagtaataagtactcagctatttggcaggacatctcctatttgtatgttcacagggtatgttcacattctttttttttttttttttttttttttttttgagacagagtctcgctgtgtcacccaggctggagtgcagtggtgcaatctcggctcactgcaagctccgcctcccgggttcacgccattctcctgccttagcctcccgcgtagctgggactacaggcgcccaccaccacgcctggctaattttttgtattttttggtagagacgtggtttcaccatgttagccaggatggtctcgatctcccgaccttgtgatctgcccgcctcagcctcccaaagtgctgggattacaggcttgtgccaccgcgcccagtggtaccctcacattctttacccctttgggtgttatcctcctgatgcctgcaggagagatgctgtcactatagtatcgtagcttctttcgtttgaggacacgggggctcagagaaggatcactcttgctcaagtctgcagagctaatgggtcacagagtcagcactgggaacccaggagcctcgttctttctgtgatttttcctgtattttgagggaaatggtgaccacatggtagcttctgcctcccgctatgctggagaaggggatgtttggtggcctatgtgccaagcactgtgctgtcgcctcatgcttatcactggagcacatcgaggccccccagcccccatcaagggtcagcctcactagaattctcacaagatgccttctttcaccaaatactagcttgacccacaacccacttcattccctagaaagtttcagaaacttgttttgatttgcttggtatctcgagacccctcttcatcttgggtgtcctccacgccattcatctgagcttatgtctctgtcctttgtccttctggttctccatcccagacacacagtcttcagagacactcacacacagaaaacactaaggagaggctgataacgaaatggcacagcccaaggtcaaacagatgtgcttcatacttctaaagcatttcccgggcatttactctctccaaagcactgtgcagagaaagccagagccaggaggagctctgggaaatactatggcgtggaactgctccatcctgcagcgaggccgagtttcagagcagggaaatgatgtgttcagagtcctccagcgagttgaaagcaggcctagagccaggcagggaacagggtcttttttccatctccagcgggtgctctgcaccctgcttcctcctaggtcagccttccaagcttcttgggcccattcagattctggtgtcggtaaagacaagtggtcaggtgaggggcaggatcctattatcataaggtgatcacgggaagccagtggtggtttctggaaagaaaaggcaagttctggctacagcaaaaccagcttcttttctgcacgtgtctcagtgcacagagggtgactgcagaggcagcgttcagtgttcagcctgtttattaagtcccttctctgttttagaaactttgtggagatgggcattcaaaaacaaaagttgccttgtcagtaaacctagaatactgggcaagatgcaacttgtcaacatttttggaagttaataggtgacatctcagaatagtcatcattggaaaccccatgaaattggagtttcccccatgagaggagaggggtctgtcagccacaggaggtgttctcttccacaccgccccctgtccctccgccccccgcccaaatcctgacttgggctccccgtggtacagtgcagtatgtggctttgcccccaacacagatctgtccaaacacctttccctgcaaggaggatctgtactgcctcagggttgtcccggcaacatcagggaacacaggcgctctattccccagaaaccatgtctttcctttcctgttagtgataggaactctgcttcctaaacagaaggacaaaagtaaaattaggagtttgtgaccgcctggccaacatggtaaaatcctgtctctactaaaaatacaaaaattagctgggcgtggtggtgcacgcctgtaatcccagctacttgggaagctgaggcaagagaatcccttgaaccctggaggcggaggttgcagtgagccgtgattgcaccactgcactctggcctgggtgacagagcaagactctgtctcaaaacaaaaacagaaaacaaaaagtaaagcatgacgtttatctctgggctgctgtttaactccttggcagagggggacatgaaggcgtggggctgtggaggaacaaaaagtggctctagccacacctctcttccctgtgatatgcacagtctccacatatcctggagctaaacagcatttgactcccagggagcccttagggttccatggaacctcactttgactcctaagatgacgacctgcatgagcccctttttgcacaaatgaggcagggaataagggataagggcaggggaggcagccaagcccatttcagaccctgctcttgtcctcaccagtatggtggcctctgcaagcatgctaacttctctaagcctcagcttcctcacctacaaagcacatatatggcttagctgccggagttgagaggattaaatggagcagagtaaacgttccagaatggtgctttatgaatgtcacatgcagtttggtgtctgatcccaagtcagtagccacttggttcctttacaacagatggaaggtggtgctatgcttccttgggggtggggtgttgggtgtgtgctagggaacattggtgggaggttacactaacaggtgtgtagttttatttttcaaaaccttctgtgtgctttgccctctgcactcctcacagcagccccatgactcaggtgtggcagacatccttgccttttacaaatggagcaactgagccagggagagccttgtgacatatccagaatcacacagtaattctctagcagactaagatttctaactttgaggccaaggcacttttgccttgttccatgacccttggacagctgggattctttctctggatgaagaatagacagtgaggaagaaggaaagaataagaaaggagaagctggttttgagagagccgcatgtcttagttcctcgtgaggttcactgatgcaaataaggggtacagaggcaaagctccgacttcagactgggtttctttcttcatgcctcaattccaggagacaacataggggaaggactgacagtttgccagtaatatttttgcagcttgctgattttctagggtgacctctatgaagaatggttgaaaggatcatctgaggctagaggatgggggggatgagagagtgatgagtgaagggccttcatcccaagaatgtggtccctccagctgatttaggattcttgcctgggcggagggctcccaggagactaattctccccatctgaccctcctctgcctgcatggctgtctccagatgaattatcatttgccggggaggaggatgggggtcctagaaatatcttagaatggcgtttgtcccagccacatgtgtcatgactcagaatagaactgactttaaccagcttgggatccattggtaacagattcagagaaagtcaactatctttggcagctctaaagttcacttcccttgagaagcgccctcttgtaatattttaaaatatacaataatatgagaaaactcttggggacttgagtttcagtcttaacatttgagatagatttcccccttggaagggaagaaacacgaataaacattttccaaagtctgctccgaagtgtaattatcaacaaaccaaacgcagttctgtttggggaactaggtggctatggatatggtgaatataggacgcatccatggttcctatgaaaggctttgctttaaaaaaggaaagttgattgattagtgtaaaatgttacagaaatgtccaagtgctaaccccctgaggtgataaaataccgggttttgggttacccgccaagctcccatttcaggattaattggcagtcatattagtgacaagcatggcacaggctgtgctattgttggcctattccttcgacttacttatatgaaatggtcatatggaaaacaaagaaacattaataatcctatcaattacttcatcttccgtgcactggagtggtctggtagctggaaaaagctcaggatatttaaaccaaatggactgtgtgtgtgtgtgtgtgtgtgtgtgtgtgtgtgtgtgtgtgtgtgtgtgttacttatttaaagtaaatatctttggaacgttagaaaaattctctattttgcatcattgtacactgcttaactctggtgtcttacagtgaagacatcttaatgtggtgtttgtcgacctctgatttctgtggtcaaatagagtaacaaggattgggagctatagccttgggactcaggcctcctgagaaggtttcactgcctctgccttccttcagccccttgcccctggaaatgcgtgacagaccgtggggcacacgctcagccccagggcgagcagggtaggtgaggatagctgtgggcagttggcacaggctccagtaaacagcacaagccacattcaaagttagagattacttttgtgagtcacataaaacacatctgtgggtgagacatggaggaccagtgtgacagatctcatcctggtgggacttttaaaacagcattctagaaggaaaccacaaagcagcttgcctagtcatgaaagagatgaagggtccatgtggataatcttcgaaagcatgcttcctgttaaaatcaaccatgcagagggcagccgtcctgcccccaaccactccaccagtagctgcctggtcttctctggccatcagaccatgctagccctaaggggttcacagtagagacaccgtgggcccctctttgtgtggggtgggggcagaggccttggggtgggcatctgcctggagcagagaacctgccacattcactggatttcagcctaggttcacaccttgccagcctcccaacaaagcctcaatacatttccttatctccccagagtcgtgtcaagcttagaaaacaggtacttgtaggatgcagcctaatgtttgcagagtggcaggagggatggagggcagacctaatctgtttaactcctacatcttctgcatttgaatattgaaaataatctatatttagatggtcccttccaccctctccccacggccccagtatctcctcagatccaaagtccatttgttccagatggggccagaccagaccagaaatgatttcaaaactcttctttgtgggggcaaacccccaaagtctagatgcggtgggaaggcaattatccaagcctaccaaatacccaggactccactggctgtgaccaagtgaaaattttaagtgtcgagttttaaaaggaaagctgccaatgggtgttctgtaaatcatttgtgccagcagactgaccccattatgtcagctaatcctggaaatacaggaggtaaatttcaatcttctagcacggagcacttaatcaatattctaaatgtttttcttgcaatttatgctagcagagcaatgggatgctttggcggcccgttaatcttccaccagagaagaggcgcttgagagccagtccagggtgctgggattttgcacaggatgatagactgggaggagaggaggcctgggaagatagaagcgaggaaagagaggtgcttatttccacaccagactcctggctccgggaagggggttcaccccctgtccttaccccacccctccaagtagggtgaagtaaccctgagagcagttcttccgcactttccttttcacccatggttaacagtttaagagttggttttccgggaaaagcttgagctttggagttagttggacctgagtgagaatcctggctcgcctcctgtggctccatgactattgcttggtttttaccctgaatctctgctgtaaaacaccactgagctcttggttttttgtgagggataaagaacagtgcaagtatgcaaagagccaggcacaacaacaggctgacccttggactgggggaagtggcctccactattggcatggttggtgagatgcattagagattttgacacaggaggctggggccagaaaggaagagctgctctcaggagcaggggggccacagaggaagaacgatggagctctttagattgtattgtgtcttcttaattaataagaagggtttgaggctgggtgtggtggctcacacctgtaatcccagcactttgggaagccaaggcggcagatcacctgaagtcaggagtttgagacctgcctgaccaacatggagaaaccccatctctactaaaaatacaaaattagccagcatggtggcacatgcctgtaatcccagctactcaggaggctgaagcaggagaatcgcttgaatccgggaggcggaggttgtggtgagccaagatcgcaccattacgctcttgcactctagcctgggcagcaagagcaaaagtccgtctcaaaaaaaaaacaaaaaaaacaaaagcaaggggcggtttgagctgaatgatatcctgccagttctaagatgtggtcttggtggaaagtcccagggaggaggggaagagggagaatgttctttggacaccaggccaagaaggaagggaaaccaaaggcaataaaaggactaggtcttcagggattagaactgatccaaattccatctctccgcacatctcctgggagcttcatctgacttacctgcctcttggagctgtgacttggagctgccactctggtcagatcttggtccagcctggtgaccagagtggaactagctgccacggtccccgccacatctctttaaccaatgctgacattaggaagaggtgatgcagttgttaacatgaaacattcttggttgcagaaaagacggtatttgagaactagtcctgcctcttagcctcaaatcccaggactttgcagtctttgccatatctgcactccactgatcctattatttgcttcatctttgtctttaaattcaattatgagctatacttatttatatgcacactactgcctttgagactcatctgaagctgttactaacatatgtgaaagcatgagttcaatgtgctttctctatattaaaatcaatatataaatattaaaattaaaaccataaaaaagtttgcgtgctacctaaaatgatgtcgtataccaccagtagtccccaagccccactttggaaaacattataaaccatctcattctatgacagatcccagaacaatttgctttgataacttaggtcaccctagctttttatggccaggcattaataaaacaaatgcatacgcagtgcctcccctgagtaatcctcacagtaacctcagaaggtcagtactgttatcattcccatttttcagacaagagacccgaggcacacagatacttgatcaggagaggagcaagggcaaagcagtgttcctccctgcccccattataaatggctacactgtattaccgaaaccagagcactttaaacattgcgtttctgggtaacatttttcatcgctatagattaaatcagtccctaaattcttgttgaacatctggcagactgaagtgtcagattggttcataaatgagcataaagaaaagtaatgatgcctattctgacaccaactggtagaccgcagtacaactcaattccgagctaaccactcagggtgtcagactccacaggttatggccgtggtccccaacaagacggcccttgcttcagatgccagtcacactttggggttcccaggccacctgcacttctgaccaactagttacaaatccaggggttcctatgaccccctcaagttcatttcactggaatgattcacagaaatcaggaaagtgctacaagacctaagattacaactttattatcagggtacagatcagaaccagctagacaaagagatgcctagggcaaggtctgggggggtttccaatggagagcttctctgccttctccccatggaattagggcatgtcgcccccttgctgcattaatgtatttgctgcccaggaagctcccggagctcagtctccaaagttttgttagagttttattaagtaggcactattgattgaatcattgaccacgtgactggctgtcttcagccctcctccccacaccatggggatcaggaagtcaggctgacctactgtggctcaagtcccaaccctgtgacccatggttggtctttgtggtaacctgacctaatcctgagtcatcccattactcggacactcaggtgtgatccaaagaattcatgaataacaggcactcaagaaattccaaggatttagaggttatctctcaggaaccaaggacaaaggccagtcaaattcttaattatacaacaacgcctcatcagagttggttgttttaaaatataattttaattctagagatgcaccgtgaaacttcttttattttttaaatgttttatttccataggttactggggaacaggtcatatttggttacacaagtactttaatggtgatttgtgagatttttggtgcacccatcacccaggcagtatacactgcacccaatttgtagcactgtgaaacttctcataaggaagccggagttgaaactgtgcactccaccacttagtagccattaaactttgggcaaattacttatcttttctgcctcaatttcctcatctttaacgtgcagatgacagtagaagagcttcctggggtgtttgcggattaaatgtgtttgtgagtgtaaagcatgctcagaatggtgcccagctcaaaaatggtactatgtaagtttttattagttgtaagtttcaaggggctttcggcccagcaattggatatcactgtcccccttcgtcccaccttcagtgtcagagaagtgcccttaaggatcaggctgggttatgggactcaggaggcattgctttatggggcctttttcccagcaggctttctggtcttcgtggcctgtggagctccagtgtgtggagtggaacttgttatggataagacaaaggatgaggtcttgttagagtgggggttttgaaatggagtttggagataggtgcttcttcatgagaagtcacttgcttcccctggtattctctgctgagggtgggctgcacacccccctgtgccaaccctgtcgatttcagtgaggattgtccagtaacctcttggctgtgagttgaatggttcttccaggccaggcttcctcgacattggcactattgacattttggtctgcaaaattgttacggggggctgtcctgtgcattgtagggtatttagcagcgtccctggcctctaccgtccggataccagtagcacctttcctcaactatggcagccaaaaatgtcctttcagcactgccaaatgtctccagggggcagaagcgcacctgcttgacaatcactgcccgaagcgaagggtgcctcagagaccccccttttcctttatactaacaaggaaaatgggggcttttgagaatcctcgtgtttcttcctccttctgtagcaaggagcatagggagatataagtgtaaactggtgcactggaccaaatctttcctaggtagtgcaggcagggacaaggaaaggaagctgtggttactacttgtcttagtccatttgggctgtcataacaaaatactgtagactgggcggcttaagcaacagaaatttatttctcatagctctggaggctggaaagttcaaggtcaaggtgtgggcagattgggttcccagtgagcgctctcttccaggttgcagatggccgccttcctactgtatcctcacatggaggagagagagacctctggtgtctcatcctcacaccatcaccttctggtgtttttacgcatccagcgcgctggatgattaccctgcagagaacatctcaaaggagacttttgcccaacgaccatagtggatggaagtgttgtgccaaaccatggtcaggcttctcacacatggctttgaggacggaggagctttaggaggggtgggattgaatgggattagaaaactagcaccagacatgtcaacgctgagcccatagcacaggcatagaatctaaatgacggtagcaacgtggataccattgcctgggccttttatctaagagaatggtcttggggctgcgtgttatttgtggtgtttggtttatggtctttgtgacgttttcatcgtctctgtgtgatacagactgttttctagcacccgctgttatttttgtcacatagaaaaaaatccaaaccttggctatatctaaccttggctatacccagcgttttctctgcgtaatggtctcctgctctggctgagtttatttccccactctaggaggaatgagctgttggagggggatcttcccttagcagaagtgttaagctgcaaggcccctcacctagactacatccttctgggccctcctggaagctttatcacagagctctggaccaggctgccaagtggttccaggccctgtgtggtgaacctgcttctcccagcatggacaggctaccagtgacctccttggacttcatcttcttggctccaagtgccagcagaggagcttagagggaagctgcatcccagaatccacccacgtcagccttgggagaaaagaggctgttgtaaaaacaccttttataataactgcttatagagcattttcaaagcccttcagccaagaaagtgcttgaattcagagctcaaaattgggtattaccctgttaaggctgccatacaagccagcatgctcaactacattttcaattgtgtattcaactcgattggaaatggacacatgcagggtataactaactggtacaaaaaataggaatttaatcttgggggccaggccttatgattgataggtacatatgtgtggcaccctacatcctaggtatcatacatgtaagtggcagctattccgtaactaagcattttgcatttacaaaatctcactcatggggagacgttaagggaaaacagtgctgttcctgcaagacttttcttaatctccggggccctactaagtgtcgcttgtgcagactttaacataggaagctgactcttagttctgtggttgcaggaacttggcaaaaggcagctgccatggaggacaagctgtcccccccagcctgccgacatcaggtgctgggctgccttgctgaagcagctgttatcatattgccagcttctgcaaacttaattcaaaaaatgatttctttgtgattggcatgtttgcattgtagcaaactttggttcaacatattgttagaatacataatactgtaatttaagattattttatcagcagtaaagggttttataattcattttaaaagttgtaatgggcttgagcatcttcagtatagtttaataatacggcattttatagctggctgtaaaatttcagattacggttttagcaattgtgcaattctattttatagtttaataattgttcaaatgaaggagagtgtaaagttcctaaaaaccaatttaatgacttagaaaaatagcttttatcaaaatctattgcacacctttaatgaacccagatgtcaccttttcaacaaaggcaggtcatgggatctatttttctcagcaacaatgtagccagatgccctctcaattaagcacatacagtgctgtatctctaaattataataatttttctctttttaaaaactcttttatccctaatctcctatagctagaataagcctattttccaagcactaggtgaacaccagtgaggccaggagaactccagcttaaacaggcgataaattggttctctccagagaagattttcattttacagatggcctcttgatcacactgcctgaaccccagctcctaactcttataaagtctcttatgaatacctccaaataactcatagtttactattctataaagtgaatggcagaaagggatccctacctgataatttaattatatattctcattacgagtaatacaagtgttatcatatattatagcatctgggagaaggcatgatctcattgtcattggaattatggttcatgttatttatatttctggaatttgccatgggtatgttttgaggcaacaaaagccagtaaaagcggtggcccagggatacaaacacagttatcacatagcttagggagcacaccatggggaattaggtcccaggacccttgaaaacaagtgtgattattgagcgaaccagctctggctcagagccatgtttctgctacacagaaatggaaaaggtcaaaggaagtcccatgtggctgggctgtttcccctctgaggtgcagtctggtgacctggggttcacggcccattaccactctgtgctataagcagtgtggtacctttatgtgaacaaagggcaggctgattttgaaccctccacccggtaaatactttgggaagaggtcacctgcagcgcctagaacccctttcttctatcaccctgaaatgacacaggcttcctttttttttgtttctcattcagttctctagttgtctgacccatctttgtcagcttggctccagggtgtttctgtggaaatttggtgttccttgggaacaatgtaaggctgtccgtgcctgccatttggatatcttttggcaggtttcagtcatctcagcaaagatgccacagctggaagacattcttgctgccttcagacaggcattagctctgggcttcagctgttgtctcctcttattcctcatcccagaacaccccagtactatgttatagtaccccagtactatgttagtactatgtagtggacagcacttagtgattctgtggtcccatggagaatggaggcaataccgtcctttgttttgctccagtccgacactcactttaagataatagagcttggccgggcacggtggtcacgcctgtaatcccagcactttgggaggccgaggtgggtggatcacgagttcaggagatcgagaccatcttggctaacatggtgaaaccccgtctctactaaaaatacaaaaaattagccgggcacagtggtgggcacctgtagtcccagctacttgggaggctgaggcaggagaatggcgtgaacccgggaggcggatcttgcagtgagccgagatagcaccactgcagtccagcctgggtgaaagagcaagactccgtctcaaaaaaaaagataatagatctcaagcaaaacacagcatcaattgtactgatgcctgacaagtgatcatgcaaacaagtgcagggtggttagtttccagtgttgatttttttttaagaaaaggagactatcatacttaggagaagatgctgaagggccaggcctcttgatacaataaaattcaaaccctctgcaggctaagatggagagtagcttaatctctttggtccttggatttatcatctaaaatatgagaatgataaatgctactgcccaggagtgttataattattaaacaaattaaatccttcatcacagtaactcagcctccaggacagtaacatttataccattattttattctcctgggtggtctttgctgatgatgacataggaggagcctgtgccgaggcggcatccggtgacctttaccccaaaattcatctgagaagtgaacttgagcatcatataggtgtgctaccttgcaaaaatagaccaattgtttgatcactcatttatgatgtcttctcctaagcacttttttttttaaaccactattctcaaaaaatgagaaagacttagagagaggatgggaagataaggtcctcctcagtgcattatgggaaaagccattaggccacctgcacctgtggtccagagggcagtaaggccagcccatcagaaggacagtaattcagcccttggacaattgcttaacccaattgctgggtaataaacatgcttaataaaaaggaataggacgtctgcaccatcttggctataaatatgctctcttgttctgggtaacctgtgagaatacctctgagcacacttagatcacatactataaataaatccaatttcttatatcccctactgaccttttatccttaggacttctagccaaccatgttcccctgaataataggttctgcatgttcttgaaccatggaactcccttatgtggaagcaaacagccctggttctcttattgggtaaaattcaaccaagagcatccctcctctctgccccttatatttcaaacccaagaaaatgagactctctggagaggaaactcaagacagtgggcactgagtcgacattttgggagttttccccagggtggctgtcccctgcctgcccctttgctgcagggacctcagagaggcactcaccactggcatcttggaggagcagaaacctcctggcctggcttgacctctgacttcctacagaagctgcatttgcagaagttgctcctggtttctggggtgaagcttgggaggacacccttgggctctgtattccttttcagactgttgattctgtgctgcctgagctgtctctgtccatgctggctgtgtgagcctgggcttatgactgcacctctcagaaccttccttagctgtcaccaggataatgagctgtttctgagggttgatgtaagatataggagataatggacagcctgtctagcatggagtcaatatgcattgatttttagagtcagagtgactgggttcaaatctcagcgcagcctcttcaagctgtggaaacctgagcaagtcatcacctctcggaacccctgtttctgacccatacgaaaggggagcacacccctcagaaagtagtttcagcgatgggtgtatttggtaaaaggcagatgggatcatcatcgggtgaaggctatttgtgacagtaatgatcacagtcatcatcactattcatctacttggttttcctatactttctagaatatttttctctaaaagcacgtattctaaaaaacttttaaaggttttctgcttttaccttgtttttttgcaacaccaaccatgttctgtcttctgaaccagaggatgaacaaaagcccctggtccgttatgtctccaaaccgtggtgttttatatcaaaccttagttaccaccataagtcacagagccattacggggccgcactcagctgcacataaatgcacaggagaatgagaggcttaataaatattatctgatggtgatgaggatgcatgtctgatgagataggcttcatgcacttctcatcagggacaacaatgaatcttttctgttgctcttgcacatttgcattcccaactgcacattctgagaaaacaaatgtttcattttagggccatccctcctagctgcctttataccattaatgctgaatgttcgctatacaaaacagccgccctcaccccaaaccaaaacgtcttcaaaatgtctttcacacatttttgtcattatcttattgttaattgtgcataattttctaaaatacagctcataattgcttcttgtctgaatattttgctaatcaagcaagttaaccatgaatgaaaacaaacagttctctaatatatttctgcaacctgtgtctgcctcagcgtggggaaaagcaaaaaagatgtaaggtgatcctgtgaaggtatgaaaagaagaagtaagcccagccagggcaccctgtgaagctctatgctgtagacagagtctgcacgcagcactccttgccatcttgccattagtgttaaattacaagtacaaagctgcaggcatccttttatggtgtgctggagactgacagggaagcccgagggaatgcttagctaatggaggactgttgatatatcttactggactgtgtctctttcattgcattcatttttgaatctgaggaatcacagatgatcacaagccagttctcttccatacaaagttcgcaggcccaattagcgtgaggttttgcatttcccacttttgcctcgatcaaagaatgaccatcaaccacagagaggctaagagattgtccacagcaacttgaattttgaaaggacttccatctagagtatcacattagattttcacaaccctgtgatttggacagtagggcaggaatgactggaatcatggatgatggttggaaagctaggactaggaaccttgtaacctgtgctcttttatttttttgttttgttttgttttgttttgagatggagtctatctctgtcacccaggctggagtgcagtggtgtgatctcaactcactgcaacctccccctcccgggttcaagcaattctcctgcctcagcctcctgagtagctgggattacaggtgcgcgccaacatgcccggctaattttttgtatttttaggagagatgggttttcaccatgctggctaggctggtctcgaactcctgacctcatgatccacccaccttggccttccaaagtgctgggattacagtagtgagccaccgtgcttggccaacctgtgctctttttaccgtggcatatcagtcaagccagtaccaggagcaagttctaaattgtagcagaagttctcttaactgacactcatttagccagctcgccatagaagccaacctgtccctttccctgcaaacatactggctactgcacaagacccactccacgggccacactagtggacttcgcttcttctacccacaagtgcccctcactctctccagttgggatgcaggcttaacagtcatcaaatatattttgtgctggttgtagttggtatttttgcttacatcatttgctaaatattacataaatcactgaaataggagcacaaaaaaaggacaattgcttcaatgcaaactaagttgaatatatctgaaaaggcaaattcctgaaaaaaaaaaaagcctttggattaggtgtgggtgagatgactataaaggaccgagtgcaattatacaaacacaggaatattgtgtactgagattcttctgcgggtgtcaaacgtcactcctgtttttaggaaactgaaaccaggaactgtagaccaggaattataggcgtggcttatgcaaaacataagccagggaactccaatcaatagactctttaaaaaaaaaatagaataaagatggtcctggtcacataatccaaaaatcagtaaaggagtgatatttagttggtaaagtttcgtatagacataccatttctaagtgattttgccctttaatttaatttcccaattgaccacctatgggcccagtccccagtcaggtcaaagaagagggtttctgatctaggcttggcactaagctcaaactaaattgcacagttcaactctgactgtcccattggtgccaggaatctaagaccttcactgctggagcctgtctgtcagcttcaaggctaggatccccacactcaaacacagacatctggaatctggctttatttcaactcactatgcacccattattggaggcttcacctaaatgtagcccaacctgtctgagctatgcctcctccaaataaggaagtatgactgcaggtccctcatcctgtgactctacctgcccagactaatgaaatttggcacccctgggcctttctgaaacctgtgctgagtgaaatacctttacaaggccttctaagagtttaatgtaatgaaagcctctggctgaggttcaggcaacacagagacaaagcatcttcagggggagcaggtagaggagaccagacagtcccaggctcagtggtagaagagtcacccagggctactccagccccttctcagaagcacgcttgcccagcctcaccctggctggcctcacagcccctggttttcttcctggcctgggccagggtccgtggggcttggcaaaattaagcttggaggaaatggatcccttcattgctgagctcaggctctggaagaaaaacaccccagcccacaggctcagagcaggttttatttatgtgtccacttgttttacgcagctgactttactggacattattcagaccagtggttgcaagtgattgttaccaagtttgtaggaaaagcaaacctccaggaaggtgagtttcaaaatagagagtggcagatgttttcgaaaggctggccaactgcttgggaccagaccagcgataaaacttctcccagcaatcccagatgtcaataggcaaaatccaaagccaaaaaaaaaaaaaaaaaaaaaaggctccagacttctaggtgggccaccgttacttagcttggattcactaacaaggagcttcttttttctgtcttctttttatatacagaaattaatttgggcaaattggtatcacgtacacaatagaattgttatatagtattacctattgaagtctttaagcaggtgagtctatctattaaaatacagtgtgaatgatgcttacttggaagcaggttcctctgctcagttaacctcaattaggtacatactcttcttcccatggcttgtcttacaacggaacataaaatatgtagatttaaactgagaaatggctttgagttctggacttctgcttctggactgttttgggacgaactcatacagtggttttccctagcaaaggtccagtttgtgctgcagaagagacttgtatgctaataaacgggtattgacaagtgtgatagatgcagctaggtacttagtgagtgctggagagcaaagttgattgcattttacagtctgtgtatttctctgtttattgcttgtattctgtcattaagcaaacaggttcctaatatagcaaatctctctaatcagtaaagcaaggaagaaaagaaccagagcatcattaattatgactatttggctgcagactggacagtctgttgctattggattgggcaacttcccctggttttattttctggaggtagagcagaaactggcttttcttatgcgtggaggaggagagagaaatgttccatccctgctggctgacggctgcctaaaatctggagcttaaatactggcttctctacagaaatggagtcctggggcagcaaggccaggctccgggcgagtgcacttttaagtctccaattccataatcagagtgagcatgctgctcgcaagcctgacctgtccccagagcttggggagagcctgctgtgggcagaacccacgtagggactgggctgagagctataaatgatgtgtgcatctctgcgttctgcacaggaaagctgctggcaccacggcaggctttccaaatgctaatcactggggtaaaaagcaggagaggcactgctctgactccaggtaacagaggttaacagcctctaatgcatttattaaccctctggtgccagggactggcaaggtctgtccccccacaattacagtgccctgaaaattcatttatgcgacgtgcctggacttggggattaccaccagtgacacttttataatatgagagcaacagctgctggagagacaaagctttacgtgcctaaaaaacaggtttccctggttttccagaatgtagggaaggcgtttggtttggggacaggcctctctagtataattttcatcttcccgttctcaagatgaaaacctcaaggtactatatttcagtggtggtgtttcccccaacttagagtcaggcagcttcccctaaaccttatagctataaattagagttaagaaacaccctttcttaaaaaggattaaataattcatttttcaacatactgtaagaatagttcgaattgatttttcaaaaaataaaacgcatcttctcttcttcatctcttgttaaaagacatatcatgttaaaaccacaaactgtaaggcatggtgtctgcataggtaccggctggctgagctctttttcggctctctgcatttctcataatcatcagggctgtgaggctcactgaagggcccctgaacactgtgccagcccttctattattgcacccttggttttaccagttggtaactcaggaataaaaggtgcttttctagtttctaatttaccttataccttacaaagtctcaggagtttggggtttattttttccttctaattttcctgggacgtcccaatttgcagcaactgagacagcatttaaagtgtgtaagtactttttgtgatagctgaaagcgggagacgccctgcaattttatctgtttgcatttatcatacctgactagcaagacagtgatagcttgatgatgttttcagaaatgcttgggataaaagcctttaaaatgtggaaataacaggtttctcaggttccaaagtgggttttaagacgcagattttcttaagtagactctggatctgcagaggtagatttctgaccctcagtagtcacaggaagttcacactgcctacaggactcataagcatgcaactagccagaagttcacaggtctacatcccaggctctgaccctctctctgcagcatgcccactgtgagaggtcctggactcccagcctgatgatgtctgttgttgaccccatccagtctagacagccgacacactctggccctcatctcatttggtgtgagatttaaagagatctcaaacctatatgcaatcctttgattctgctaatcagactcacagagctgacagtggcccgtgccaggtttaggtggaactcctccagagcctctctgctcaacctctgctgctgtagggctttcccgagcacccagaccgctctgtaggaagcttgttaacacacaatgtaagcagtgtctttagagtcctgtgtgtggactgctaagcctctggagtgctgagtgcctctgtgggttgggaagatgtttaacgggagagaaggcattttctcagagcatcccctgtagggatctggctgcgtattcttacttggactcagcagttcttccagttatgccaatcggagtggtcccccaggcaagatgagcttgagaggtgctgcttccagctttagccaatgggactacacggagacaaggccagaaactgagcttttcctttatacagaggccaatgggatacccgctttgggggaacaagaacttggcgactgcacagacttggagctgatcgaaatgcattttcctgtgaaattgaagttatgcctgccatttccaggtagaagacaagatccttggagtttacacctgtgtgtgtctccctggttgaaagcttataaattctgaatgtagtgtgaaaccctccgtgactaatgagggtcagaaatctacctatgcaggccgagtccacttaagaaaacctgttaagatagaggccttttctagtccattgatgaaagctcctttctaatcatttaataatggtaggattatactcctgcagtatagctaatgagtgtcacagattgagtatacaatgaataaaacactgtctgctagtgctaatcatactgaacaaagtagaaaggaggccttcccagcccttggaactcttagaagctactgtggtctaggacactcaggcgcaacttggctgtgaccacgagcataggaagaacttgaggacataatgcatcccagtctagaaaccacgctgccttccctgtgcaattcagtaaatttgttagttatgcaaaggcccttagcaagggcttatgtcttttgtagattatggcctagaaaaggcagaatgtgatgttttagggccattttggtatctgggcacaattccaaacttgaacagaaataaaacatgtaaagcactacacattactctctgtaggtgacaatgcagtggaccagatttgctattaatatagattaaaagtaggcttttgaatcaggttcaattcctcttccaatttcccctctgatcttcttatacataacatttagtgacctttgaacagcccagggatgcttcacagtgtcttattcttgatgcttgtttaaaggtttctatttcatattcacagctggcatatgcaaatataggtaaagattatgatgcctcccaagtagcattatggtcaataaattactccttgggtgaacatgctatcattttagcttagcgtgtcttccaggagttgcagaagtcacaacaggcagcctgccagtgccatccacacagagctgggttgcccaggtcctccttgattcaagtgtaacgcttaaccagggctcagcccgttgacaaataagctctctgtctgtcagtgccaaacggctcctgttgctggggatgaggaaggagcattgtgggagttctttgtgtggattttggggagaaccactgtgatgcaggaggtagcacattttcatttaggaattgaagagactgggtctgcatcctgactctgtaagtaaattgttgtgtgaccttgaattagtcacttaacttctctgggctctgttttcctttgtaaagtgggagggttgtaccaggtcagttttcacacgcattttcactgtaattatttgagcaatgggacctttcctataatgaaattatcagtagaagcccagtggagggttgttccagttgaggagaaacagggagttcaatgctttcacagctcagtccccttgcaactgctcgggaagccattttcaaatggctggattgagtatctgtactgctctgtgtgattctttgaggatgcccatctgaaagggtccctgtcctgtgccttagccccggattctatgtgatcctaaacagtgactagtgagtggtttcctcactagagaggagccccaagaacccagggaccaggtccttttttgttcatcactatatacccagcattggtaaacagtaggtgctcagtaagggtttgttgactgaagcaatgaatgaacaaacaaacaagcccaggaaggtctctgtctgtatcactaataaatgcagatgtttattgcaacgtttttacctagaaggaggtacttcccaaaaattaactttaagaaatgagggattacttcaaaacgttttctttagtaacctagtcctgggctgctccttcaggagccacttggctttgaaatggggtaagtctgaattgagatgttccatgccaaacacaccagattttgaacacttagtatggataaaaagaatgtaaagtatcttattaatattgagtacgttttgaaatggtaatatattgggttaaataatatatattattaaaattaacttcacctgatatctctttattacatggctactagaaaatgttcaattatatatggagctcacagctgtgtctcacatatttatcagagagcattgccctagacagctgactgatggatcatcagtaattactcttctgtattatgtttgagcattttttttcttgtccctctccaggcacagaagctgaaatccaatgtgtcgggcaatacacacctctgtatttccaatgtaagtatgtttcttttggaggcttcgtgcatttatagaaacatagcctttgggcccctgggggcagggtatcatataaagcattcaaagacaagaaggtatccagtccacaagaaatctaagccaccctccatgaccgtctgccctttgagcaaggtgaagactttgaattccagttcacaaagttggaagtaagcatgggacctggaatctttgtccaaggattaatacaagtgttccagggccctgagcctctctgtgatcacagtcatgtaaaatcatccagcacagagacgatacatagcaaatctcactgcttaccagatgttctctatcatctgtggtgcctctgacctccacaggcccccatgggtagattagagcagatacattcctctctccagtttacaggtgaggagaccgaaaattctgctgtgtgtgggccctggtttcttgtgtaggagggtggcattatgggattaagcaggtgctggtgacagggatggaggactctatcctggggaaggacagctgtgctggctgggaatccagaagccagagttctggtttagttctcccagcaacaagcagggcaagctcttgctctctccaactcctcatctataaaatctgggattgaactggctcatgcagggagaggctgctctgcctgtctccaacgctgtcagttacctgtgcaacgtggaaccctggagagagggacaaagaatgacaggggtacctgaactcagatatcttcccccaaaatgaatttaataattcctaatggaagagcaagcagtaagcattggccagacgctttatcaaaagtatctggttctaacccaggttcatggtttcttcccataaaactacaagtcagtgaatgtaagtctcagtggtaaaatcttggtcagctttggtgagtgggtcagccagtggggagtcggggggagagagagtgtaaagtatactgtggtagaatgaagacatgcagtggatgataatgaaaccattcttccttacagggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatgatgatcatcatgatcatgatgatgatcatcatgatcatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttctttcccctcataagtagtgttcgctctgatatgaacttcacaaatacagctcatcaaaagcagactctgagaagcctcgtgctgtagcagaaagttctgcatcatgtgactgtggacaggcaggaggaaacagaacagacaagcattgtcttttgtcattgctcgaagtgcaagcgtgcatacctgtggagggaactggtggctgcttgtaaatgttctgcagcatctcttgacacacttgtcatgacacaatccagtaccttggttttcaggttatctgacaaaggcagctttgattgggacatggaggcatgggcaggttctcctttctttggaaacacatccatgctgggatgcacagttcttttcctaaggattgtgtttactcctgactgcaacgtcttggccactgtttggagcagtttggtctgaaggtcattaaggatctgcttgcatcttgtttcatgtcctccgtgacagactgcagaccatgttagaagagaaggaaggtttgtggatcaagagggttgacattaggtttggtgagatgagttgcttggcacagatcagcagaacaggaccctggtgataaggcatctggctttgctaaccacttatcatcttccattattctctttcttaactaagtagacccgaaagtgcacttttgaagtctggtttagatggcgagattccgaatctacaatgatcgagtactggtggccacttttctccaacattaagtaaagaggaggagattccaccttcagaaagtgctgggaagcattggctttcttcccacattggtagaagagatggaggaggaaaccagggtgcacatttctacagatcccctttgcctgctggtgtttgccttgtaagataagtcactggggggaaggggaaatctatgaaatccaagataaaggcatagtctttcagctctattggtgttaaaagtatatttgtgtccaaatgttaatcaacacaaatgtacagtactcagtactgacttttttcacttcaaaatgttttcaagggaaattcagcagacacccaactgtatttaattagtgaaaagatctataaagactcttactttgaataaacacattaagtaagtgtgtcaaaatatttggaatgccagttatctatgagcgcatatctcttacagagtgtattttgttttcattaaggtatctctgtgtatctacactggactaatttcatagggatctgattctatgtgatccactgtagaaagctactgattacttctgcagtaacagcagctctaattagcatcagatgaccaaagcggaaatgggagtttcagcgctaacaagggcagccttcattgaagaatgcatgggtaggcaatatataaattacattttgaaaagcctcatctgtcaccaacaaatatctcatttttcttcagtgataaaagcatattcaagttaccagctcctcaatttgaaaatcagttgctgattaaataaatagggggaagcatcttgttcagggacaacacgttagagagattcttatcaaagcaagccaagcaaggtttccgccattcagtgtgatcttagtttgacacggtgaccctaaaacaccatcatttgccccagaactggagcacaataagttaaatcatttacctgtctcacttcttcttggcgtgcttaaaagcaaaaatgattcgctacttcctgtccttcagtccgggcatttggggtgccactgaagacaggggttatctgctgaggtttgggtgtcttgcaggaagtatctcattgcagttgattttgatgaaaccaaacagtaactagggtccatgcagaccgtgactccctgattacatctagccatgccctacttatttcagagagaaagagagggggaataaaggcagtattgccacactgattagaagcacattcattccactttgatgttgaatatttttgaccgatacatgcttgagtatctttttaatagagcacatgaaggaagaagcacacaatatagagaaggaattgagaatgccaattacatatttatttttccatacctgatttttttcaagtctgtaataaaaaaagtataagttgagattaacataggttatttttcatgaagtatagcaaacgatctagaatgtgataggagtgtggtttccatttctttttttttttttttaacagacttttgtgctgtagtaagaatgtcttagaagttgtgtcttcgagttcctcaaacaccggacagggctcccccagagctgcctcagcctttgatttggtccatattcagacacttcctgtcttgcatacactctgaggatgggccgcttctagctgccgcccgtctccctcttgccttcttgtctctaaatcagacactcccaagcactccatctgctatactaggagagtgggagagccaaagcattttggagtccatgtaaagtgcctgggaaaagagatgtaagagcagtgggagtttatataattagcgaattcttttctcagaattcagcggaaatgtatttctgttgttattatttacaaaattgtggcctcagaggagctgtcttttggaaaataagttttcattcatgcagttagttagacatgcacgatgtacttgaatcaataaactgtggaccagaaaagggctgcttaaatgaattcacgtgttctaattctctttcgaggctgttgatgacctcctggattcatacccccatgatctgtcttgctcttgcctctgttctttgataaagcacatcagactatgtgacacccatcttttcaagaacgacctaaaagcaatgacaacaggcaggagagaattaccactggcctgggcacagtgacagcagaaggcccacctgagcttggagagttggcgagataaggcaaaatcaaggtgcaacagtgggccatgttccaagggtgaatggatctgagagtccgctgatgttccttactgatcagaacagggaccttctaacgaaacagccagagttccttgaatcaggcagaagttctttagagacaggaagccagagctattgataatatccgaacgacagaggaaggaatttcttattagaaattctaaaataaaacaagtggggatttggttggatacccttagaagctacatttttctctcatccctaagatagatatctcaagtgtatatctgacacctcttggctttgacacggctctgcttctcaagtgaccatttgttttaagtctgttgtctagaattctttgtgggggctggacctctgaaaaagattctcactgcagaggctttaaatctgtgtttttttccactccctccgtcctgggatgtattcggtaggacatttcatttatatcaggatattggctgattcagctctctttcatcgttattattcaggcctccctccaccaccttgttctttattgcctaagtattgccctccccaattcttcatcgtaatagctctaaatttagtttgacccaaattaatttttgttccaacagatatattttaagacagagaagcctctctcaggagccagatgatctgaagatgatgctaatccccaaatacgaagttcctccagctaactctcctctgagctccctcttcttagctttgggattggggatggtctcatccttgccaggaatccctttgttgctcccagtgtctctgatgagcttctcctccctcccagagacaatgcaggggtggttttcagcagaatgtgccacctgcacttctgattgttctgagacccagcccagaggggtggagaaggcgcacaaaccctattccaataaactgcctgcagagaaccacagcctgctaatagtcgttgaggtctcagccccctaaggtctccaagctcatttgaccagcgcagctgcgacttcggctgtctgcctctggcaggtgccaatatcagcatcttgtcccactgccatggggagttaatttttgctccagggcagctgccaagcccagcaccggcatcaatagaaggttttctctgattttcttctcttcctctcaggctaggctttcttaccaatccccaattttcttctgtagggcgccaggagactggccagagatctttagactcttacttagtttgaacatctcttgctgctcacacccaggcttcttcagcagaaagcatgacccatagtaggtactcagaaactggttgaatgaaaagccttgacatttaagggctttattctgtcatacggtagcaagaactggcctattggcatcgtattcctggcattgagctgtattgaccctgaatgtgtcctcctgaggtttttgagggtgacctaggagaaagggtctgaaaaagcactgggatccaagtgactttaaatctgcccgtggcatttcctgctgagaggcgagaaactagcatctctcccaacaggctcacatccgccaggaaggacagagcccaaaacgggggtagactttgtgggaaattcgccagttagtccgctgagattttaatctgcctcaagcacaggatgctgacaagaaaggtagaccactcccccgatcccagacaaaccccaggggtgacaacttctccatcagtatcctgagaagcaacatcaaatgcttaccaagtcagcacgtttactgagtgagtactctgacggaataaaccagcatttggagctgaacttgagaacacagggccctctgacagcagcttagggaaacacccatcccttccagattggcagaatccttccatttcatgtccttcggagacgctgtattctctttacaaatcattcatgaaactgagactcagtctcccaggggtaagtcctgggccacgtgcaaacaatggcaaatccagctcttccatgatagagaaggcaaacacacccaccttcatcctgagcctaaaaggccacctctgagcacttgggcagccactcctctgggcctcagagggccatgagcttggccaggtaggcacagcggcggggaagtcacagctgtcaggtaccggccatggtgcaggtgggaataggagatgccagagctgctttagctgaggaaagcaaacagtcagcagtgctcaaaggagcaaaacttcgaatgtgcacattgacccctgacacctgcaagcataacacagatcctaagactagagtgaagtaggaagaagaattagaaaatccagtggatgtcctgagtatagggaaccagggccgttgaaaatcagtaaaggttgattacctggggcgagaccgggtgactgtggcagtgcaggtgaaggtaccctggaccttctcagttcgctggcacataaggctccgccaataaagcgtggttctctctgtcacacacacacacacacacacacacacacacacacacacacacacacacacaatgattggagggctatatgatccagcattagcttcctggtgtgccaagcatgcttgatcgggaatttttttttattattattattttttagctgtagctgaaggcatttctcggatgtggagaggagaatggaaatcgcagaaccaaatcagtttgccctgccatatttggctgtggtctgtcattgggcatttctgatgtgcttttctggattcaggaagagctgattgtcctccgagggttgaaaaaaaaaaaacagtttcagaaacctgaatccagggccttatagttctcctcattatctatcttcttctcccttccctcgcccaagggagtgggggaaacacttttcactgcagagtttgctttaaagttttcccatcttgcgtgcattatcccttgatattaaaattattttctcagtttaatccaactcctgctgagaagctgtgtgagatttaggctgtggggtttttttcttgtactcttttggatggtgttgcatttttcactcttaacccgagggtgtgtttcagcttatgttcgttctgtttcatgcaggtttatagcacggtagagtagaaggcggcttctgatttttagggtatttttagaattcattcctgagtgaggggttcagacacccagtctcctcggaacaggggtgaggggtcgactgagctttgttgagaagcctccagttaggcttcgggcgggtctccatgttatattgtgtgtttactgagcttcccactggtagaagatgacacatttgtccatcgtcctgtgtatctgctttccagaggacaccggagcattctcctggggtcactcccacatggctgcctcacatagctgttttgcaacagcctttattgccaacacccttggaagaacatctcctgtagaagtacaagttttgcaatatggactttggaagtggttttgtgatgttcgaattttctgttagcctattgctcaagcactacagaatgtacatagtccctttggccatcctctcaccccagaatatcctaataaacattgttttctttttt

SEQ ID NO: 56 - DNA, 245874 bp, Homo sapiens
agagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggtaagtccagaacccccgtccccgaccctttaactccgcagaagaacacgcgtatccagcacagaccagcctaccctagcgcgcctcctcagcccctcacctcctactgccctagacccctaataccacccacctctatccagagaaacaaggggaactgttgcaggcccgggggtgaggggtggttctgggatgggcagaaagtgcaggtgtagcaggaaacctttgcatgcttgcgcttacattggagctgcgaggattttgagaaatattaaacgggatggttttctgggttcactgttttgaaagagcaccaatcctaggggaaacactgaaacagaagctttgtcatcattaaagaaaaaagtcttactaggatgaggaagaaataactttatgagaaagaatgagcgagaaagcaataaatcaaatggtgactgcaggggaatcgctgattcctggcaaaggtgccatgaggtcgcactggtctcccgttgaagaccaggtcacacagattctagaggagctgggtttcaatagaatttctctctctctctctctctctctctctctctctctctctctctctctatctatctatctctctctctctctcattcccttctctcctaggcggcaaaagacattggttttgcagtccagatatgcccctctctttgcttccctaagcttcaaggtagtacaggggagttgagaaaaagaacactttgcgggtctcccaggccggagtgggcatgactgaggctggtcaggctccatgtaggcgagccgagggcggaaccgacttcagtgggcgctgactcctccatttctggacaggcttctgtggagtgggtcaggcactcttcttgctcgctcgggttccttcagattctgacggcgaacgcttggcaggcttcgctctgctgaagcttcctaattaaatagggccagaggatgggagttgctgcactcctagctggcatagcatttcggtttgacagcctgtagtatactgggcagaattgtggtgtaatttccttggcattttaaactccgttaacatgcctgggtattgtcccctaggtgtggtctgttctagttttagcaagtgtgtatgtaatttttcatcttctgtgaatataattttgctgtagttaaatctggctctgaataaagtgtctttcaaagatgtatataagctgaagtgtatgtaactttagagaggagggaatgaccaactgtaactcagggtgaaagcctgtatagttcctagttattactgatgtaaatgccaaaaggaaaattattatgcatcattctaatttatcctttacaaagacaagttgagatatgcaaccctattagatttgggtcaatagattgttctcttttttggcagtttctaaatttggcattttaataaaactcaacatgtttctataacttcttgattcatgcgtacatgtgtgttgtttttgaaagaataagtttcactttgctattgcctaatcactttttagatgctttattatggtaataattatgagcctgcaaaaacaatttttggaaatgttgatggctttgtagtccaacacagactggtttgcttcattcctagcccttgcattgttttaggaaataactaacttaaatgtgaagttgacatttgcaatcaagaaattacatatttaccagatattttaaaggggactgcataaactaaagagaataaactggttttgcagataggttgtcaagaacttggcaccccgcttccacccctgttaacttagaggtgatcaatcttcatttgagccaaacagaccatcacagaaaacactgtgcctgtttatctttattattgaggctttgtttcctctttgtctggatacatttcaaataaggggttgtttcagtcgttgaagcaaaagaacaattaaagatggggaaatggtaaaagggtattcagagatcatcactagctcttttccaaaatgtggagttttgtggtcataaatattgtccacctaatgagcaaaaaataaaaataaaaaaaaaacaggaagcaaatgttaagctttcattcaccactgtcagtattaacgcaagctttaaaaaatagcactatcagaaaaggatactaaaggagaattgactagaaaagaattgtggaaaatggaaacgaatattgatcacttaactagattttgaggttatcagtagacagtgaccttgcagtacagctatagttgttggatttaaaatttaggacaagtattttaaagcttcaaagtagtgcttttttttgttaaaaatctgtaagatgttttaatgactggagtgttctctttgaatttgaggttatgatgacagagaaaatgatctcttcctctgtgacaccaacacctgtaaatttgatggggaatgtttaagaattggagacactgtgacttgcgtctgtcagttcaaggtaagaagtcttatatttgcatcttctaattcattaatgagactgcaaagcaggaatcttcctttacagcctatcacttggaaatttatagctatgcaagctaagagggaagctggcaccaagcaaaagtactagcaagagagccaactgatgtcaagaagacatacgctttttggagaaatgtatatgccaaagttataaatgctgctggaggtagaaagcttcaggttgtgcttttgggatgtcaaaggaaaattatgtttctctgacccttctagcatcactttaaaagtgaattgactggggataatagtcaaaatagggggtaagaagtgtggacttattcttttgttctttttgattggggctatcatctttttatcttattgctatctgttttaatggtcttggcctttattatccttgcaacctgactaggtttttaaggtaactccttattagtgtaacctcaacactttgttctaatttggaaatcatggaacttattaattagtgtatatcagctttttcatagataccacactcaattagaactgaatcccctaggaatccagaagagcatttagatccacaagtcattttatgaacatcaggaaatgtactttttcttgtgttaatttcttttaactaacaaagagagaaagaagttgcactactggcatgatcaaaactgggttattagtatctattaaagatagaacttttagtgtcattagtatagtcattagctaacaaatgctttccaccatgtaagttataaaacttttcctctcaaagtgttcatataatcatgcagaacttcaagtagcatggatgttgtactaatagcctatatttgcccttgagtattttaagttacttttaaaaatacttttaaaatctgacaatatgactcaaccaggaaatatgcacataaacaaaactgtatgtgagataatgaaaacttttctaagattgtaagaataaaaatgatatagaacaaataaaaacaataaactcaaatttagacctagatatctggttaataagtaatatttagaattattgatgaaatttaaatattttagatggaattcaacctcccactaagaaagagaagagaattcacatttaaataaagtttaagtggcttttagaaatgctaaaaccttcttagacattattttattctttctaagaaacataataagacaactgatatttgtaaagtgcaccacctcctggtgggtaagtagtgctctgactgtacagttttttagaccataccatagtgtcagaaacatattcttgcatatttaatatgcatgtaacgtcaacttctaaggtctgcagccacattaaacagtgccattatgtacttccaatgaactacatgagagagatagagtatgagaactccccaattcatacttacccaaatgttaactaaacaggaaaaaagcacagttggataaatcattaattaaagtcccagagaattttgtgaattttttccttctttccctttgtgatttccataaatttgtcttattttcataaccatgggtagacaaaagcaatgaactcataaaaagtatcaaatgaaccaggaaaaacattcctgaaatgtaaagccatggttctaagatttcaccaggagaaaaaaaaaaggggttgacagaactctaaagggatgaatgctacgaaatgaaaataaataattttcttattaaaggaattgttttcattttataggtgccacagaagattttggtaaaacttttatcaacaaaaatatttgtgtttttcatacattggccagtcatgtttgtcattaatttaaataatcgttaagtggaatagatgggggagtggaaacgaatgcaagtctgtgtaagaaactaaaatgtaaattgtttttttgtaatccttgtggcattttaaatgtactagtgtactactactgctattagtttgtgctttgcaatagttgtcaatctggcaagaaaaaataaacatctccctagtggaaaatgtagactttgcacataccaagaatatagagtggctgaattaagttgaaaatcaaagaaaagtataagttgcatgaagaataataaataggatattttaagctaagagtctcttgagtccatcttttcccaatacatgaatttgagtttttggtgtttgttattttagccctagtatctgataaaaagggagaggtattgaaaatctattttcctatatattatcctaaacttctgtttctttctctgctgccttttcaggtacaagcgtgcattcctttttttttttttggaatttttggagacaagggtcttgctctgccacccaggctggatagtggtgatgccctcttggctcactgcaacctccacctcctgggtcccagcaattcttgtgcctcagcctcccgagtagctgggaatacaggtgcactccatcattctcagctaatttttttgaattttagtagacacacggtttcaccacgttacccaggctggtctcaaactcctgccctcaggagatccacccgcctcggtctcccaaagtgctaggattacaggtgtgagccaccacacccagcctgcaatctatagtctttctagctgagagataaatttcaaagagaaatgggcatatatttttatacctataatgttttcaatttgccttatcactggaacactaaagtaaacattattagccttcacctctcttagacgattttaaataaactgatttctgtccttcaaacatattatctcatttatttctcacaacccggtgagataattgttttctccccccttttttaaacttttattttaggttttggggtacatgtgaaggtttattacatatgtaaacatgtgtcacgggggtttgtcgtacatatcatttcatcacccaggtattaagcccagtaattatgaggatgaaaatttggagacagtagatggacagatagatagatagatagatagatagatagatagatagatagatagatagatagatagaaaagcggggaggaaggaagggagggaggcagagagggaggaaaaaaggaagggagatgcatgcagatatttatagataaccctggtcatgcagtgatcaataaccactttataatttaaaaatatgatgaagccttatgtttttcaggtattacctaattcagatactaaatgtttttatttaataagtcgtgctttagatctacaaatgttcttattagtaaagctgcgtaacagactgcccagtacttagtgtcttaagacaatgaatatttattttgttgatgaatctgccattttggtagggcttaatcgaaacagctcacctctgctctctttggcattagctgatggtgaggggagggaattcaaaggcttggtgctataccgatctgagggttctcactcatatgtctgactgtcagctgaagaccttggttcttctccatgttgatctctttgcacgggcaagttttgtcttcctcatagcatagtggctgagtttcaaagtcaagcatccagagagaaagaaagagccaggtagaagctatatccgttaatgacctagcctgggaaggcacacagagtcatttccaccatagtcacaggcctgtccgctcttaaaatcataatttttttacatttaaggaaatataaatcacagaaaagtaaaaattacttatggaatggccaaaggattggaacatatgcagatttttttaatcttttttcccttttggaagaaaaatataccatatcccaagccattcttcttaagcctttgacaactgggaatataacagaattgacttaacatctgttgagcaccttctacatgccagactctgtggaaggtgctggcaatatataaaacataagtcatacataagcttctagatgctgaaatctcagctcaaaaaacctgtattaatcaaacaagcaataaatcccatgaaaaacttctcacataatgtttattaatttgtagcaaaaatgaatttcatgcattctagtgtgccaagtaattgaatccactagtgtggtgggtagcccattttggaacagaattcttctactgaaaaacacttatttggaaaataaacataagatttttaaaacatagaaaaatagaatcactttctcccctgagaggaagtttgtacaacacatacgtttatggacctaaccatctgaacttgagtcttgtttttcctcttaccaggcaactgtgtggtctttagcaggtcacttaacatctgagtccgtcccttcatctgaaactgagcagtatcatgaatactactaaaaactatttccaataatttggcatattttaatgcagtagttaggctatttcatgcttagggttagcctgtttcctcttgtttttctaattctagaaacaccatggcttgatgttagagttagatgataactctactagttaaaatacatatcatacaaagcaaataatttacatgtctttgtataagtgagtattacaagatatttcttgttttaaaaacatgactttgttaatttcccaaaagttccaggtaagcatttcaaatgggaaaactaggctataaacctgttaaatatttcattgttaactaatatacaaaaggtcctacaccaagacagtgaaagagataggacaacttaggactagactcccactcgtgagctttcatgatttacagcgtgcttccttctggtgttcttcatattaataagtgcaagtcttgatactaagggccaaaaacatcatgccagtaatctacagttaagctcttttcagctctgtagaaatctcccttttggcttgtgcatggaacttggcagctctgtttttagaactgttcgaatttggcttactgcatccctcagaagcggcatatgagcactttatcagtttattcgatattttaagatgcatatcagcattgtgtactagcacttgggagagataataaatactttccactctccactcccagttcactgactttatatttgagtaatctgagaaggataaataaataaaatttaaggatcggagagaagaaaacacggacccaaataatctacatacaaagtattataagcagggatggagatggagattgaaaggtagcccggggcaagaataccaggcctcaagcatgagatgttaactagtccagctagccatagacacattatgactctcttctgtctactgaaaggatcggcaagtctatcgatcattatgtcaccagctgtttccttctttcttgtctctcctccacgtgctcagacaccactgtagtgttcatagatcaacataatcctacctacattctcctgtccctggttctgatcatagcacatttatcaagcacctatccctgcacttgccttgctggccacagttctggcatgagcacaagccacatttatttgtggtctcttccgtactactcattggaaaattcaaatcttacaggcattttgctcctgccttctttcttggatggtagtggagatgctcaggcctgtggtgagtcagttttcagatgtaaattaaaacaaatttttggaaagctcctggaaaacagtgcttacacaggtatcacctaatcagaagtcagtttctgattgagttaaacattagcaaaagattagtgaaaagctctaatcaaatcagttttttaaatataatcacatacatagactgagtctgggagacaaaaatgcaactgtggaaaagaattactatatagaggacttgcagaatatctagattatatattgtagaaattaagataaagaatatttataaaatatgtgctaaagcatcctgttagtaattatggtcatcttaatatgactgtcataccatttgggtttactgtttggaaaaaagttgatcacaattaccaaaacattatatttaagttgttaataatatatgaaaaagtaaaacttatagaattaggctttcatttcaaagaacattgacatttaaatttgttatgataattaagctattattatataaaggcaaagagcaagagttaaatagttgattaggaataaggaggtttaggtattgttaggaaatagagtaaaataataaatttcaggttttaatcaatcagattatcaacatgttgagaggtgttttcttttgcatacattcttgagttgaggtttatttatgatagggttttaggtttgttatcacatatatttaaactttactacccatctcactgtattattggtttattttgtatgtattctgaactcacagcacatcaaagattcaaatatattaatcaaaagtaaaacatagagtttttaacatgcatctgtaagtatgattttccttacttagtttctggcataggtgagcatatacagataataatcttgatcattatattttttataattaaacaatgaagcacataagtagtagtaatcatgagataatcacatccctggtgtaattagcaggcatagaacaaagccaagtatcattaatgccttagagtatgattatattatgatgactataccctgttggttgccttaattttcactgtaatatgtgtacttttttaataatgaggttttttaaaaatgaacttttctctttatggaatatctattaatagacatactttggaatagtcggtaaagtttacttatagttcagtagttgttgaaatttttctctgagttccatagttttgcttctctctagaccatatccacatcaatatacaatagtctaaagaggtataaaaataagtaaatcagtatcttatctgactatttggaaatttacaaggactagaattcaataaaaattcaattaaattcaattaaaaaaacaactaagagttaattgatttctttggcattttggctatatatttccactcctagcacagatagacattacctttgttttttaatagcttgaaattaaactgtattttaattttttccatcaagtcatatgggctacatactaaaaataatattaagtagcattaatatatttattcctatatctttattgtgctacttgtccagtcactttgttgggaattgcctgatcaatttagatgcttatttttgccctatctaaatcaaatgactggttggctaacttgaaattggctttgtgcatctttcaatgatgcccttataaagacttattggacacaattagaatcattgaaaatgaagacaagtggtttcttttgtaaatgattatttctgttcatcgtgtcagagggatacaatctccagtactaactataggcttacatctgtgtgtttcccagtgcaacaatgactatgtgcctgtgtgtggctccaatggggagagctaccagaatgagtgttacctgcgacaggctgcatgcaaacagcagagtgagatacttgtggtgtcagaaggatcatgtgccacaggtatgtgtgtgatcttctttgaaaccttctgcatggattccaaatccaaaaaccatgtctttcatttcttgttatctcccaataaataattcagattatatgttgactagacaagccgtattgttttgttcaaaacatttgttattcttattctttgtcatttttacatttcaaatcacttttggaagaaagaggatatctaccataaggacactggtagatttaagtacgtatgtcattaaatgaaatacaggcaggttgaataaaagccacatataattagaaatctagatagactgccaacgtgccaaatatggagaaacctgactatgtatgaatacagttgtattgtttatttgtgtttgtttgttttgaacaatagcattatctgctggaaggcaatcttgcaggtttgggctctgaagttgacgtctaatcttagcagctctacaaaatggtcttcttactatttagtagattttattgactaatgtgtttgtaatggacataatttctagtgacatttgtcatttctgactcaattaacctgggattctacaaagttttttagtcatggcttaccaacaatgctataaaggaagtaagaagaaagagtgacttcatgtgctctgtagcttttcaaattttccttgtgtctacagtggttgttagagcttatgctttaaaatggggaatgctttaaaatggggctgagttttcaagttaagcttgatatcaaaatcacatatattgtagaggctgtaaggtgccataatagttgttcttaatggcaaataagcatctttctggaaagtcataattcctgagaatttggatgatataagcatattcaggaataataacaacgtcatcaattataaactttctctaaaaatagaagcagagaatagtgtcatgaaaagtctatttattcaaaagtccctcttagataacaggtatttctaatctagtgtatgatgttaaaagttatgtgctaagtgactggggcagggtggaaaatgagcaaagagaaaagcctcatattctttaaaagattatcttaagcatattgattgttagtaattgataatactaagttatactggtgactacccaagtttctgagaattagcagaagaaagagaatagaatcatatctcatggccaatgatgttttgttttggttttggtttgtaagtagtcttttctcctaagggattatttgctcagatgtgaatgttcttcatgaaagggtggtcaggaggcaagctgggctggtactccatttgtttatttgctaaagcaaacaggtcattgctgcttggtctgtgagtgacaagtcatgaataaaagaaacagcaatatgtgagagtcaatgggcagccttctccaataggaaaggaggaggaccagcatgctgctctcatactaaggatgggggatatagaaagtttgacaaggagcaaactaattatgaggaatcagtcagccataccaaagaaatgagaaatagtactttaggacaaattgaatagaaaaaaagtaaaatcccaggaaccaggaaggatgaaggcaaataccgtagagtattgaggaaaggatttgctttttcaagatcaagatcatggaggatatctgttcttttctaacaatagccacatgagaattgccaggcaattgttataataaacagaccagaagttacggttatggccaatgtagcaaaatctctctttcttacttgccaacctccaagttcttgtcagcgcatataatcacattctcctgattcattcaagtctttccattctagtccctgatgtgctggttatactatgaaaataaatacttagccaagtagaaaatttaatcacaatcgagtaatccatctttagctcattcacatacttagatttctacaggatttaattagtaagccagtcttgctgaatgcatcttccatggacttgtaaatctaaaaggtttttgatctgaataatgacggagagaacaaagtaattttgattaaccaggtctgactgtaaataaattggggttctgacttttgatctaaaagggattctcattcttttctttgtatatttcccatttattttttaatgctgtttgacactgaatggaagtggcaagttgtaagctctaggaataataggcagtagaagatataactttatatttattatatttcattgaacttaatttttttttgtccagagaatggactcttattgtgaaatctgctcaatggtcttaccgtcaatttaactttttgccttgtaggaaatgcattaactaggagctcagatttaggtctaacagcatgacttcttttcttaggtgtttctgtcttactaataagactttagtaggctatttatcatcagttggccaggatgacttatcatataataaaggaaaatcattaaagcctcccataatgatttcataatgatgccatggacttaagtgatcatttttctaaactattccttcttttttttcctggctgtttcatttgtgtcaaatcaaatattgtcttaaggaccatgccccttgaagttttagaaatgcatgtgggaaatacaagctaaaatgctattggcatttttttctgattttccccagtcatatgtatttattagaatactcgtagatgaataggcaagatgtttactgtacattttaattattatgttcctgacagtgcttaagcatttaatatatgctactgtgcagtaagcctcaaaatagcccaatcggttagatattactgtacccattgaatagaggaggaatatgcttagcaaggttgaataacatttctctgtcatgcaatgagtaaggtttggagtttgtaactcctaagcctttatgcatttcccattatgttcatataagtgtagagtgatgaacaacacattttccttgacttaaagaagtttataggggaaaatttaaaagaaactatatacatttaactaaaatatatttagaatgtgttatcactgtaataccacagtctgttatttagccctgaatgagtataagtaatactgaattaaactttcaaattaatgcaaatacaatcaattaaaatttttgtctgtgaaagtatacaaaaagcacccaagcactgttctgtccaaaagagatggtgttgtgacttatgacagtcagtttagttggtaggaatattctaatatcaacatgaattcatcagtctttcttggtctattatcattaaacagtcaattcttatgattaaaatccttgtttgattctacatttactaagaataatttttatcataaattattttaccaattaacttgcctttaaggaaaagatatgctgatccaaagacatatgtcctgtcacattaatagttaattgattacttgacattctaatataatagtattagaccctataaatttagttaatgtgggcctccaacaagactgacagttcaaactactgctccttcatggtactgctaatgccaatacatgacaaacaggagggctgctgggaaggccttccttcttccatatttgtcagccttctgtggattttcaaacaccatgcctctttctatgtggtgtttctcaataaagtatcatggaagcaaacaagtaaaagtcatgttttattttaattggaccgtaaattcttaagagtggcatttggtataagtcttgaaccctgggtgagatttcactgtggaataagggcacatcaggcagagaatatcaatattaatcttatttccctgtattaacattaaaatacataaccaaatgtattgtgaacaaacaaaaatggaaagtcagaaggaagatgatgtctacacttaagaagcagaagcagatggaatcgtaatggttttgatttcaacttgaaattttgtgtgtttctgggaactaccttcccagaaatagacaactttgaccaattgtaattaaaggaaggaaggggagagaagaagtggtgaaagaaaaatccagaagaggaagtatgattttttctgcaagaatcatttagtgaatatctgactttaagcacaaaggcaaaaattaagctgtcttctactgacttcaaaaacaaaggatgatttgacacagatggaatcatccacaattgtggtattcgtaaaacatatcaacacccatataaaatatatttctttttaaactgcttttctctttgttcatatgcaatttgcaagaatacaagccttaattatgggtttatttgccacacgcattagactatttaatttctgaaacttactgattgttacaagcatctcatttttaatactttattttgctaatggcaccaaatccagcctgtcaagattaggaatttttcatagccgagattaggaaattttccaaacggggcaataatgttttcgtaaagctctggaataaaaatgatggataatttattatagaagttacattaatagatattaaattaaattgatgtgaatgtacgtttttggattaaatattagtatttttctcaaacaatattattgcagtattaaactaagaaaataaacttgagcttaaaaagtcataaatatttttgaatatgttttactagcaaatataacttttccccccacagatgcaggatcaggatctggagatggaggtaggagttgcctttttacatatttgaagatttactggtggatattattatgtatatttacttatgtatgttccatttcagatatttaagacaaatttcatattttgcattttaggaaaggtgaaaccataaaaaattgtcaccatattaagtacatgtatataccgtgcaaattatttggcatacttatgaatcatactctatctccagttaaccttccttgttcatttgtttgtttgtttgtttgtaagttatctttgatatggataggcataatgtaaaaacttctgaagagaagcatgtaagcatatttggcagggaagaaagaattcatgaggaaatcatttaaatattggatttttaaatatatgacactgctctcaattactaggtgctaataagacatacataacctaccatatagccaaggttttaattatcagatttataatttgaaactgaaggaactttagttcataaaagtgaaaaagataaaatgaagtccaatgaaagtaaaatattatctttgcttccttgattaaatctatagttatttttactaaagtatgatatatgttcccattatttagttttgtttagggaagtatataagatgagagagagagagagagaaactttaaaagtttgatctaatgtacttactaccaaataaagattttacctatagattgaaactaaattgtaaatgtcccaaatacttttcccgatgaaattcaaacaaaattagacttttatacacacaaagcaaaacaaaacacaacctatatataatttcaagattaagaaaaacaaaacaaataaaagcattctctcaagaccttgcttcagttgtgtaaaataattaaatgtgctattccaagttgattttagtttttaaatacagaatttgataaaagataagtaaaagaaggccttgggttcagggtggcagatatttagtgcaccctttatctagttcaggaaacacttgaaagatttatcaagtttccttatgtaatgaaagacttaactagttcaaataagcaatacccacagaacataattagagcagcatattggagcacaatttttttttcataaagactaaaactgaacagcagcagattgaaacacaatttttttcctaaagactaaaactgaacagcagtcaagactcaagcatagaatatgtttcaatgtcccatgatgttggacagtcctttgatgtctggacagtctttctctacttctaataaaagttttcctagctgattaatatagtattcccaagaaagcgtccctagaggttttgaaaataagaccttagaatagcatattaaatcttaaagaaaaaaaaaagacaggaaaaaaggcagttcctttagtagatgttttaccatgggaatattattaataagaaatcaattaattttttaaaatgttgcttttgtaaggaaacagtttctatgcaaaattctgtatattttctagctgtttagttttatatgtagactacctaattttgcaaatattgtgctgagactgaactgttccactgtttacccaccagtcttgttaattttctagcatctttaaagacaaaataaaacataccaagaatgtcttcatttctctttctgttaaagcatcatcatttacttttttctgcttgactatcctaccatactgtacttcatatctttatttttctaacaataagatgtgaactttgtttcacatactagtttctagttttcattcattgttattagcacatgcaaatggaaatgaagtcaaactcactcttccctgttgcgttttatattaaaatctttggttcattatgttgtcttgtgatctgaataagacattttttcaggaaataattttaatctcatgaatatgacatgtataacttataccatataagtgaaacatcacttggaaaacactttattttctttctctttttctgttttttaatcactcttcctttcagttagaggtgcttcatagtaacttggagaaaacaaaaacaacttccgatgtttgctttagaaaaaaaaagcatataacacatttaattctgagcttattcttttaaataactgcagttctgaaaattgtggtgatgagtatttgctcctaattgcatacaatttttaaaattagagactgatcaggtttttctcaacagaactgcttgtttttctagtctacatgttactttggtctgtaagactattagttttaattttctttaaattctttattgagggatgccaaaaatgcttagtaactaaaacctaaaaacctagtttagaataacttgcacaaattcagttcacatatccattgggttgtaatcgtaagatatatttgacttgctatctctcttatacagatgatagactttcctctgtatttttgtagaattcgtattaccaaggttttgagagggcagaatcagcttccttcatttttgaataaagcaaaagtgattgaataacttgtgattgtttggctaatccaacaattgtaactagtgattgttctaactaatctctatataacatattctcagtaatgtgtatttaattaataattgggtttacttggcaagcactttggatggttaatagttattttctaatttcttattttaacaaaagttaatataattccaaaatggagtacactgaacaaaagagtgaagggaacaaatttacttgtaaaacatttatcatgtgtgactatcataaatgatatcattaaacttacaaatctaaaatcatgtaaaaatatatcaaatattactttttaaaaattttcctatattttagcgtgaatgaatattacattagtaatgaaaattagacctgattattctaaaaataatttaagcttaacccatttgcacaagggtatgtctgtcatttactgcatttgagagaacatttttactgcaatataaaagggacataaaggttttataaaatttattttaacttgttattgtacattttatagggagttctaaaatcttcaaccattgacctatttattcagctgaaacaattcaaacagttaactgtattgagataaaacacatttactgtgcttccaacatgacccacaaagatgcattctctcctaaaggaaatttgtagagtaataagatacaaatacttcatacaaatcttaatgtttggctgtcgcatttcgctgactgtatcctcttcttttagtgtttaagaaaactcattaatacaaaagataattttgtattattagttttgaacataggacccgccatttatggaactctgttttcgaacaaaaacgtttgttttgaaaggcatctacatcaaataaacttgttggatagattcacacctgacaaaaaaaaattcaagataaactacaactgtgaattgtgctatagggaggtaatatgtggtccaaattccaaagaatttgagaaagtgatagaaagaaaacgattggtgtttcaggtacttatatatggaagtttaatgttgtaaataagaaaacgggtgtgtgtaggagggataataacctcttatccacccacagacttccttaagcaacaaatactgcaggaagaaaaagtattaaaggtgcctcctctcaaaattcagaggtgtgtgggtggttaaagaataatttttaacccctgcttttctctataagtctttcagtcatattataaagacaatgctatgaatatctccattactgttttttttaaatatttatgtattgcttagatctttgttagattctgaaaaataaataagtctggtgaaattaaaaccatattttaactatcaaaataattataaatgtattatcctgctgtacatgagcagaatccacagttaaattttaatatcatcttatgggaagttgtatgataatgtttatagaaataaaatgtatctaagatacacagcatagatacaataagtatatttttatttcatgagataaaaggaagcacggaacttacttatacaatttatatatttatatacaattttaagataattctttaataggttattgttggatatgtagaagtcaaattaaatttatgtttatttgtataaaaaagccttatttttatgtgaattatccagataattgttgttatgataaatttggtgtagaaaatcagttgacatatggtttttatttaatgaaaaaattccagtacaaattattttcatataacattaccaaagatgtccataattaagacatttgcttcatatacatattggatagaacaagaaaggtttacatggcaacacattgtagatcttgggctgctatttctgattatgtgaactgctaaaaactggcaaaaatattttaagcactttgaaacatggagataattttaaaaaaatccttgtctttctaatgtggattttataatatttagtaatttggttgacttgaaggaaggtagtactataacctaggtatttttgcaagatttctggggctgtaaagatgaatatgacacagttctttacactcatggagattacatgtaaattctcttctgagcacacaatggaaaaaattatgattctaattatgaaaagaaaattattcctctgaagaaataaaatgttaaatatactgtaaataacaaggaattgaatatttattccataaaatatgcttgtaaaaggctaagtaattttcccttccatgttgctgtactaattccctctccaaccagcataccttttccacttctccactatcatggtcaaagtctggcaaacacaacatacctcatcatggttgtatgttttgttccccccaccaagcgcttgggctcacattacagccaaagtctgacaggtgtcaattgtaagcaacttctgctgaaatactgatttaataaagaaattctaccaagcatgacacgtctgaaattcttcccaggcaatatatatgggaagaaagcagaaactatcctctttttgctctgccacacctgagagctgctgttctgctggagatgagcgtatagccatctgaacttcaattgaaatcttatctcagctcttcttaggttgaaatccatcttactttctctttacctaaaagaagaacagtatagcaatggagtaatgaaatagagatagaatgaatgaggaccatgtaatggataacaaaattggaaaaatatagaaagcaaacagaaggaggaaaataaagtgagaatgatggaaaatgaaaagggaggagaaagggacctttgttatcagcatggctatagtttgttttcacacatgaatacgtttttacaaataaaaataactttttttttcttccagtagagcagtaatagctctctgaatttctgcacattgcttaagaatgtgaaatagatgctacaaacttttgtctgaatcatccatatgggtttttaaaaactatatataggaaaagaaagttaatcattgtgtgtagtatgatagaaatggctttggattatgaatcaggagatttgccttctagatttttagctgacttgaagaatgcctgtttgatttttgctctcagtttcctgggagattcacttattttgtcagtgaaacagtaatatgtatctataggaaagatgattaaaattaagtaatgcaaataactttgaactccaaaaaattcaaaatgaaattaaaagaatttatgttacctttgctctttattcccatatactataagaatataatttctccgaagggtttaattagaattttgaatcttttaattagtgattttaagtccatggcttaaagtattgatggtgggatagtaataactctaagaatccaatacagtttctagtatttagaagacacagctagctctgactcctgaaagcaagtggaatcactgtgttaatacacataatagaagataaatgcatccagaggaaatgcagttacacaagataggtaagaaataaggaataatgtttaaaatttcaaaacagtacataattattcttaaaactacagtggcaggcatattgcctttatagaaaaccaataaagaagaagtaggagggagtcacaatgtaggagattctgtatacttacaagaaagaatgtttgtgagggcactaagcattgcaaaatttttcttaggggattaaactttttagaaagagattctttcaaaattgatgggaagattttattacaattctgcttgatgtcaaaatatgaactagctaaatctataagaatccctatgttcatgtataatgatttataaaatgctgtatagtttatagaaagcactattatagcatttattttagtttttaatttttatgaacacataatagttgtacatatttgtaagtacatataatgtttagatataagcatgcaatgtatcatgataagatcagggtaattggggtatccatcaccttatgcatttattatttcttcatgttaggaacattcctattgtattcttttagttgttttgaaatatacaataagtcattgttaactatagtcatcttgttgtgctaccaaacactagatcttattccttctatttaactgtatttttgaacccattagctatcctgtctttatcccacccttttaaaccacagcaacagcttttggatgtgtagatgaagatcagaaagaatgagcactttatgcagtaaatatggtgactaagccagtccttgaacttcaagaaggaaggaaactagtctgcaagattgccctacctcttgtacttctttgcaacaactataccagacatcatcttctatggtttatataaatcatcaattctaccagcagtccgatgacattctattattacatctcctcatccccttcccactttaacttttgattctgaaatcatctgttctactcaatgtaattatctaagttaatcacacacctcagtccatgggacttaatgattgccaactattctattacttttcccctttgtttatctaaccctaatcccattcctgatcttctgtaagtattcactctaaggtatttgagatactttaaatcattgctaaaaatatatataggatagttgtgtaagtagcagtagaaggtagtggtacaaagcacatattctagagctctagactctggatatgatcctggctcaccacttactagccaggctactggccagtacttactgtagctgctgatcctggacaggctacttagactctatgtttttcatttctttacttgtgaccctggcatggtatgcaggaaagtactctaaagttgagatttgtgcacatgaaacttagggatttgtgctctcaggatcagaatctgcagaagggaagaaagtaagattgggaagagggtgaatttgaattggtgcagttaaaaaaaaaaagctacacagcgtggcccatatgagttctcaagatgggatggcctttatgagttgtcatcaattggaaaagcagggctgagcttttataccccaccattaatcaccatagatgtgagcagttcccaaaagggagcataccgtgggccaggcagctctcttcagctgcagactggacctggagagggactcaactgtaagctatctgagtgaaatactctaagtagctgaggagggaagaaggtggacattgcaccatggtatccactaagatctgtaaaatataaaacaacaacaaaataacagaattcttaaccttgtagaacttatttcttggaaagagacatgagcagtaaacaaaaaaggaaaaacacagattgtcatatggtaatgagtgtgatgcagcaagaggaaagtgatagaagggaaacgagaggttactaatttggggtgatcaggaatgccttggagaaggatcaggagggaatgaaggggcaaatcctgcagatgagggagagaaggacattgcaggcaaagggaactgcaaatgagaaaactctgaagcagatgcatgtctgggatattccaagaacatcaaggatgttagttgggctaaaatgagtgagaagatgcttggttgaagatgtggaaaaagagtgggagtgaccctcaaggccagaaacagaaagttctttttctgggtgagcagggagccattggaagggtctgaaggagaggagaatgttgtaatctgactggtgattttagaagatcactctggctgctgtgttgagaacatgccttgctgaagtaagagagtaagggagaaagcagggagacctgtgcaattaaaaggaaaaaaaagataaagtttcttttctcttgttgtcattgatttggggatcacagtatctcttgtctattttagacattcactctgctactcatctgagggactttgtgtatggtcctttattgagtatattgagaaaatatcctaggttttgctgtagtcaaatctatttttaatcctcataaggtatttttatattggggttttatttaagatatccttcttctttttgaaatttttaattccagatagtatttaaggcataggaatgtctctgcatgctgcagtgcatgccaaattgcattgaatttgtttcaaatttggatttgaaaatacagctttttctttcaatgtactaaatgaacaatacatattataggatatgattttcaatgtgtacttaacaaagagcaatttcattttctctggtaaattacacactcacttgttacagctttgggattttaaaaaatccaggaataaatagaaaacaatatgtttaaataatgttggcatcctggctcaatgagtcaaaccaaaagaattattccagtgcctgtcacttagtaaactagttctgaaaaatcttttaattttgtgttccttgctgatctctctctgaaaagaataaagggagaattaactggatttcaaataatgttggcctggtgcttccacaaacctattctgcagattggttatttaaactgcattcattccaaattaaataatatttcctataaagttgaactttttctctattttcttctaattttccagctgcattcttactcgtttctcctgtaatttgtctgactggattgctattctgtcgttaccttcttttggtgaaggccacaaacacaaggaacatattagtggaatcagttggagagggaacccatttctataattgcatctacaaaaaaaaatggtgtactctgcatatatttggtcctggcaacattgagaagtttgcatgttcttgtgggcattgagatggtgtgaaagtcattacagatatgctgactatcctctccagagaacatagcacttgcagaaaaatatgacctttggcaagtagaatttctgacacactgatttaagtggtagtggtggcaactcgttgaaaggacatgtggagctatacagtgtcatcttttctggcccctttgagcctcgtgatatagtttgagatctaatccttaagggttagagagttttacagtgttgagaattttattcagttactcaaaagacaactgtaatagcaacttcaatgtggttatctttaaaatagctgttattttaaaatataattaaagagaaacacagctggcagtttaaaggaaaaaaaggaattagtagtacagttaaatagtgcatcttaaatagtggggtgatattaaatggttatattctggaagctcatgcccacactgcctttgaagttcaggctgcccagccacattcaggcattgattcaggaaactcccttggcctttcagtaagagagagctcccttatgccagaactgctttgaaatagaatgtggcagagctgtaaagtgggtccaattctacaagtcagcacactctgtggattttccattgtgaatagttctcagatctatatcttcagaccctccaccaatagtatatttcagcccttaggtatctctcatctatagcattggaaaaaagcctcctaacaggcctccccaattccatacttgcctacgtaaaatatttcttacttgcacagtcagaatatttacatagaatacttatctaagtatataattcccctacttgcaattcagcaatggctgtccatcatccttaggataaaaattagtcttcccaacaggagatacaaagaccaccagaactggttcagttcctggctctccattcacatcattcattttctctacctcagacttgacactccagtataactttttgttgatagtagttcagtgggatagaccatcaattgattgcatacctccatgctttgctaatgttcttctatttatccaaaacccttcccatgtttttgcttaaacatcattcatattccaagactaaagtcaatgaaaatctacatcaggatgattgtcctcaatcttctggttggactacatgtctctcatcaattatactttgtatcatcagtctgattcattcaaatagtctgtgtattatatgtgcctcaggctaatgactattaatacctgtatattagaaaagaaagcctggtgcttagtagaattttgttaaatatttgctcagctgaaccaatgcattaatactaacaacaaaaagtgtgcttaattcaggtgtgatggcatgtgcttatagtcccagctaccgaggaggctgaggtgggaggatcgcttgaggccaggagttagaggcagcagtatgttatgatagtggctataaatagcaaccgtactctagcctgggcaatgtaacaagaccccatctccaaataaaaccaaaaatttaaacaaaaaaataaaatttaaaaagaaagtgtgcttaaatttctaaatgtttccactcacattcgcatgctgccatttaaattatttgaaattctaaattaaaagctggatatgaatggttttgtgtactaaaataactgtagaagtattttaacttcataaaagatgactgaaaaccagcaacaacaataaaaaaataatggcatgccaggaggagcctagcaaaaatggtttgcaagcttagcctgagagtcatctaataccagtatatgaacttgtgatctacctcattctccaaaagtagtgtgcagaaagaaaagaattgaagatattttaggattctagctagtttgtttgtaattgaggtaattttcacctatatgaatactctattccacatccaaattacttattcaaatcccaaatgactttggccagagaatgtattatttggaattccatttgatgccttcatttaatttgacattgaaccagttgtggggggtgggtggcaggggactgtctttttggaatattcaaggagttataatgatagtaaatttatgataaagttcataaaatttactttaaccatcaaagcatattacttggaaaataaaatgctagatattaattcctcatatctagaaagtctcttacttttgtgagcaaagagaatagaattctttgagcatttgacttttgaaatactcaaagatatatggagagaaaaatggagcctccatctgatgccatggggattctagatcaaatgattttagagtaagtcacatcactgtcagcagactgaaagtaaagactcaaccaacaacgtttcatagaattgtgtctggcgtgtgctatgtgcttgttaaatacttgttaaattaagggatgaatgaatgaactgtcagggaagtgatgtgaactgctaggaatacaattagttgatgcatgcatcaacacggaagccactcttctacttcccagtaattgctaactatgaccctcaacttactgagagtgggcataggaaatgccataatacacatcatctctgaagaaacctgcaaagtgattctgtttcatccattaacttcaagccagatctcctacccctgtcctcatgctcttttatctcatctgtttgcttcacacatgaaacttcagcaatgtagtaatgctctgatcgaatataaaatgtaagtgtagaggataaaaaggagaacttggaaaaagaaggtaaaagaacaaactagtgaagagaaaaggacttttctatgcaaaataacagaaggagaaaggagaaagcagtgatgttcagcattttgtagaaaagttttaatgtttaagtaagggaaaaaaagatggaattttaaatagctgcaggcgtgggtaggctgtattagttttatacattctcttaacatttcagtattaacatatacaatatttactaagtttatgcatttctccctttgattgtttctatacgcccaacacatgttttcagaagaaaataaagaaaaatgtgttccaggcagagattttttttcctaactccaccaccacatgcatatttctcacccatctaaaatagcatttaatgctgccattagatattttattaggaaaaataggtttcgttcttgccagataagacaaaggttgaaatcaatgcttcattctgctgactaggagaattagacagccttcttctactccggtacttttaaaaatgtgttctgtgggacttgaatgcctcaagatgctattctgaaaagagtatccatttaagtgaggttgataaaagcaacatattttgatgccttttcaagagccatatataaggtgaccaaccagtgccagtttgcccaggatttttctgattttagcactgaaaagcttgtatcccaggaaactcttcagttctaaaaaactgttctaaaaaattcatatatatcttgaagtaagaaatatgctaaattttgtttgaaacgtgttttttaaaagaatacctgacaatgaaacattttttcttaagcaataatattaaaattcaaagggattagtcatctatgatacacactttgggaaactctgccctaatcccatccatttttctcctggcccctggagtctctccattttgttgccccgttttgcagggcatgtggagcctgaggaatggtctagtattgtaactgcttgagtttcctcctgagccttagactagaggtacttaaagccttaagcctgaaatttaaaataatttacatattgaaaatatttttatcactttgaaatatttctcctttctcaatatcttttacaaatatgtacctgtcttaatgcaaatcttttgggaatttctacaggaatgtaatacattgtaagaaaaatccctaaaaagtctatattccattttccattacataattctggatgagtctttgtatattttgggaagtatgtgtacatttcaaagaagaaagtcataaagagttttgaggctgccatggtatggcaacataggcattccgataactctcttctgagccctctctgtaagaacaattcccatacctgaggggaggtagaagaacaagacaaggagtaagaagcataaaacggaagacaaacaatgtcaatgcttggaaagggagaaaaattcaaattcacagccacttagtttcacttatttttcttttcaaataaccaacagttaaaagtttcatctggctcaacacacctatactcccactgcgtcacgaactagaaacaggtgccttttccttcacctgcaaacagtcataaaaggcaagcccatttcagtgaacacccgaggactgggcaaatgaatgtatgaaaggggatctactacactgaataatgtttcaaaaactgtatttgtttcaactaattctgaattttttctaaattcagagatatttgtctaacttcctctaagtagttttcacctctaaatatctgagaattaaaaagtatgatttctgacatttctagcacacagtatctactgctaatgctgagggagcattctttttgacaaagtctctaatttttttttttttttacctcggagacaagactatgcaaaagaaaaatgcagtagttgcctactgttccctggggttattggagaggaaagggagtggatgggaaagtacttcaaatagtatattacttttaggtatgctgctttcaaagggggtaattatagaaacactgacaaagacacatcactgttgttttacaaattttatgtgtgtgtgtatttgtatgactcacaaaagttcatacagcttatcttctcccataattgataagcccagtataacactctagagactaaactatcttgttttaatatacttataatgagtacgtactatgtgtcaggcattttatagccatatgttaagtacttgctgtaactcttcaagaaagacatatcacctccatttctgggtgaagaaaataagagacacagatattaagttatttatgcaacatcaggtagtgttagtggcaaagccaggatttacacccaggctcctggacctccaaagtttcccttttctccactgtctttatgtgtagtctgttattttttaaagtcaaggatttataacagaaaattataaactttcatattaaaatatgttaaatatgttattttggttaaaagtaaggtgtttctattaaggagaaatacggcactagtcatagaaacatctgtgctatttgttttgtgtgatgtgtctttggcttgctagtctcctgcacatgcaagtatgtgtgcacaggtacacacacacacacacacacacacacacacagtttttattcagagtattcattctgctagtatgtattaataacttttatatattgctatatttgtactctgagcattgataacatagcataatattattatactctgtgccaaccatattttagatgctagagatacagataaagtcccaattcacaggaagcttaattcagaagagaaaaaacagacatgaaccatgcaaataaataagcaaaaacatttcagagtgtggttactttttttttttttttttgagacgaagtctcgctatgtcaccaggctggagtgcggtggcatgatcttggctcactgcaacctccacctcccatgttcaagcgattctcctgcctcagcctcctgagtagctgggattgcaggcacataccaccacgcccagctaatttttgtatttttagtagagacggggtttcactatgttggccaggatggtcttgatctcctgacctcgtgatccacctgcctcagcctcccaaagtgctgggattacaggcatgagccaccgcgcctggcctgtaattacttttaagaaagtaaaacagtgatgttatgcaaagttactaggttttgtggtaagagtgagattttcactgaagccttaagtagtagaaagaacaaggtacacaaagatcagaggcagggcattcggagcaaagggaagagcacaggccaatgccctaagggatgccttagtgaaatccagaaatagaaggaaggtaagtgcagcccgagcatagtgaatgagcaggaaagtggtagaagaggagagtagggaagtggtaaggaatttggaatttattcattgcatcatggaaagcctttggaagacagtaatataatccggtttatattttcaaaagattgctctggcatctgtgtggagaatgaattgtagatgaggcaagagtaggtgcaaagaaagcaataaaaagattattatagtggagcaggcaaagaggatcctgacctgaataatatggtggcaacaaaggtggtgagaaggtgacagatgtcctgggggccatgtctatcctcattatttcccattcctttctatattgttattggtgtgaacaaaaatgttacatgccaacgcaaagaaggatatggaaaagggaagaaaaagaaataaccccatcacgtcatttagcactcgccaagttctccatgcccatttaacataaatgaatgtgtaggtttacttttaagacatgaaaatgtgtcataaaaagcattattttaaaaaccaaagcccatgcattgagcctactatattcatctaaagtaattttctcagactttcaagagagaaacagattgatgtacttttggggttgttaactagtggcttttcaataaagcctgagtatattgatgattttgtttttcacttaccttttaaaatttatacaatttaagtaccatcactggtatggcagtaaaaaataaaatataaaaatagacagctccataatttggcctttaaatggcttcacatatttatattctatgtaggatatgtaacagattgtgacaacagaatcagatataatcaaattgcagccttacaaatatagcaaatatcatgaaacagctcccttctgctgactcaaagagtgggagtttcatttctttcattatattttttctgtaacagcttatcactagcaacacctttggagcatttctccttctttgtcaatgtaaatgtccacacaatagcgctttacctatatttgccatcaattttctcacattggattttctactctggagacaactaatttgagtaactggaaatataaagcctatggcttccaccttcagtttcccagttcacagagcaatatagaaagtcacttccagatgcagaaagcccaaggcccacccatagactttgttcagcctccgtggtgctccttagcttatttctctaaagcctgcagattttcatatgtggtatttggggaaaatcttattatcaatatataagcatcactacaattaagctctgcttgttgtgatgtctgaatatcaataaggactccagttcatcctgagagtgacagccatttaattcactctgcctgtctaatcttgggcaaggatttaaaagatgctgtcaaatatttgtaaacatgtcgtgcatttttctttcacagagattcttttaaagtgagaagagttattttctgttttgtcttggattattgtttggtttttaaaagctcatttagcttttcctcttctttaatagtaaattgcaattttttttccccctaagactcacaggagctatccttcactgtattcatgaagtgggagtagtgctgtaccagtagggggcgctcatatcatacctattttgtgggttggcgaaaagtaaattttgtaggtttgtgtagttaagggtggagctattttaactctaaagccaacaaagattatgagttggaatagaagttatttccccctgttgaaaagttaaactttgctaaagttgtaaatcttcactatggtacgagtttaagtggcttttggttaatgaaactgcatgctgtggttgatgttttcagatagcttaatgtggagaatttaaaacatattaaaagacttttttcctgataggtattatcaaattttttaatccataaataacagacacagcacactcacccctgattttaaggggtttctcatatttgtttcatggctgtaatttcatgtaaacatggctgatggtgatgtgagtagcaatggacatagagttcaacttgtttttctggtaagtgtctcctaagtaagtttactttggggtcatttgccttcttcattacattggcatcaagtgtagtcccaaaggcatcaagatcatgattagctaactttcaccaacatcagtaaggaagcagcctgaggcatccttctattcctttttcttcttcaaggttgttatgtttgtcctttgagttgtcagcacccttcaaaacgctctctgtaattttagaacctttaatatggtgaacatcaagcatctcatcatgccaaatgtaattttccacacccccagcatttaatgtgttcacaggaaatgaaaaaagaatcacacttcctctctttgcttgttccttatgctttatcgaacaccattttaatgccaggcacagagtgagagaccagagattaaaaaataaaagatgaacagggcttatcactgcccacaacaaactcatgatctaggcaacacattattttgtgtactggggaaaggatggctccaaagcctgttttctttaacagaagaaaaggacacagttgtctccagactggtccacatgtttaactttcacatcgttcctgactcaagcaagttgactaattgcttacactatacatcccaaaattgaaagtctttaaatttggaagtgcattatgcctgcctttagatggacatggcttatggattcacttatgtcatacaattttcttgcaaactactatgctgtttcaggccggtgaggtggctcatgcctgtaatcccaacactttgggaggccgaggagggcagaccacttgaagtcaggagttcaagaccagcctggccaacatggtgaaaccctgctaatgaaaacacaaaaattagctctgcatggtggtgggtgcctgtaatcccagctactagggagaatcgcttgaacacggaaggcggaggttgcactgagccaagatcacgccactgtactccagcctgggtgacagagcaagaccctgtctcaaaaaaataaaaataaattaatatgctgtttcataggttgaatctgcttggacgctggtatgcaaacgggagggggcaaggggagaggaataggagatgacatgggaagatgagactgggagacggtaaagtgtccccacttccttagggtgagctccacaactgtctagcaattctctagcaataaaatggctgtcctaagattgataagcctttagcgtggcagagtgatgactctagactctcggatttaaagatctctttacttcacacaaggtctctttttctcctctctttcctctacataaactttcttctctgtcagcattactgctgcctattgcatccagtttactataatgcataattaccatgccatcattgctgctgcaaatgcctttttctctgttctttctgcacatccttttccatttatcttatatttcctgttttggaaatgtaagatacatctatatacatcatggtgcctttgtaatgttaaatgtatttttttctaaagaaggtcccctaaattgcaaaagctcaggctccacagagacttagatcagtctctccccatgggttttaatattcaaatctttggctcaccttccagttgccttgttgtttttgttgctgctgctgcttttgtgttatgattctgtaggtaaattgtttgtagggcttgttcttttcttaatgaatatttttaatatctttttttctcccaggcagtttcttagtccagagttgtgccagaagccaaattttctaatagagcttaatggattcttcgacaattcttgtaaaatatggtatcttaaacatctatcactaaagtggatattacagtacagatattgcaaaaatgtgtttaacagggtacatagaatttctgccaaaccaaatgttgatacacagtattaataggactcacccagcaacttatatttcagccttcacattgactttgataccaaattctttttgaaatctattgagtactctctcaatttcacccaacttggcctcccctccccaaacacacatatttgctccacctaagaggcctaagtctctcaaaattttagaaggcagtcaaacaagatgccctttttccaggcagtaatatcacaatagaaaacatcttctgaatactaaacctctggcagcaatagagtctattcatttcgttgccaaaggaaatggtaacccagtaattatcactggccctattacttcttctcattagcccttgtctcacacaaagcagaagttcaagttcttggttcagactttgagatttccaaagaactggtttggcaaatgacttttatttcttgatcaacattttgtgtatcaggcccctattcaggttctgcaactagagaagtgaacagacaatatttgtgctagcatggcaataagttttgctgaagcagggcaatgaggtgggaaatattaagggatggaagaagactgtttaattatctagaacacttccttgaaatagattaacaagctttcaataccaagcagttagggtaagccattgctcaaagggactactatgacagttttttgtattaccaaattttattagatgttaagtccatacagaggttgaactatatacaatggcagtaaactgaatatgaagtcattaaaaattaagtttcatgctattcttttgggtgtcatgacagtagcaaaactagcgcattcagttcccagaatcacagcttcatcataaagatgagtcatgttgaactaaagggactatattttaatgagccaatctggttactgtagctcatctatgctcagcagcagactgcctggggaacaggagacaatctatttgtcaaatgaagaattagtccctgatgctatccttcggccttgatccccccctcaacactctcctctctgttccttcttgtataaagtcttgccttgggggtttcccttaactacaaataacggtagcataaaacaatctgcattgtgcctgcgattccccatttagcatttgttgacaaataagagtcatcaaatatttattatttatctacaatgcttttagcactgtggggttacaaaataatctttatagaataatctcttggccttgaggaggagtttctagtcctttgagagagtgaaaacctccatacatggaacttcagatcagaaggtatggtctgtagtcattcagaaaaaaatgatcgctcgaccctatgttaggtagtcaatagggagaaccttagaaaggagttgggacatgagttaaacattaaagaatagtttaggtgttgaataatttggcatttttatcattttccgatttgctctctttttaaattcatgtactaaagatttcctattgacaagcatacgatgcacaattatttttattcctgatttcagtggatcattctgtgagttgctgtggttgtttttctagctttaggagaggattaataccttgaatccttacttgtaagtctcaccagcactagaggttttaaagtgtggagtaataacatctaatgtaagggaactagagtggagacaaaaacataggggaaatgctaattttcagtagtcagtgtaaccatgggtaatttttacatgggtttgtgatattctgatgtaaatgctttaaagtagattttgaatatattattttctactgaatatcgcatagtgttattttaaaatttattaggaaataccaactctgtgccaagtaatgaacattactgatggctaaaatgcttggctagcatcagatctgtctagctttattaaaaataataaatctagatttacaaagttcttgacacacaatatatcagagatataatctcaaaaatgtatatccaaataagttctgtcctttaaatttggtcctctatgaaatgataatcatatctgaacagtaataccatcattccatagattttttaagtctgtgtttcagtctttcttaaagtgccagtagacggctgtacagataaatttcttacattattgtgaaattcacatttttatgaagatggtattgcccctgcttgatcatctgcttcataaattcacataacaaacattttgcatggtactcatactgtgccagggaggcaaaaataaatttggcgtggatcctgcctctaaggattgtaccactggtagactaaaacaggtaagaacttggcaaacgaacaaggaaaaggccatttgagataaaggaaacgcacatgaagacatggaagtgcggaacagcatggcattttcagggaacaacagatggtttggcatgactagaatatgaaatgcaaggagagaaagggtgcaggtgatgctttaaaaagtcattttaagctagacaatgaagattttttaacacttaaaataatttcctattatcaaagattttatcttttttaccatagcctggaataaagttatagtgggcttttcaggtatacttttattaaaatttgagggaatagggacggtagaaacaaataaataagcttagaagtgccatacgtggtgtcaaagtgatgtcttgctttcacattaaaaataaatatatatttacaaacttcttgacatatgatatattggagacatcatttcagaaacgtatatccaaataagtgttacacttcttgtgagctattttgttttttagtcacaataattaagaaaaccacagagtacagaaactaacttttatgtgtttttattaagctttaatacttatatacattaacttatttaagatatatataacaatctaagtaatacgcatttctcttcctattttacagatgagaaaactaagattcagagtaaaaaaagtggcctaagatgtccaggttactaagagacaaaatcaatattcaaacagatatgtttggcaacaaagttaatagtttatactgtgttgccactttacctcagtcagactttatctataccatatttgggtttgaacaccttctgttctaaagaaattttaaagttttcgttaaactgtcccaaatgtcaggtaggaaaagttgacactgatttccctaaatcacaatattcatattaaatattctggaggttgccagggaagaatttcatagctatcttatctacaccatcctatacaaactgcatcttggtccattaatcctcaaattatgttaaagaaaaattgggactattatacaatctctaagtgatagtaggctctcaaatgtgactttaagaacatatgttaacctctctcgaccttaattcttcatctctaaaaggaacagtttagactaataatcccagtgatccttctgcgtggtctcaggattctgtgctcactgcaaaataaatagcatttcagtctgtagatacggtatatgctggcttacaggtgagagagacactttaagtgtgattattttataaccgccaaattcggaatcggatttgagagctgggatttttgtgtttatttttaagaactctcatggcctacatatttctggcatatgtaaaatttgttactggtgatataccctgtttataaacagaaacttgttctttaaagacaaggtaccaatgtgcttaatttttaaatcaatagaaataaactaatcaagaatacccatcaactgcattgtggagtggttgttgtatgaggaggcagtagggtataaggattaaggacccagactctgggtttgaatactggaaatgccacttcttcctaactgtggaactttaggcacattaatgctgttctctgtggcttagttttctcatctgtaaaaacaatttctgcctcatagagttgttttgaggattaaatgtattcatgtatgtgtagtacctagaacagtatccggtacatataaacattcatgaaatgttacctgttgttagcattatggataagagatcacttatttgaattaaagaagctacagaattaatggataaaataaaaatattgaaggtaagctgcaagagggcagaggtttttgtctgttttccatatctgtttcctgggcaccagcctaagtatctggcttagattaagtgcccaacatatatttgttgagtgaatagttcaagattcaatgacgttgaaacctctattatcttgtttttttttttcaaatgttcctctgtattttaatgtttcttgtattcaagagcattaagccatatgctataaattctataacataatgagtagtaagtaacagctttggtctctagattcctgtttcagttcctctgtgctattttaagcagaaataccataaaatcttagataatttcttataaaaacaagtgttaggcctcatcttttttcttctttttttgacaagtaaataaaaccaggcctctgcttatttagacatttcatgggtcttggcagttctctttgttgtagcagtagctgtattgatccagctgttgcagttgctacttgggcagctgctgggcagcattgccaactgcctcagatggtttttaaactgattttagagagaaaaacaatccaggaattccagaaatacagctaagcctcccctctctcttgtccaattagcagctatggcttagaaccatggattccaaatacagcaatcctactcttttggatacaaactaatgcctatcttgaagagtctaagttggataaaaatctcaccctcagtctcagttttagtaataatactttagaattacagttactgtaagccaagtgtttataaggattttcataatctgtatcttattttacttaaaaacccacgctttcttctctttactctttcccagatagacatagttcctgagtcactgttgattagccaaagtgacaaggatagccactttagttaatgaaactaaattatttctcccaaaactaaattatttctcccaataggctctcggtcaaaatcatgctgatatataaggtgctttccagctttgtactatcttaaatattttattgttgtctaaatgattttgttccaaccataagcttggaaaacaagaaaattgtatagtacaacaccaaaacctaataattgtcaccacagggtgcattggccaatgggaggaaactttgccttttttattttttttaacagaaagaaatatcgatatccaacttaaagttcccaggaagggtatgaaaatttcgcataaagatcttataagttttatagaaggagagaagctgaaaacccatttagacctattctgcccaaaatgcagtggtacagaaacctgtcaaagtgggggaatgtactttccaaagaccagggatgagaagcaggcaagaagccctcaaaaatcagctgcatgaagatggtggttgcaatatcaccagcctcataagaatatgtatatgtttcaattccattgtggaggtggaatctaagcacaaacagtcccttggcgatcacctgaacagtctccagagaaaagagagaaaagaacgtacctgctataagcattatggaagcttttataatttagaaggattattaaaaagagatgctactttatgtgttatcccaaaataaatgaaataagtgataaaattcattaaggttgatacaaagttctgtctgtggtccttattggagacacaagcaccaaagtagtttctaaatagaagctctccactgtttttgatttgtggaatttgaggagtgaatgccagtcatggctaagtcagaaatttaacttagcatgcttactgtaccaatgtagaaagtatacatgttatcattatgtccatgcttactcaaaccacatcctcaatcagagcgtcctctctcttatacaaagctctatcacacaccaaccctgaactattcactagagagagttgtacccagtgttacatattatttagtgtctctcctccccacaaacatacaccacttctggatgaggaaggtcataagtcctggttctaaatactgaagtgtaacattgccaagtgtaacatttcccctatagtcttggactcctctaatcataggaacccaagggaaccactggaagcacaaagataatccttccccattttcaaaagcagccatgtcactaatcagaaactggttaatggaattagcattgcatttaacttcctctgccttcaaatttaatatacaagcactgttttgtattcacccttcccccaaccatgtaagaatttaagctagttttgatagaattttctctcaaaatgaaaaagcgattttatgtttatttaatgattgaacctgtgccagccattctggtgcgttcccaagtaggcatcagccatctcatccctatttgagtagcatcagcactttcatccctattcgagtatagagtattttgagcattacaatgtacgtcagcatctgtgacagatcagcatctttcaaaacagaaaacaatgtagacagcctgtaatatgcttttcataccacaggtgttgatttctgccccaggaaatataagaatggcacatcaacagatattacccatcatgagttgtgtctgagtgttgattttaaatagtctaattaaaatgtcccatggttggcaaaatatttgatgatcagcttgcacaatagttgttgctctatcacaaacagggtaaagttgaccctggtacctgatcattggctgccatcagtgaatctgcacaaaatggagatgcatctacaagtaagaattggggaattggctactcatcaataaattggtaggtatgaaatgggtatatatgctaggaaagaagcacagtgggaagttagatgcaaagtcatctgtggaaataattataaatccataatttttaaaaaaataccagtattcaggtatatcatgctgtataaaatgcagtgagattatttataagggctaatattaaaaagtatagaaaaatataatttggtttagattcttaatatctataacctacttcttttaaaaggtctagtatatattttaagcaaataaactaactcttagatttattaaaaagagtaataattcttaatttaatagtaaatattaaatatttaaaatatttaaatataggctctgtactgaccattgaagaattttcttaaatttaacatttccaatcagtttaaattatacaccaaattaactaatatcttcatgcataaaagtctcagttttaaggttgtaatggaacctgacttgaccagttcatccttatggtacatgctgataaatccactaaagtagggttttgattaaatatattctgagaatggttgtctttggttattataatagttagaaaacagttctcagccttcatcaacctgttaaaattagtggcctgtaggttattccaacatagttcttttgtatgtactagacaaatacagttgttagttgaaataatgccaatattataaatggatcaaatgactctgggttgattaaataattgtcttttttctaatctataatctgtgctcacttttattaaaatagattcatagcaactatctgctgtgtgcgggtaccatactagctaccttcatagacgttatgttttacagtctttaaaacgtgaataagaagttttgcatctgataaatgtgactgtgcccccttggggccactcattacttttactgcagcatcaaatccttttttttcatgaccctattatatcatataatgtcctggtctctttcttgcttaactaccttccatgaggtcagaaatgattacaacagcaatcatattaggtaattttagtgcctatgaaacaagctaaagagaaatctctgatttggtgaattgaaaaccatatagatatggggatgaagagttcctatgactgattttcctatctggattcaaaccttgcatttagtataatatttacaatacaaaagacaagccttcactgtcacccacagtcacaccagtgttgttctcagctggacagtatggattacttgagttatgcatgagataaaaattggcagccatccttgtgctctcagctcttggttatgcatgaatgcattattcttttgtgggtaacacattcatctccggattaccacctcataattgctgttatgggacctcaagccctcttcctccctgaatacttccccaaccactctagaagccactaaggacatgactcacaaggttcctgaacaattacccttagccaacatggaacatctgccattttcctcccctgcagcccaactctcttttgtcatattgcttagttagccaggtgcatgcccactagtaatgcaatcacaacccacttatgttgccacctgtaggctctcccaagatgagactatttaaacatctcatcactaaaactcctctgcaaaaatgttgagaatgtcttcttcccatcatgttagactctctcatgatagtccttgcagggtgggccttctgagtgtcagagaaaagtttgagaacaatttacttctctggttcctgtttacacttctagtctgggggactaaacttggaaatttacctcaaaattctaaccatcacgctcttgatagtcactggttaaaaaaacaaacaaataaacaaacaaaagcaaactcgtctttcccaattttcccttagagtttcttaatcaacatagttgctcttagattcaggttcagacatctccaaatgaacatgtgaaaatgcaactcttgatttttctaaacagttatacatactacagccatggtgatcatcttaaaacagtagcagaccaatggttctcaaaagttactagatattagaattatgtggagagtttttaaaaagtaactgatgcccatattcttaaccaagtgtattagtttgttttcacactgctataaagacatacttgagacagggtaatttataaataaaagaggtttaattaactcacagttcctcatggctggggaggcctcaggaaacttacaatcatggtggaaggggaagaggcatgtcttacatggtagcagatgagagagagtgagcaagattgaggaaaactgccttataaaaccatcagatcttatgagaactcactcactattttgagaacagcatgggggaaaatgcccccatgatccaatcacctcccatatggtacctccctcgacacatggggattatagggattacaattcgagatgagatttgagtggggacacagaaccaaaccatatcaccaaagtaatgaatcctttctaagggagaaaaactcatatgaaatgtgtgacccacctcatctccaaccacagagaatgaaaatgtaaacttgacatgctaaactcaaacttttcaaagacaaagaagaggctgggaggagaaatgtactagggtggaaattctggctcccatcctccatttgttccctgagaagttagaactgaatgtaaaaaaaaaaaaaaacatgaagtgtcctctgcttggacctaggagtatgtgctttggaagcactcttgatgcctcaagtatgagacactttaggaaaagtaacccaaaccagaagagaactgatagtggaataaagaacataggatgtagtgcagggcctggatgcacctgttctatgcattactgcagagttgtgcactaaagcatccaccaaaaacatccctgattttagtttctgttccttaggtttgtttcttaacattgtaaaaagcattcaactggacagtgttgggctgagcggtgaatgtttctccaagattgtagatcaaggcttgatacaagtgaattgtgaaacaccccacactggcccatattgttaggggcatggctgacatctggctactaacagtttccttctgttcttttgtcaacgtcagcctgattattttaataacaattcttgtgtgtcactatccttgtttgtatatttttttagaggaatatggtaactaagtttccgttgaggaaaaatacaaatttaaaaaatctaaaacatcttgtgtgttttatttgttcacttgttagttatattttaattaattttaaaatgatgtatataaatgaacaagatatgtctcaaaaatcacaagtggaacttattaatatcagttctaaatagtgcctggcaacaaaacattggtttccagagccttacaaagaattgctgtataatgggccttctaaactaatgttagatagaagttgcacttaataaagttactgagatattaaattattatagttgaaagttagccaggaagttatataatattttgccttcatggaattgtgtgtttaacaataaacaagtcaatcccttcatcaagaaattgtatgaaaatatgtaatggtacgtgtaagatagacttcttattacactcttctgtctttagaatgtgtgactccaacatatttcatcacaggttatttactgttcttaaggcagacagtagtataaccattactatcattaccataagctttaatttagagctcatgtgcatagtgtaagtgtgaaaaaattcacaaactaagtttatactctgaacttcatatttaaggcagcttttctattaaatgtacatctaatattccctttccatgttctgagttcaaagctccattgcttcaaatattaaaaatcccccagaagtctttaatcagcacagctctcctatagaagagatccaaatgaaatttgaagaatagaaaaagcataattggagctattttttcaattccttcttcctcccccctcactatgcttgtctctctcattcttgtatacacacccactcgtacatatttttggaggcagaagagcactgcttgctttttgtgcaaatgaaatagcaaaagaaaacatgttgctgtgaagctgaaatacactcatcagactaccaagtgcttctagagaaagctttcactgaacgtcattctgagggacgcagctcccttcctcttgaggccctaggcatgaaccatccgacttcccaatccaacaaaacctatcagacaatgaacagcagttgaatgcaaaattaaaggcctgaatattgtagtcactaagtgattggtagcttgtgactgagggaaatggggaaaaaataagccattctcttgtttcttctcgcctctctttgtggttttcttgtcattctaaaaatgctgaaaatgctgtgggacttagggacctcctggacacagaagatagtctaaaaatacatttgtttaaaaatttaaaaaaaattccactttagaatttgtcttcttttgaggtaatctgttacacaaggctgctataatttggctttcagcagtaacaactagttatgccaaaaatgaatcgtaaataaagtctagacaaatgcagtgtttttattccagaggcagccagcagatgctttgtgtaacctgcactctcctgctggccagattaattttgcactatgcttttactgtgtaatgccttggaacaaaacaaatttaaaatgtgtcctttggccacttggacttcctcagatcactcactgtagcattcttcaatattaacgaagagtaaacagtttaagggccttctgatagtcaatgacatatcacacagccctacttaggccaaggagttcacaagcaaagtaataagtactccagagatgttcttcagttgtcaaaattctgtagcatgtcaagtgtggaaagaaggacaaggaagaggaatgcaaacctaggggaacagaaatctcaactttctccatggactgtcgatcaagtatatcattataatatctgaaaaccttgcctttcccttctgtgatagtcatattattgtggaaaatatgaaacctttcagatccaacactttctcttcaaaatgcatgttatatttgaacaaacaacactgctgcttttctaaatggattagtaacaggatcttaaaaaccaggctttttctttttgagtgaaccagtgtatcactgctgaggaaaagagcagaaaggttagtggagcttgtccttgaaatatagcccaaattgatactctgtgcaacctaaatgtaagcattagctgcagtgattgtgggacacatgattgagctttccactcattacaagcaattctcctaagctcaatagacagactttccttaattgaggaacaggcattaccaatgaatttttatgagtttattcattctagaattgttcatcataatgcagtcagtttattatattaaaaatatatatcacaactgaagcagttttgtaaaacagatgttaatacactactgtatctatttatttgtaccttggggatataagggggaaaaaaagcaaactgcatgctgcatgaaaaatcatagccatccaatagctaatggctatcatgttgaaagtcaagtaaatgcttccactgagccccagtcaaatgtttggggttgattatagtaagatgaaagggttagttgaaattgcaagtagatgtagcacaattgggtattaattttttttaacgtttgttgaaaatggaaaccatcattctcagcaaactgtcacaaggacaaaaaaccaaacactgcatgttctcactcataggtgggaattgaacaatgagaacacttggacacagtaaggggaacatcacacaccggggcctgttgtggggtggggggagtggggagggatagcattaggagatatacctaacgtaaatgacgagttaatgggtgcagcacaccaacatggcacatgtatacatatgtaacaaacctgcacattatgcacatgtaccctaaaacttaaagtataataaaaaaaagagaaaataaaacataaaggaagataactgaagtgtattgtttatcattataagtggactactgtctgctacttctagctcactgtgtctatctgaatttatatatacccactgtgatttaatcttcagtttaactagtagatgccagtccatattttcactatatctacaagagttcctgtttcttcttatgactactcatatcaataattctggaaaggggagtcttaaaagccacttaaaaagaagagtgacccaagaaagcagaaggctaaagtaaagtgcagttgtcatctatttatagactgagtattttaattatgccttttaatgtattactatggttaaaaataaaagctgtgtatgaagtcttgaaaactaaaactgaaatgtttatgttttattatagttacaatttttcctttgaactttccaaataaaaaattcccctgcagactcatagacaaccagtattgcttagcttacgctgtaagcctgtaaatggggaaaattgttcaagagtgtaatcactaagccatgaatatggctctgggtgctcttatgcaagtttctctggccagtatttttatgtatggtttgttggaatatattttttcttttcttagatttaaaagagttgttagaaaatgtgcaattggagaataacttacacacacacacatacacacacactataggctgtttctatgggcctctataaagcttacaaattcagaaaataggatattcacattctctcaatgaatcagaaatgtagcagttcacatgactaagctgatgactaagcagacacttggggagaagagcttgcaaattgggctttagggaaaatgctgtcattagactctaaaaatctaaaataattatcacttaaagccaatgtgaaaaattaattacaatatttttaggtcattaatttttctagtctcagatctcttcctcccctccacacccatttcctggcatattttaatctagcccaatatttaaaataaatcaaatgtcagaggaactctttaaaaatcaaacctggagtttctgtcagttctttttccacaatgtttttattggccagtagcctatgttctgagaataatccattttctcctaactagaaagacttttaaaaaattttttgcagttgtcatagagatggaacctagcatggtggcaggatgtcagttattttgtcttttgtgatatttatatttttgtgaatatttttatggtgttttttttcctgcctgcatgaggtgattctcctgcctgtcttgtgatagtaaacacaggagtaaacgtgctctatttcctcacctgctaacatttgagtgtgatatgcttagttaatcagttcactgaagcaattaagttgcttttcagttttttttctttttgtgtcttcaaaagggcttcatcttctggaagtgccacattgacatggtaagaacaagtttatatggtgcttgcaagatgttgctcactattctaagttctataagtagaataaaacattgaatcattgtggcaaccctaaaatataccgatgaaaactgaggcacagagaagttaaataactttcccaagactgcgtgcctagtaagttgacagtacagtatttaaagtgagtaatctgtgcctagaatctgtgaccttagccatgactctgttcttctcacacagaaatttactcatgttttttcaattatgcagaagagccatccccaaaagattatttaagatgaatgctttgtcattttttttatcatgtagtggacatactttcaaaacgttacattgtattaattaaaatctctgattcctagtataatatagacttttaattccttgctactgccaaggaattgcttacttgaaataaaattttacttaaaaatgggtactctgtgttaccatatacttctatattgctgtctcttttcagctcagcattttactgtaaaaagaaatgcacacatatttaaaagttcttatatacaatgaagattcgtgacattcgttactgaatttatagaatacataatcagaattttataaacacaagtatgtattttctaatgataatgttgcaaaattagttacttttcaaaggaatcaagatcaaatttcttgtacttaataaagttaataagtaattaataatgtaagatattgttatataatttagtgttccttgtgtactaggactagcactatataatatgcatatttacatccttagaaaattttgtttttctgttaaaaatgtatgttcagttttccccaaaatgggaaaatatctcagaataaaatacctatttgtttcaagtatatcaacaaataatgtttactcaaaaatctcccagatttgtatttttttgaaaatgttagaaaactcccaaatcttacattaaattagttatgatttggcctttaatcactttaatcattttatcagaagagttgaagtctactaagtcaagttagatatgatcccactagtgactgtaactttgtatgttaaaccacctgttctcagcatgtacaggaacattatcttctgtttgaaaaaggtaacataaaaaacttaataaaagccaaacaaccctgcacttgttgttattacatttaaataagttatttaaccttttgtcatttgcttttgctcattcaggaacaagatttaaagtactatcagatgaatgttaaaacgtacttgcacacacattaatttagccaattctatggttgtctacaaaataaaggacagaataaagctagacaattcagtaaaaatattgctggataagggctaggtaagctaaaattgctaaagatggctcctatctctgctctaacattattggacaaatagagcgtgatacttagagatgggtatgggatgagtatgagtctggatgagactagaagatgaaaagcagtagaatcaaaatttttaaagcatcagataaatctatttacctgttctccaatatcatgcccttggcaatgaggaaaaattaatctttcatactaatcattaaaataaagaaaaaggaggtaaaaacttcccaggtgatatttgagaaatgaaatcagaaaatggggagagtgatggtgatggcgacgatgtgggaaggactgtgggctcttaggaataagttatccttgttgtctttcaagtacttgaacgcagatttcaaaaaatagaaattatgtttttcttaccacataaatgaagacttatgattttgtaagtgttttgatatccaccacagttttaaaataacccagtaatacttgcagtgttatttttgtagtgtaaccacttgtgtgaatgaacacatagctaataaatggttaaatggaataaagactggcctaagagcatgacattatgaagtaaaaagtcaggcaaaaataaaccgctgtatgtgcaaaagattttacattctaaattaaaagtaactattaaaaatatcactgagaagagagtataggtcttatatccttcaaataaaccacttggtaaatgcagggaatgctacaggaaggtgcctctgctactcagaagttaacgaaaatgtgtggttgtcatggggatactcaaattacagaaagaaagaaatcaggaaatgatgaatgtaattaatttttcttgaagttcaactgatgcaaggtaaaagcatatttattatgtgactgtctagccatccatgatattaaaaaaatgaataaataccaaatttgcaatatatgtaaattaggcaaattttgtcatggaagttcacaacaaatacaattatagttactcactgaggaatttaattttttcatatgggtttgcataaataaataaataatttataaatatagaaggctgacttttgttagtttttgcactttttattaggagaaaaattaatcaaagaggatgcaatagcccgcatacaccagaagcaattggtgtgtcaaatttgctgtagtgctgagcagtagaccactctttcagggtagaatttgagcagctttcaaatgcccagttctgctgctaacattaaattagataaacagatcaagattagattagataaatagatcaggcaaataagtgaacaatatagttgttaaaaaaaaattcaggagtagtaggggctggtgagttttacgtagactaaagagctcatgctttgtctaaatgagcagcagcaagttaatttctctaatagttgtcctgcatgaatttgaatccatacatgctagatctgatttttcatgggaagctgaacatgtttccatgaaatatttttctgcaaaacctcctaatttttaaatgtgggcaagtaatatgtttaatcagctagtggaacacaaaagaactactgtcagcaactagtttgggatcttttatagggctttatgtagagttgtccttcataagcaggctaaaaactgatcaattagggatttgttggttggaatctggttggaatcttattacatttccttattcacaggtgtatgaatatgaagcagtccactgtgttagatcagtggtagcttttaataaatgatagcttcttcaatctgtaggtatagtctgcgtttcatagatcccaggtaccaacctaataaaaccttcctatcagtacctgcattccaggccatggatatttttagttaacacttctttatggttcacaagagaattttacataattccagccttccataattcataattccagtccataattccataattccagtcattatgggattccgtaattccataatgtccagtaaaagaattggctaattgctactcccatcgtttgccaatcttcagataaaattttagcatctataacaacgagaaatttgtgtaacttttttataaagattaatgtatatgtactccttcatgggtttagaataagaaaaaaaaatggtgtcatcttcaatgttgaaaaatatgccagatcttcaaaccaaaaggcactacatttggcccactgagaactaatttattcaccaaagtcacctcaatatgccagattgagttctttgcttctaggagaatccaagatttaaatctacatgtaacaaacatatgatacctaacgttcacagagtgccaagaatttacaaactacattttaaaataagatctcattttgatcctagatataatgaaaacacacatcaaactctttcattccctctttgacttcccaaagagggtctttaaaaaatattctaatggattattttcttattttttctgtaaagtctttatcacactgaaaattacagtgtgatacagtggcatatattatcataatgtgataatatatacttgattctatatcattttttagttaaattttcccatataagcctaggaggattgaaggagatgttatttgtaaagagcctcaacctagtgccctggaatatagacagtttgtaataaatacaaatatccttagttgtttcgattttggtcaccttctttctaatacacctgttttgtccaacttatccacttctgccaattcctaaaacataaattcaatcatggtaatttcacactccaacatgtgctgtggatccttcctgcctctaaagatggggcatagctttcaaagccctctctttcatgcttcctctttaccattgtgttttatccaaactaaacaactttctgttcagggtttctcttagcttagtagctttgttaacaatgttcccatctacctggaattattttactaaataataataaaagtcaaatgcatgtttgagacctagctctatgaaatacttctacacttcttttttttttttttttttttcttttttgagacggagtctcactctgtcgcccagcctggagtgcagtggcaaaatctcagctcactgcaacctccgacttttgggctcaaacgattccactgcttcagcctctggagtaactgggattacaggcatgcaccaccatgcccggctaatttttgtatttttagtagagacaggattacaccatgttggccaggctggtctcgaactcctgacctcaactgatccacctgcctcagcctcccagagtgctaggattatagccgtgagccaccgcgcctggccaatatgcttataatattcctacagttctaacagccttcaccttctctggttccaggaccctctcggttcttagaggacatacctataagttttgagccttaaaattaatggagtacataccttagctccattataagatcataagcatatttaggataaagactccatcccactcacttttgtatacccagaaaggggtaaaatgcttttcacatagtaaatgctccataaatagttattgaattaacttggcagaaactataggagccattgaccagcttcctgccctattcagaaatcaactctacatcattccccctgtcctgcctgtggctaaaatacgtgcaagctcatgacttcatgacatggtgtttttccttgttgaaaaattgaaattattagaaaattttcttgttttgagctgaaatattctttccacttcactcttacctctgcctgtggaattggagtactatttttttttcttctacatgccaatccttgaaatgttgatacggtgctcaccctcagcattctcttatcatggtgaacctcaccgacctttcacccccacgttgtgttttttttatatggctccattctggtcatcctctttttaaatgctgctcattcttatcagtctatttctttcaatgtggaacccagaactgagcagaatactgtgtgaatgatctgaccagtacagaatgtggtagaaatatcatctccctcggtgcggacaccacattcctataattcagcctacaactttagcagccagattatgtggttagctcatagtgagcttcaacaaataatgatttaatgagtgcctgtatctgccaggcaccataaggaccctccacatgttatctcagtaaagtttataaagctcgattaaaactcccatgttcttgtcaaacaaattgctgtcaagaaaacatcttctgtcctcaatgtgtataattgtcatctcaacacaaatctaagatttttcatttatctcagttaaattttattattttggtattgtctcatcccttatcccagttaaatttcattatgctggctttgcctcatccctttaacctgtcaagatcatttaaaattctgtgtctggtgtcaaagatagcagtcagttttttccagctttgagtcaactaccttgttgataaggaagccatttagttttcagctaagacgttgctgaaaaaagaaaaaaagtgttgaactgaatggagcagagccaaggatgaaagctacctctctagactccttcctacagatttacaattagaatccctaaagtagggctcttctatagctacaaattcattaaagattctagcattcaacccacattctccatcatagttaaagggagcagcatgagcatttttaaagtgtgatttatataatgatagacctcatgaaataatgagattcgtttggcatgcagcatgctcaccacttactagaagttccaaactactagtttggcaaaactttttatgaaattgtccagggttgaataacagtctcataaatctttggattctatactttgacttttatccatttttgaaaattggtcatttgttcatctctgatcttgtgggatttactctgttcaccatcatttcccagtgattacccagaatgatttgtttcacctttcaaatgtaattcatcagtgtttggactgctacattcatttaaacagacaaaatgctctcataatctttgctcttattttgtgcttcaattacctcttgatggtgctgtccttcctaatgtgaaaataattttcccagtggagagaaataaaagcaaaccaccattttaccacatttaacaatatatcattgttcccaagcgatgattatattcatcacttttaaagtctcatttactccaaaaacagtatttatatcacatatacacatattttatgcgaagacttctttaatgtcccttagtaaaggtaagaagtgacaatttcagccacttggtccttttcttaaagattattgtttctcttttgtattcaaccttggttatatgttcttcccttcatatgttgtacacgttttgtttaaatcagagctcatcagaaagagagccctaagcaactatgatggtttccttggatacagattctttatttttctcatcgatatcatttgtgattgtattaccagattttcaatttttactttccatctcctttatattttctgcccattgaaccccccagggagaaaataatagctgttgattcttaaattgtttttcaatggaattacctaaaacctaaggtgtactttagtagccttttcttgacctctaaaatgtcatggatgctttctctataagtttccattatttcagattcaggaataagctcctctttgctgctaaagattaaatcaagaatagaaacttcagaatgagaaactcccttccttgttctgtcttcaatctgaggaatgctgtttcatcaagatagcacaataatttcaaatgctttctattaggagaaggagttgtcgagttacatgcccaggtggttgagatttccccgaaattgctactttcaccactttatgatttgtgtaatgcaacatcagcatcatatgtgtacttattagaaaagtgaattcagggcctcagaccggacctatggggtgagaagctttggaggtggatctcaacaatctgtgtgttagcaagtccttgagataattctccttctcactaaagtttgagaagcactattgtaaagcatcatccctacattctgagtgggaagcaatgcaatgtattatcccttagccacttacgttggctcagatatctgtaccgatgtcacaattttctaagcagatgcacatataccatacatgcagtattcttgccttttctatggacatgcttcttttgaacagagtcttctatattacacagttgcatcctaacacattgtagtaactgtaagatattgaacttctaatgttaagttgccagtgtttcaaaaatatattactcaggaggctgggcgcagtggctcatgcctgtaatcccagcactttgggaggccaaggcaggcagatcacctggggtcaggagtttgagaccagcctggccaatatgctgaaaccccatttctactaaaaatacaaaaattagctgggtgtggtggcgcatgcctataatcccaggaggggattacaggagtgcctcaggagtctgaggcaggagaataacttgaactgtgggggtggaggttgcagtgagcctagatcgcaccactgcactccagcatgggtcacagagtgagactccctctcaaaatatatatatatatttgtatatattacatatatatataaatagattacatatattatatatataagtagatatatagatagatgtattttactcaggctcagtgtataggtatgcagatatctgaggcctttcctatagtctgactcattcaagattgttttgcctgagaacttcttggcaccctctccactattggtcttgccagatgataccaaccacctatgcctgctctccttgctcccaaactcctctcactctgatccattcttctgtaagtcgacctaaaatacagccctaatgatggcatttccttgctggaaactctgctgatttttaactcctcacactggcatatgaggctctctgtaatgttacttcaaccatcctctccgcactttcatttcatgactgcctactttgtagcacactctccaattcaatgggatgggaatgtgtgttgtgccctggacttttctgccccaggccttttttcattctcttccatcctttcagcaggccatttaccttcacttcccctgttaaaatctttcacttcacatctcttgggtaccccaccctcacgaatcctttttaatgtaacttagttaagtgtcattcatcttgcctcctctccctctggtaagcaccaaaggagcacagaaagttatgcttgatgtgcctgattacacaccacttcttacaatatgcgattagggacttatccctctgttaaaaagggacatggatatatcctttatccttaacggtatctgttgaatggaagtaaatatgatgctgtaaaaattcatttaatcatttcttctctttccttttccccctcctaaaattttgtcaaatgatgtagttaatttcaaagtgcctaagtagattataactgccaaattatttgaacttagtgatttaacacaaccatgtgttatcttttagatgaaaggcccctggagtataacgttcttttgataaatctaaagttagttgtttatctttagttagttgttcatgacttatttccaaatggaaacaggtgtcaaatattaatttatgaaacttaatgtttaaaaaaggcataaatgtgtgtggagagagagggaaaggagagagagagcggggagatggaggagaaagagaggaagaagggaaggaatgagaaaaaaagagaagaaataatccgcaaagaatgataaatctacctatgttttggtcataaaggtcttcaatatttctttcctcctcttggtaatactactatacactcaatttaaatggaaacatcacctaatataggaaaagaattattttattctacactaaaatacaggtaagtgctaatttaagaattataaaaaaatgataccatgtatttggacagtatgtcctagagttgagattttatgaatcataaaaaggcaagagataaggaagctgaatctgaaaataggggaaaatacttagcaattaaccttaggatgaaatctctttcttgtcttatcattatcaattcatatttaagtcttaaatggaaaatgacttgtatttaaccttttaagattcagggaaccatttaattgtaattatagctaatccaattaaagatggattataataactgctgaattaataggtcatgaaatactgagtttaattagtagattactatttattttgaaaaaaaggaaaaatactctttcatgcgcgtctgtgtgaagagaccaccaaacaggctttgtgtgagcaacatggctgtttatttcacctgggtgcaggtgggctgagtccgaaaagagagtcagcgaagggagataggggtggggccgttttataggatttgggaaggtaatggaaaattacagtcaaagggggttgttctctggtgggcaggggcgggggtcacaaggtgctcagtgggggagcttctgagccaggagaaggaaattcacagggttaatcactcagttaaggtggggcaggaacaaatcacagtggtggagtgtcatcagttaaggcggggcagggcctcttcacttcttttgtgattcttcagttacttcaggccatctgggtgtatatgtgcaagtcacaggggatgcgatggcttggcttgggctcagaggcctgacattcctgccttcttatattaataagaaaaataaaatagtgttgaagtgttggggcggcgaaaatttttggggggtggtatggagagagaatggacgatgtttctcagggctgcttcaagcgggattaggggcagcatgggaacctcgactgggagacattaagctgaaggaagattttgtggaaaggggtggtattgttgggttgttagaagaaacatttgtcatttagaattattggtgatggcctggatacggttttgtatgaattgaaaaactaaatggaataagagaaggagaaaaacaggtataaaaggtctaagaattgggaggacctaggacatctgattagagagtgcctaaggagattcagcatagtcctgccagcaaagattatttatttacttcaagagttaagagtggccgtttggggatagcacgaggagatatcagctgtgatggcttggagaaacagtgtgaactggcagtgtaaacaagagcagggcatatatgaatagttgagaacggagaataggagtatgactagacagaaaatagtagggatgacaagtttttttgggggcacagtctaagttggtccggtgtctggaatgagactggggcctaataaaaaggagcatctatacaggagcttaaatgggctgtagcttgtagcattctgaggacaggtctgacttctgagaagggaaagtggtaaaagtattgtccagtcatttttaagttggtggctgagcttggtgaggtgtgtttttaatagaccattagtctgtcactgaatactaagagcctgaaaaaatgcttggctgatttgactaataaaggctggtctgttatcagactgtatagaggtgggaaggctaaactgaggaattatgtctgacagaagggaagaaatggctgcggtggccttctcagaccctgtaggaaaggcctctacttatctagtgaaagtgtctacttagactaagaggcattttagtttttgtgactcagggcatgttgagtaaagctaatttgccagtcctgggcaggggcaaagcttcgagcttgaagtgtagggaagggagggggcctgaataatccttgaggagtagtagaatagcagatagaatagcagatggaacactgagaagttatttccttgaggatagatttccacgatggaaaggaaatgagaggttctaagaggcgggctagtggcttgtattatagcatggcctgcctttgctggtgtgtggcgattaggcctggtggaactgccatcaataaatcaagcgtgatcagggtgagaaacagggaagaaggaaatgtggggaaatgggatgaacatcaggtggatcagagagatgcagtcatggggatcaggtgtggtatctggaataatgtgggaggctgtattgaagtccgggccaggaacaatggtaattgtgggacttaacgaagagtgagtacagctgaaggagccagggagcagaaagtatatgcgtcaggtgtgaggaagaaaatagattttggaagttatgagaaatgtagagagtgagttgagcatagtttgtgattttgagggcctctaaaagtattaaagcagtggcagccgctgcacgcagacatgatggctaggctaaaacagtaaggtcaagttgtttggacagaaaggctacagggtggggtactggctcttgtgtaagaattctgactgcactaaccatgcctaggaaggaaaggagttgttgttttgtaagggattgaggtttgggagattaatcggacacgatcagcagggagagcacgtgtgtttttacgagaattatgccgagataggtaacagatgaggatgaaatttgggcttgactgaagtaatggggtctgtctgtgaagccttgcggcagtacagcccaggtaatctgctgagcctgatgggtgtcagggtcagtccaagtgaaagcgaagagaggctgggatgacccgtgcaaaggagtagtaaagaaagcacgtttgagatccagaacagaataacggattgtggagggaggtattgagaataggagagtatatgggtttggcaccatggggtggataggcaaaacaatttagttgataaggcatagatcctgaactaacttgtaaggcttgtctggttttaggacagctaaaatgggggaattgtaaggagagtttataggctttaaaaggccatgctgtagcagacgagtgataacaggttttaatcctttcagagcatgctgtgggatgggatattggcattgagtggggtaagggtgattaggttttaatgagatggtaaggggtgcgtgatcggtcaccaaggaaggagtagaggtatcttatacttgtgggttaaggtggggggatacaagaggaggacgcaaatgaagccttggattctgaagaagggcggcaatgagatgcagctgtagcccaggaatagtcagggaagcagataatttagttaaagtgtctccgcctaataagggaactgggcaggtggggataactaaaaaggagtgcttaaaagagtattgtctaagttggtaccagagttggggagttttaagaggtttagaagcctggccgtcaatacctacaacagttacggaggcaagggcaacaggcccttgaaaagaaggtaatgtggagtgggtagcctccgtattgattaaggggacggacttactttccactgtgagagttactcgaagcttggcgtttgtgatggtctacggggctttcgaggtgatcaggcagcgtcagtcttcagccactaagccgagaaggagtcggtcaaagagccttgggccagaattccaggggctctgggagtggctgccaggtgagttgaacactccgattttcagcgaggtcctgcacagatgggacatggcttggaggaatcctgggctgcaggcattccttgccctggtggtcagatttctggcacttgtagcaagctcctgggggaagcgggcctggaggaacgcctggccgctgcagttcaggcgtttggaagttcttgtgtgctggagatgtggctggggtttgtctcacagtggaggcaaggaattgcaacttttttttttcattattgtacaccttgaaggtgaggttaattaagtcctgttgtggggtttgagggccagaatctattttttggagttttatttaatgtcaggagcagattgggtaataaaatgtatattgagaatgagatggccttttgaccttttagggtctagggctgtaaagcgtctcagggttgctgccgaacgagccatgaactgggctgggtttttatatttgatgaaaaagagcctaaatgctatctgatttgggataaagaaaaaggagcattaacctggactatgcctttggctccagccacctttttaagagtaaattgctgggcaggtgggggagggctagtcacagaacgaaactgtaagccagaccaggtgtgaggaggggaggtgataaaaagattacagggtggaggagcggaggctgaggaagaattggggcctagcttggcctggcgaggaggggagaggtcagatgggtctgtagaaaaggaagattagaaagactcagtgacgcttggggttgggactgaggggacaggcgggagggaaagaaggaagatttgggacgagttgcactgggcacagagactaggaagggactgatgtgtaaaagaatgcctggacgtcaggcacctcagaccatttgcccattttatgacaagaattatttagatcttgtaggatggaaaaattgaaagtgccgttttccggctatttggaactactgtcgagtttgtattggggtcaagcggcattgcacaagaaaataagacgctttgattttaggtcaggtgagagttgaagaggttttaagttcttaagaatacaggctaagggagaaggaggaggaatggaaggtggaagcttgcccatagtgaaggaggcaagcccagggaaaagagtagagacacggagaagggatgggggtttcttgccctccagaaaagcagagaaagtgttggggcacggaaataagggattggggcacagagataagaggttggggtgtggaaataagggattggggcacagagataagaggtcggggtgcggaaataagggattgggggttcttgccccctagaaaagtgggacttgccactaagggtgaaggagaaggggttgaggggtacttgcccttcccccagaaaagcgggacttgccgctaaaggtgaaggagaaggggttgaggggtacttgccccttccccagaaaagcagagaaggggtagagacaaggagagaaggggttggggtacttgtcccttccccagaaaagcagagaaggggtagagacaatgagagaaggggttggggtacttgccccttccccagaaaagcagagaaggggtagagacaaggagagaaggggttggggtacttgcccttttcccagaaaagcagagaaggggtagagacaaggagagaaggggttggggtacttgcccttttcccagaaaagcagagaaggggtagagacaaggagagaaggggttggggtacttgccccttccccagaaaagcgggacttgctgctaagggtgaaggaccaaggcaggcgtccctgcgtggtctgacacccttgaaacgtgggtgaataatcaggcgtccctgcaatgattaaacaccaagggaaggctgccttcccagtccgtgaccagcgccggagttttggggcaagtaccccaaccccttctctccttgtctctaccccttctctgctttcccaggtttcagcaccaaatttcatgcgtgtccgtgtgaagagaccaccaaacagactttgtgtgagcaacatggctgtttatttcacctgggtgcaggcgggctgagtctgaaaagagagtcagcgaagggagataggggtggggccgtttcataggatttgggaaggtaatggaaaattacagtcaaagagggttgttctctggtgggcaggggcgggggtcacaaggtgctcagtgggggagcttctgagccaggagaaggaaattcacagggttaatcgctcagttaaggtggggcaggaacaaatcacaatggtggagtgtcatcagtcaaggcggggcagggccttttcacttcttttgtgattcttcagttacttcaggccatctgggtgtatatgtgcaagtcacaggggatgcgatggcttgacttgggctcagaggcctgacatactctttctaaggtattatgtgaaaactctaaaattttcatctaaaaattatggagattgcattattagaagaaagaggagacagaggagaaggaggaggaaggggagaagaaggaaaaaggaacagcatagcatgaaatttaggaaaaaaatctgagttcttacttttatttttttctttagtttaaattattttatatttgcaatcctggaagaagaaataatagtaactgtttaattccttatttcactagacaaattaagattgttaatacgtacgctcacagaacaaaaagtaataattaaatgacagttttagtctttaaaaactacaaatcacagtgcaatacaatctaaatcacttatagacattttgcatctatttgttttatatttagggaaaataatacagttgcagttaaattaagctaagtgacctatgctagggtcaggcgaattatttcaatattcgtctttgttaatttgtttttagaaaaactgcggtaagaaatacaaatgtaaatgactaaaaacaaagacttggcatgacaaataattccacaagtaaaattaaaggactgttttatgatgtatgtactgtagattatgcagtgttgtgggcctcaatcttgcttgctagtcacacaaacatatacaaaggaccttgctcccacagatgtacacatttagtccaaatcctcaaactgggaagtcctggagcaacatcagcaactccctcaccataaatatggcatttccttaattctatgctgcactattttcatatttaatatttctgaaatctggattcatcttagaattgaaatgtaagaatgcatgtggggtcctcaaactcttgttccactgcatggggaatttttcaggttgacataaactaaagtagtattaaaacccatccctctaagagtgtcttttttccttggatggcccaaaaactatgtacatcatggtcagaaaggtatttttctgaggatattgctctttttttttttttctattaaacatgctggtaaaatgtgtcagagtatactgctttctactcttataaaataacccgtgggttatattttcaagatgacaaaagctatttaaatgagatagttagtggacatttttaaaaaactgaaaatcaatccagaatatgtgcttgaggaactctcagggaaccaattcgaagatttgcacgaggatcccaggattcctagtcattttttcagccttgggccatgtaggtacacagaaacataaactggcaccagagctagaatacctaatttaggggccccaggccagggggtgttaagattgctgggtgctcaacactctcctatggggcacccaggcatgtcccagaggaaatgtgtggctactgaaaagtgcactgtggttgtatacatcagatgcacaagtaacacaaaaggcaccacatgtgccacacactggagagttttgctacctccccgggggaagccaaaatgcgccgctgcagcacttggaatgaaaatgcattttctgtgagcaacagcctcctttgaagaaactgctttctctttcaacatttggaagctgcttggcaacccacaatcaaggttttcgttatgttgttttaaacaggcccattatcagtgtctcatctctctgaaagcttcagacttcatcatactgtttttaaagattaacatattatacctgataagcttctaaaacttgcagccttactaaagctgactgttccagcactttcttcctattaaaagtgagttgcacaagaattaaaatagatactgtttgtctactcttttcttgcgataagaaggcaacacttcacttgttctgatgttcattttctatccgtacattcaggaattcatttttaagatgtcctttcttttgtcaaaatgttagatctgtgcaagaatttataaaggaaaatcatttcagacatgtttgtaataggcaatattaaaagtaaatttgaaggctacagtgacttattgcaatattttgtttgtcaatagtctaattagaaactaagaatattcttatattcgactaatgctgatttgttacctcacctgtcaattcttacatagtataaaagtagatttggaaaaactgaaaataaatatatgtatagacattgagcaaaaatagcatttttagcttcttgaaaattgtaggctttatctgtaatggcaaattttaaaaaaattgtgacagatgcaatttatttggacctaagtttaatgagtgaaaggctgaacttatgtaaaatactaaaaactacagtgccctaaaatctaaagttgcaatggcaaatcaagattggaaatattaattatcactaccttgcacagtagaattgtgtgacttagggctaagaaaagctacaaaagagcccagaactacatatctcaaaactttaaattaatgggtttccaaagaggagttatgtagcacataaaaattaaaattaagattagaagaatgtaatagtgtaagttgagtagatagaacatttcttacgtagttttaaggatttctgctaagctttgactcattgatagcaagaataacacacaaagtaatattattacttaaaattgtcacgacttattgaactaacttatttaagatttaagctacaaagattgggcctttcagttaacataaaacaaacagttacataattgtactgttgctcaatttttgactttagacatagtcagctcatgttcttgtcatgtgttgaagcacaatttttcaacgttagccccaaatcatagttccatgccagcaagtgaggtttccccaaaataaagaggatttctcatccagtttgaacaaaaaatagctacattgttgatttgttgaatgtttttcaaatgcaataatttttacattttggatttagagaagagagaagtaggagagaaggcaggaagggtaacacttaaagacagaagggcaaatattctaacaccattgagtgttcactcagaaaacagcaatgaattacgtggcctgtgatatttaatgagccctgtataatttgctctattattagtcaatatttggctttctgtgagcatttacaaaattataccttgatgaacaataggtcaagtcagtttttccttcttgctgacagagaatcattgaatcttttaaaaattgtcagaggtgatccagatgtcattagtgcactagattctttcatgacttggggaggagccacagactctcatctgtcagaaagcctggtggagggatgagttgcttggcactaataatctcattcatgtacttagtgttacagctgtctaaataagagtgctttactgttcttatattggcacataattaaatatcagttctaagttacatagcaaaacaacaaaattctaaaacccaaagcaaaaattaacttctatattgaaatacttgaattgcctgaagtgggaggaagggcattattttacagcagccaaaacaagcttttgtttgtttgtttgtttgttttgttttgtttttgtagttagaaggcaactccacgtagtgaagaaggacaggttttggagtttaaccaacctaggttttaccaccttgaggaatttaccctgtctctctgagcctcagtttcctaacatgactgtcagagggaacaagatcatgaatgtaaaacatcaaatatcctaagtgttagtcatttctccttctttctagttgcaagtatgccttacttccttcataccaaatgtaattaccatagcagtgtctagaatgtgtcaagttgtgacatgaaacctaaaaaatacagtcagtatctttagtttgggactgacagttttaattgtcatgttttattgttcccttacacatcttgatatttttttctgacatatatcatacaatatctttatacaaatattttaatgtatttgagatatcaaaataatttgtaatattttctgttatgtaacctgtcatcatatagacttggcagatgtattagcaattaaaagcatttccatagaaaagaaatggtaagttattcagactgtacttttccccatcacttcattaattagcacagcatattaaggatctattttatgtagaaagtaatatgcaactaaatgtaatgagcaaagattttaaaatatttcagaaaacggtaattcatggtgcgtattatttttaccactgggttgatacatgtgctttttatctttttcaaatatctgaatcatcaactgaatttttcacttgcatttgagtatatccacttattggtatattttcaaaaaacaaacttttgtttctttaacttttattttaagttctggggtacatgtgcaggatgtgcgggtttgttatataagtaaacgtgtgccgtggacatttgctgcacagatccacccatcacctaggtgttaagcccagcatcattagctattcttcctgatgcttgccctcccgccattcctctgacaggccccagtgtgtcttgtttcccaacatgtgtccacgtcttctcatcattcagctcccacttataattgagaacatgtagtgtttggttttctgttcctgcgatgttagtttgctgaggataacagcttccagctccatccatgtccccgcaaaagacatgatctcatcctttttatagctgcatagtattccatggtgcttatgtaccacattttctttatccagtctatcattgatgggcatttggattgattccatgtctttactattgtgaatagaaacaaacttttattaaacctgctttctcttaaatactttatttttgcttgaatttaaatgaaattagtagttagcttcactttaaatttaaggatattcttgatgatcttaaaaatcaatctgttaaaaagatgtctaagtggaaaaacccaatattattgcttataatacaaagatatttatatttctatatgttttttaaaattatgaaatagtatatttttattagagttgagctgaatgttatttgaactcagagatgaactttatataatagcttaaaaataattgtatgttttacttgtttatcttctccctgtaacgtttattttaagatctcacttctagtttaaaatattcgattagatgtaagataagaagggaaatttcacaaacctttgggacacactggattccaaatgtcttcccatccagctgagaaaacttttaaaaatataattctgttctatataatttcatacaagtgttgttgtttgggatgaggaatggtaatggatcttttgtggtatcctttcccaattaattaatgcctcttttaggagaagtttggtcataagagttttacagagaacataaggctctgctagccaatggaggagagttaattctgggtatacaatagacaagtaattaaaggggacaagaggcaaaacagttttgcggagtgactaatacccactctttccaagggacatggtagaggagcaatgaggacaaattatggaaatgaggcacccttggcttgtgacaaaactctgaaatattggaagaatgtttcctcttagttttatgatcagtatgaattactcctctgtccttaaatgtttaaactccatttgccaggtgtcagccaggaaacccatttttagctgctaatttgtgttttctgtcatctgaaaattttttataagtgtacagtctgtttctctgaggttgaccacataaatttgaaataattgctgatcttatccatccagaagatcctggcagtttcacaactgtataggggatccagatattcctctcaggagtcttaatttgacccagagaaggagcaacgcatccagatccacagaagaaagaatggagcatccatcacttctgccaggcctttgtcaggtgaccctcagagccccattagaatgtcttctgtagggaaaagcttgactacattcttgggttaagaaaaggtgatgctgtttataactgctgagacagggggctgagaaagagttggatatatcagtctaaatgaaaccataaattgaatagagcatgaatgtttacccctgtggtcctatacccacattccctccaattttcagactagacattcatttttgtaatgattgcattcatgcatgtttatcttaaagtggtagaaatcaggtgattgattaaatccaaatgctctggatgagatttgtaacccagcagcactgcagactcagactgcttcagttaggaaagagtgaaaggtgcattaagagaagcagctgatcagttcttggcaggcagagtactgctgaagtaacaatttgcagtagttttgcactcctgtcagtgccagttggcaaactaatggagatgatggaatgaaagaacaaaatgtcacaacagaaaggagtgagttgaaaattcaaacattttcttatttctcataatcctgctcaatcaaaatgaaatcagcatcagtctacaaatgaaccaactcaatagtgaataagaggcagctatctgcacattttttttccaagtaggaaaatcgattaacaatattgtgaccattagcttgttcaaaacatcatcatggtttgtaataactcagaggactaatttataaacaagaatattgattttaacagagtaagttttagttgagaatagcaactgatacagatgttgaaactttacattaaggattccgatgttgggttgtagtggaatatcagtgccaaggcagcaaagtcaattttaaactattattttgctaatagtaaatataatgcaactcctatatatcctcctaatatagatcatctggatttactatgtaatctttgcctgacactgcagactacactatgaaaaccaattctatgtacacattacaaatcatatttttaacttcaaagatttaagtgttattgacttcccatggttcactcagttttaattgtttttgtaatctagatcgattacctcaatttttgactctaggaaaaaaaacataaacttatttatcaaaacaagtaggagaaaatcaaattagcacatcatatcagaagtacagcacaagataactaaatgtgaaaaacagatgctgccaaacatcataaatatcaccccagtaaatacactgaagagtagatccttttacttcagctgaactatgaaacagcagccattaacacatcaagaatgaactacaacttgccaaaggttgaaaagtaattttctccttaatatgattttagagtgcagcaatgtggtggcttattcatttttctcccattgggtatacaggataagttgttttaatattcacatgaaaatagataaataactttattgcatggctgctatagagctcagagccaaagttgtgtgccttgttattattacaaatacatcttaatatatgcttcctaattgcatttctggttcaaatctgatttttatattctcactttacattttgctattctgttatgtttttctgtatttataaatgattgaatcacattgaataatgtaggattatagctgtgtcaatctgttagtgcctgatagtattttaaaggcattgattacagggtattttatttatatgtagtgttatcctgcatatttatttcataaaggtaatcttctaattacttattattctacactaaattagtctttggaccaagcagatgtgcacggttaatttcataaacagacttggtaaaatgcagtctgtttcattgccccgttgatcagtaccgaagccgtataatgcagtaccatacaccatatttaaaataccttaaaaatcatattgttctttggcagaattaagccattcctaaaggagaaaggcctatcccattcttaagaaaagaaaaactgcataacttatcacctgaatattttctgaaaccttaaaataaagcttctacattggcagagtctaaattcctctgacatcagtttcagcagactggaggttagctattacacgccaaaatatttctcttgtatatttcctgttggagtaagtcctgttactaagtacctttttttagcattaagaaaatcaaattctgtttttgctttttcactggtgaatagaggggttgggatgaagtatggccatattttttccattgagtttttttgacaaataataattatgtatatatatggggcacatatgacaccttgatatgtttataaagtgtaatgatcaaattatagtaattggcatattcatcacctgaaatatttattatttctttgagttgggaatattcaaaattctctcttccagctattttaaaatgtacaataaattattgttaactaaagtcactctattatgctatagaacactaaaatgtaatcctaatatttaactgtaattttgtactccttatccatccagcatttctttcctgaagataaatgctgtaagaattttttttgctgaatcttcttttctgagaagtttctctcagcaattctctcctatgcttgttgtttcctacaggcagtttatactccattgagctatgagtttatctttgtaattccaaaatttgattgtgttactgttctgctagaaaaatgacaactgtctaatccatgaccagatgagagctaaaacccttagtgtggtgtggaatcttgctattcaggtgtgatcctaaaaccagcagtattaccatcacctgcagtctcctttcagaggcagaatggcaggcccagccatgaccaactgaatcagaatttaaattttaagatcacccagatgatatattttcatttaaaagctgaagccctagttccaaagaccactccagtttagccttatcttgcccctatagcctggtccttccacctcctccttcccctccttctactttgtctccactggctctcccttctctaggctcacaatggacttttcctgcctctagctctttatgtacaaagtgacctctgtccagaatttcctttcctgacctaagaaacttctacatagttgttatgaccgagaccagatatcctctcatctggagtttcttttcaaactatggcatctgacaaattacaattatttggttctgtcctctgctttatagcacattttgcttctatcttcttagcgctgattgtgttgttagaattacctgctaacatgtctccttcccccactagactcggtgtatgtttgttttttttgttttcttttgttttgtttttcctcttctctgatacttagtagagttcaggtacatagtaggcccctagaaaaatgtttgttcaggctgggtgtggtggctcacgtctgtaatcccagcactttgggaggctgaggcaggcggatcacaaggtcagaagttccagaccagcctggccaacatagtgaaaccccgtctctactaaaaatacaaaaattagctgggcatggtgacgcccacctgtagtccagctattcgggaggctgaggcaagagaatcgcttgaacctgggaggcggaggttgtggtgagctgagattgtgccattgcactccagcctgggcgacagagcgagactccatctcaaaaaaaaaaaaatgtttattcaataaatttatgaaagagtggatactataacagatctctacattttgctcaaggcaaatagaaacaagcattgtcacccaaaagaccacaaggatggtaaattggtagaaaggagagttttattggcgttatcaatttccaagctgggaagagaaagtctccacaaggcacaaaggtgctctctcttcagagaggggaagaacaagttggattttatgcctcacagggccagtatcatacatattcaacaggtttaggggaaaagctgtatatatttatgagcagtgttgagcacacgcacaataggtaaacatgcatgtaatgtacatcccatgttcactgtggggtggggtttgagcattaaaagaggtggaatttcgctctttccatgaaaaggtgaactataagacccaaagacagtttgtgtgcagcctctacaaactggctgaaactggcttaaggtctgccatagcttttcagaaaaaaaatgtaaggccagtcctctgttcagtcagggttgtagtggtctgggtagtaaatcagcctaatagctcctactgttagggtatttagcagggctgtggtttgtcttatggtggtagaaatttggaaatttgccctaccagccaagccctgagccttgacccataggaaacttttgtttccttaacttagggaccatcttaattgataaagagatgtctatttcagtttttcctatcataatatttactagagagcagtttaagcaatttcctgtgttattctctagaacagggtccagaaattactcaggaccaagttcagggctcagccactgtaatttaacccaggttggctttaaaaattagctgttgcagcaaagttgataatgtttcttaataaattccacctacgattgaaggcatacaacacctacatgtgaaaactacactgctgtcaattcatttagaggacagatgacattgtttgaatcacaagtaatatcaagctgcattagaaacaaactccctccctgtactgtcaaagttaaagcaggaaatgaaacctccattctcacacagatttatgagggatgtattgtctgaggtgaaaccccaaagtaaatgcaaaggaaatttttctattttaaaatgcatataactgtgtgattgtgggcttccacttaactttcaattggaagtcattggtctacaatttaaagacatgctaaaaggcatatattgagagatgaatctagtggaattctatgaattccttccaagtgacaaatatactcaactaaaatcatatgctcatgaatttatgtaagtctttagcactacctatctggttggaaaaacatattcaaagatgtaagaaacaaaatcttattacagaagaacatttgcaattaatttcaatgataaagaatactaactttgaacctcaattatgcaaaatgttatatactccccaaagaatttcattttctcactagtagatttgtattacacaatattcactccatttttactattatattttggattttatcaataacaaatttgtgaaaattagtttggtatcttgtcacataagtagttggacaacatacttgattttgccccttggcccacaaagcctaaaatatttattcattggcttcttacagaaaaagttttctgacttctagaaacaaaagcagagattaaacattcaaaacaataaatatgtatttattaaaggtatatttataagctctgagaataaagtagagacattttcaccaattcagaacttgtattgtcaagtagtatgcttacctattttctaaataatttggtaaaatatataacaataatattggtatatatttaaaatatgtatgtgaattactttctgaaattggcatcagaataaagggctatgaaaattatatgggacctcaggtggaaatctacatataaagtattttcatatctggacagctcaggtctagctcagatttacttactttatggacattttacatctgctgtacaaagaaatttggtcttcaaggaatttgtcttgtcaggtagcaaattgttataattttttaaaagctgaaaactgccttcatatttaggtgtgctgaatacactctcagttcctgagacaacttctgtaattaaaccggcaagtatctcttcactgtttactgtacacttcacatcacccatagaggcatttctgaacacacaaggagggcacttcagagctggagaaaggggaaattcattttgtcacactgtgacttatatatactttttaaagacaaagcaattttctctgtcgaaactttgattcttttagagctattatggaggagtagttacatcattcccaaaatttttactgcaaagtggttgcctgttagaaacacaatccttacagaactctcaaaaactggcagttgctgtaggtagtcaattgaagaggatcaaacacatctgttggcatatccatctgttaccaaaaaatctctagtctaaaattcttgctaaaaaaacttccattttgattagaacatcactgagaagcttacaaaattgagactgaaagtcattacctttatggagtaaatcataaggaaataaaaacaaatgtctctcaagtagattaattttattccaaatctatttttttttttaattaatggaactgttaccagtggagggtatccagattcttggcatttggaacaaagaattaggtaaagcccacaaacaaagcaatgaaagaaaagcaccgatttattgaaacaaaagtacactccacagagtgggagcgggcttgagcaagtggttcaagagcactggttatagaattttctggggtttaaacaccctctagaggtttcccattggttacttagtgtacaccctatgtaaatgaaatagtgatcagcaatcagaggctgaagtgatgttacaaagttatacttctatgcaaatgaagacttggcctgggaccagtctgattggttgtgagatagaaaccaatcagaggtcctttcatctgccatgcagaaaagtggggggtggggaggtggaaaaagagtcacatatggtccttttgttacttgggcatggaaagttggagttttcattttggagtttggagttctaggaagctagccttaatcagccttaggttctctgcctccagaccctattctccttcctcagaaacaaaaaattttctttttaacttaagtacttctcactcattgtttttcctttccccagtgttctatttggatcccattaaataaattaccatcttactcacttgaggaatcttttacttctacctagtagttaacctactaccagtattttaaatttttatgccaaatttatgtgagcacataacagtatataccagtatgatattaaataattttaagtctacttatcattgagttgattataggtctcagaaataaattctagtatcacgtatagtttctgaaaattatccttaaaggtagctattcataactctgagagagcactgtgcttttggaagatttctgaaacagtctttttactacatctgattacagacattctgttatagcctccatctatcagtaatcacattttaaggtatcatttgtcaagaaaataattggtcaaaaacattacaaatatcaaacatctattgaaaatatatacagcagtacttattaaaatggtgctgttagataacaatgaaaataagaaaaatacgtttttgaaaaaatagctatataaataagatgtcattgttctgaatgactattgagccatagatgtttgatctcttgcttaaaaggtttacaaactcttatcagcaatcataagtaacatgatgcactgagatttagcatttttaataatcctgatcttgattctttaatttcttacgtcatgacaaaggcagcagtcttaatttatataaaaagatttctaatacataggtctcacatctcacaaagattcagaccagctctcagagaatactttttaaaatacaagtagttacattttaaataaaattatttagctgttttgtcaatcttttcagattgttaacaacttgaacaaaactacaaaattatttcctttatggttatatccagtgactaatattagtatatattcttttagcaaaatatactaacttaaccatatattgaattgattcatttattttcattttgcttactaaataacactaggcaaatcttgtgatttactctgtcttagcaagtttcacgtatacaatacattattattaagtatactcacgatgctgtacattttgtctctagaacttattcatcttataaaccaaaatttgtactctttgaccaacatctccccatttcctcagtatctctccccactccgtaatcacactctgctctcagtttccatgagtttgactctttagattccacatatgagattatatagtatttgtctgtgtatagcttatttcactaggcataattgtctcaaggttcatccatattgttgcaaatggcaagattttcttctttttaagtctgaaaaaaatatttcattgtgtttatgtgtatcacaatttctttatccattcacctgttgatggacacttcagttgtttccatgccttgtctactgtgaataatgctgtaatgaacatggaagtgcagatagtttatgaggtggtggtttaatttcctctggtatatacccagaagaacagattgatggatcatatagtagttcatttttatttttttaggaaccaccatactatttttccataatgtctgcaccaaattaagtttccaccaacagtctataagagttcccttttccccacatccctggcaacacttatcttttgacttttttataatagccatcccagcagacgtgaggtgatactcattgtgtttttcatttgcatttccctgattagtgatgttaatcaccttttcatataactgttgaccatttagatgtaagctttcgaataaatgatggcctttgcccatattttgattgagttttttggggggtttgtttttgatttttgctattgagttgtagagttccttatatattttgaatattaaccccttctcatatacgtggctggcaaatattttctcccactccatatgttgcttttcactttgttgattgtttcatttgctctgtagaaacttttttgtttgatgtaattccacgtgtttatctgacttttgttgcctgtgcttttggtgttctatccaaaaaataattgccaagatgccaagattgatgtcatacagctgttccctgatgttttcttgtaggaattttactgtttcaggtcttatgtctaagtctttaatccattttgtgtattcttggagcttttgctgaagattagtttgtcttatatacataggtttatttcttggctttctattctgttctattgatctatatgtctctttttatgccactaccatgttgttttgattaccatagctttgtagtatactttgaagtcaggtaatatgatgccttcagtttcattttttcttactcaaggttgctttagctaattagaaacttttgtggctccatatggattttaggaatttttttacctgtgagaaaaatgccattcaaattttgatagggattgcattgaatctgtagatcactttgggtagtatggactttaaaaaaatatttagttgacaaagattatatatagtcagctatatagtgtgatgatttgatatacatatacattgtttgatgtttatcacaataatatcaattaacacattcatcatcacccatgctttacatgagagcctcaggacttgtttatcttataactatcagttggtagtattgacattttgacactttattatttcacttatttgtgtcttctataatttcttttatccatgttttatgtgttcagtatatagaacttttacctccttgtttaagtttatttacaagtattttattcttttagatgctactgtaaacagaattgttttcttaacttattcatcattagagtgtagaaactcaagtaatttttgtatgttgatttgatatcctgcaattttagtgaatttgctcattagttttggtgaattctttagagttatatatatatatataggattatgtcatctgtaaacaaagaccattttacattattctttgcaatttggatgccctttttttttcttttccttggtgaattgctttggctaggactctcagtgttatatggaatagcagtagagagagtgggcatccttgtcttcttccttatcatccttgcatttttatatttttaatttatattttatttattccaaatatattgtcagaatttaatgttaactattatactgataaagcaaaattatctgccacagaaacaggtaatattatccaaactttattttcatataacataatatgattcttttggatcaagggctatattcctgttctctacaatctgagttgtttattttatattttcttttgggttttgtgctttaaagagaaaagatgtttattattggttaagggctatcacacacacacacacacacacacacacacacacacacacacacaatttccagattttattcaatattgttctcaagtaaaaagtaaatctgtgtagaaacccatatcggttttgattgtcaatgttattaaagcatagaggtgaaaagccacactttgaagtaaaagagatttaagatgaaatccctgtgctactgttagcaatgtgcccttttctgagcttcagttgccatcaatgcaatggggataataatagttcttgcttcattaggagggtgtagatatacaaatacaataaagtgcttggtgaatactaagtacccagcaactgttagctactattactctcacctgcttttgagcaactgccagtattaaactcactgtttgagaacttttattattttcatatataagcttattgcttattgaaaaatacctttcattttcctctactatttctagggatgctaattatatttaccagaatatatatttaaaacaacctaaacagcttattagaattgatttaatgtgattaagtgatatgtttattccacattatttctatgcagagaaaagaaatttcttaaggaagaaatatcccaaacaaaaatatgttctataatctatctatctatttactttgcgtaaccataagaccagtgttcattcatgaaaatagttttcttgtttggtgataacatatgatatgtgataactaagactcaagaatatataaaaaataatttaccttttcaaggaacactataatttactgaaaaatatcaatatgcagacttgtctactcaacctgcccaattattaatcctttaattattatcaatcactgggagaagaataatacaactgacataatcttctctaacatttgctacagtgccaatactttttcaatagtgtataagcctaaatattttcaaatcaacaaatactcttattcataatattaattttaagtgcctctacaaccttcaacattaattaaatcatgttaaaacacttgaaatatacaaaatatagattttcagatcattatttccaagaagctattttattagtcagtttccacactgctgacaaagacaacccaagactgggtaattataaaggaaaagaattttaatgtactcacagttccacgtggctgaggaggcctcacaatcatggcagaaggtgaaaggcatgtcttacttggcagcagacaggagagaatgagagccaagcaaaagaggttttcacttataaaaccatcaggtctcatgagacttattcactaccatgagaacagcatgggggaaacagcccccattatttaattatctcccaccaagttcctccaataacacatgagaattacaggaggtacaattcaagatgagatttcggtgaggacatagcccaaccatatcattccacccctggaccctcccaaatctcatgttctcacgtttcaaaaccaatcatgccttcctaacagttccctaaagtcttaactcatttcagcattaactcagaagcccagagtccaaagtctcatcggagacaaggcaagtcccctccatctatgagcctgtaaaatcaaaagcaagttagtttcttcctggatacaatagaggtacaggcattgggtaaatacagccattccaaatgggagaaattggtcaaaacaaagggggtacaggccccacgcaaatccaaaatccagtggggcagtaaaatcttaaagctccaaaatgatctcctttgactccatgtctcacatccaggtcatggtgacacaagaggtgggttcccatggccttgggcagctctgcccctgttgctttgcagtgacagcctccctcttggctgctttcacggcctagtgttgagtgtatgcagcgtttccaggtgcacagggcaagctgtcagtggatctaccattctggggtctggaggatgatggtcttcttctctcagctccactaggcagtgccccagtgagaactctgtgtgggggctgtaaccccacatttttcttctgcgctgctctagcagaggttctcatgaggtctccatccatgcagcaggcttctgcctgggcatccaggcatttccatgcattctctgaaatctaagttgaggttctcaaacctcaattcttgacttctgtgcacccacaggctcaacaccacgtggaaactgccaaggcttggggcttgcacccactgaagccacagcccaatttgtaccttggccccttttagccatggctagagttgctgggacacagagcaccaactccctagcctgcacatagcaggggggccatgggcccagccgaccatttttaattcctaggcctatgggcctgcaatgagaggggctgccacaaagttctgtgaaatcccctggagacattttccccattgtcttggcaattaacatttggctcctctttacttatgcaaatttctgcagctggcttgaatttctcctcagaaaatgggtttttctttcttcataaggctgcaaattttccaaacttttatgctctgtttcccttttaaaactgaatgcttttaacagcacctaagtcatgtcttaaatgttttgctgcttagaaatgtcttccatcagatacactaaatcatctccctcaagttcaaagtcccacaaatctccagggcaggggcaaaatgtcaccagtctccttgctaaaacatagtaatagttacctttactctagttctcaacaagttcctcatctccatctgagacaacctcaacctggatttcagtgtccacatcattatcagcattttgatcaaagccattcaacaagtctctaggaagttccaaactttcccacatttttgtatcttcttctaagccctccaaaccgttccaacctctgcctgtcacccagttccaaagtcgctttcacatttttgggtatctttacagcagcaccctactctcccagtgccaatttactgtattagtccatttttaagctgtgttaaagacatacctgagactgggtaatttataaaggaaaagagatttaacggactaacagttacacgtggccagggaggcctcacaatcatggcaaaaggcatgtcttacatcgcagcaggcaagagagagaatgagagcaaagcaaaaaagggcttccccttataaaaccatcagatctcatgagacttattcagtaccatgagaacagtatatgggggaaactgcccccatgattcagttatctcccaccaggccccttccacaacacatgggaattatggaaactacaattcaagatgagatttgggtggggacacagccaaaccatatcaactatgtaaatgcaaaataacaaacacacatcttaacaagacttcattcagctatgttaaaaagaaacagcaataaatgaaaaattaatggtacaaagagatgtgctagaattgcaacaaatctgacatttctgtgtttataacaagctcgtatatggtaaatagttgataaatgctatttatcctagaagaaatagaaagaattgggtaaggattgtcttggaagggaagagagatatttagacagaaaagaataaaattacagttggagtgttattcaaaagatgaaggatatcagctaaaaacaacaaaaactttcctttaccactagcacactagttgccatcactcttatcttctcttgtttataattgtctatatcctctaactccacttcctaatcaccactcaacccatttcaatttggtttcctaccccatcttaccacataaataactctttgtaaagtcaccaatgacctctgggttatgaaatccagtggacatattttagtcctcaacttgaccacttagatgtgggtgactccattgaccccttagttcttgaaaatcttctgtttcttcagcttgtattgctctctgggcctagttgtttatcatgcttctaataactacttctctgtctctttttgctggctcatcttcatcatccagacattaaatattggagttcctcagtgaatagtcacagactccccccatcctttttctctgttcttctttcttttcatctcctttccttattctaaattttctccctaagccatatcattcatacctatgactttatgatctatatgccaatggaatcttcacttaggtctctcatccagaattctctgaggttcagacttggaagtgtaattgcttacacaatattagacaattaaggatatctcaaaaatgctttaaaagaacctacaacataatatgtccaaaccaaatgagttatcctcctacacacaggcatgcacacatttcgcacatatcaaaatctggagttctaattgaagttcctacttcaattcaattttttaagtcagaaaacaaatggttgtttcaatatttgccccttcctctacctccccaccatatgtagtgcgtcatcaggtagtgtggacctgacagtcagtctgtcttgaagctgtctacttatttttatcttatctataacagagataacattgtaagtgttcattaaatccagaggcatcttcagaaattatttattgttggttaaaaatttaacatctcttggtcaggtaaaagaggttagaaataaatgcaatgaggatcaatatactaaggaaacagataccttgaagggatgggaaattgataagaggtagcaaccagcagtgagtcgataaaacagaaagggatttgcaaagatttcacttgcagtagattgcatgtgaatcaacagtatatgtctgctgattttttaaaaatcaataaaggatccataaataagaatatagtacatgaactctcatactaattatttatttcatattgttcttgatatatatttactggggacaaatgcgtatgacataaaatttgccattttaactatatttaggtgtgtaattcagtggcattaattacgtacacagtattgtgcagccattaccactacttatttccagaacttttttactacactaaacagaaacactacccattaagcaataactttctactagtaacctttaatctattttctgtctctatgaatttacctattctaggtatttcatataaatggaatcgtgaactatatgtctttttgtgtctggcttattttgcttggcatgtttcattaatgttgtaacataaatcagcacttcagtgctctttatggctaaataatattccatcagtatctatatattacattttttaatctattcataagtttatgggcacttgtgttgtttctgccttttggcttttgcgaataacactgctgtgaatattggcgtacaggtatctgtttgaataattgttctcagttatttttagtatacaccaaggagtgtcattgctgggctaaatgataattttgtttaactttttgaggaaccatcaaactcttttccacagtgactgtactattttacatttccacccacatacagggttcctctcattgttaatttttcaagtatagtattaattcagtgtttgataatttagaaatcataaagaatttgttgcaatgtgttaacgacattaaagaatttaaacacgaaggttaaaaagcatcagcacaatgacctggaaaaagacttttagtgtaaagaaggctatggaataatctaatatttattttcatttaaaaaaagattacatttaaataatgccctgtctttcatacatgtggattacactaataatccatatgaatattgcatccaattcaagttgttgttagggaatcagaaacattactctgatttagctactttttgttttgttgtattttgttttgtccaaggtccaaataagcaaaagtattcatcttgaatttactggctagattagtaatttgtctatggaaaatatcagagttaattgcctgctctaaaaataagttttttaaaaaattgacctgtttgaactaggtaagataattgatcacatataacgaacgactagctatctggttacacttttttctattcagtgccagaacaaaagaaagaaatttagtttataacacattgtcattatgaagttatgacagaaattatctgttttctaaaaaaaaaaacagttatattgtttctatctttgtatagaattagaattagagagatagttttgtaaggcagatagaggatgaataggatgaccttttaatttcccattttgccttgtgatttcttgattgttctgcactactgacatactgagtcaattttattgggatacaggaattttcattcttactgcagtgtatatactcacattgccatacgtggagaaaacacttgaattattatatttgggaaactaacaaagacttcagtgtcttataaacataggaagaatatcttgtgaatgcatatacattttccaagtctataaaaaactttagctccttgttttgatagactatcagcatatgagattctagagattgtataaattgggcagttctgctttaaaaaagctatttttttcctaatactatatcttcatttcctacaaattattttatctagcatagcatttacactgacgttcatggtaagatataaaaacattctccttggtaaatttaagaatctttttaaaatgtctgaagtagaagagaacataaagttttccaggttctctagctgaaagaaagaaggaagctctggaaattttctttttcttttgtgctaatccatgacaatatcaagattcttcatcagtaagtgatgctgaagcacccagaatccagggttcagttcatgggtattgaatcagtagtgccttaatcctatgtgcatttaacattaatattattcatgctttatcataatgtaattctctaactgaaaaagttttaataactccacagtaaatagagaataaagtacaaacacttttagtcttttttctcagaatatttggaactcattttaactctcttttcagccttatatttcactattactcatcaaatactcagggtataaaataaaccgtacattttactctgccttactccctacatgcccttcatgtaatcccagccaaatagacatgcctaactctttgactccacctataaaagtcctacttactcttcaagtccaatttcaagatcaaatgccatcatttccagtaaacttctctccgttcactgaatgggaaataattttcaccacattgccactaaaagaacttttgccactattgatgtatttttacatgttatctgaaattaaaattaggctttatgtgctttattttttctatttgtgagctccatggggactaggacaatatattcatcttggaacttaccaaaacaccaaaaaaagtgtcatgcagatagggagtactgaagtagagtttattattttgaattgaatgaattttacattttcaagcatagattataaaatgttatttttaagaagagtaaattttattattcattaaagaaaataattaacacatgggtaaatcacggacatcttttgaaaacagtgtaggctaagtgttgtcagtgttttagaacagaaaataacatgaaatggtaactttctgaaaataactttttggtttattatcaagttatacatttattctataataagaaacaaaaacatccataaaaatgaaattaattttatttccaatatcaacaataactcccatatgtaccaagtttcacttctaaccccacaaagtagtacatagtttatgtatttttctgtacatatattttatgcattttttgtacatatatttttgtgtttaatggcagtttatcatgaccttttttatcttgataaatatgctcctcaaacattatttttaatgaatgcctagcattcctttcttatctccataatttctatttttggacatttcaaatatcctaattttttactgtatttaaattattttagcttcatttatgtaatttaatcattagctcatcttggactattttcttgagattaattcctaaaaatgcaagtgttcttcccaagacatatgtgtattgttaaagctattgatattcactaataacatgcccttcaaacattttttattgccaatttcttttggcaacagtagtattttggaatgcccaatagtgactgtgttaagcaccctatttctgacacaagttgcattctctaaagtgttcctcaaaattgggatatggtacaattcttatctattagatattgaagtacttgataaagaaaatgcagttggattaaggatataataacttggatccttttttaccttccattttctgcatatatgttttggaattagttttattatggcacatgaatggcatgtagtatatgatgacttagtattgcaaattcagaaatgccaactgaattaaagaagctttctagttctgaagttaacttgcctaggttcaaagtgtttcctgccacttaccatagtgtgatgttggacaacatacctaacagctcttagccaccatttcattattcacaaaatagaaataatgacaataccttcttcgaagggtggttgtgagggatagatgcaataatgcatataaagtaaattgctcagtgccttccaactagaatgtcttcacaaaataatagctgttattaattttacctataatatttcaaaaatatctgcttaaaatacaggctcattacttgatagatatgctcagtaggtggttttatttattgtagaatgtatattacataagggggaaatgtgaaaaataatattaattttatgtgtacttcagtaacacttcataaaatatgtatataatcaacctctctatctcatgaacattgaaataatttggggaaaaaacacagctttgtgtcactttagagtaggtcaaatgaaaagagtatgttgcccaacattactacatcaattaaactttatatgaatatttaaaggattctggtaataattcatgtgacaaaattcaaaagcagccttttcaataaatgaaaagtttccaggtcaaatctcttcccgacattcatacatattttcttgtcttgcgttaacatgagataacagtcagggttacaattttacctataactaacttaaagaaataagacaggtaaaaagaaaagaactgatttcatgacacaaatatagaattaaactgtcaagattcgaaatgttcaatatacctcatttagagtaagaattttaaattcaaataattttctttgaatatgataggaaatgaatgtattggccagaaatttgtgacaattaattgcagaatggctgaattgtaatgaaaggctctaaggaaaaaaaaatgatgaaatgaatgtgctgtttgctttcaaatcatttacagttgaataatttatgttatctttaattcatccagttaaattatccaagatgaatacaatatgaatagaagaggtttaaaattgtcaggtttttgcattaaaatgtttgccagtaaccactttctattttttattaccattttaatggtttcatatattgcaatatgagttagaagactaagctggagtatacaatgtaatgagtttccagggttataaatatttgacctatgtcttgagacattaaaagaaaacctcttatgtagataggttatgtattcactcaaagaaaactaacctaagtggaaattactctgatctgccccctaaaatttcacccaccatattctttccctttctctgaataacagcattcttcagttgtttatgccaaaaactttggagtcaacctgattttctctaaacgctacttctgtcagcaaatcctgtcagaagctacctatgaaataaattcagcgtacttagaaatgcctactgctacccccttttaccttaagccaacatcaacattttatctcttgttctctctctggattgttaaaatagtctcttagttctccctgctttagtggttgctttcctttgctttcttttcaatacaaccatcagaatgtgccttcataatgaaagttggaaagcgttagtcctctcaaaactcccggtggcttttccatcttgctcagagtaaatgccaaaggtcttataataaacttcacagcagtatactgatctagacccgctgctattcctctgattttatctcgtagcactatctttctttttccctctactctctcaaacacaccaagcatgccctcacctcaaggctatggcatctctgcatataaaacaaagacatacaatttctcatattccttctcattctactaatgaccccaccattgctttgattcttaccaagagagccctgtaatcaaggtctaaatgtgacttaatttacggttcatatagcattctactaggttctttacctgaagagttgaaaacaagactaccttcctgtaagcttacttaacacaaagaattagatactgagtcagaactcaggtttcgttaatgtctaattagcaaaagaacaagataaagtaggaaggctagatccaagtcctagttgaactaaatgattactgtacatctgaaatggaagcaagacaaagaccaattattctaaggagaaacaaaagagggcagatgtcttaaggtgaatccaaaactaaaaggtccatatccaggccgtaatccaagcagaggtgtgaacaggatatgagaaaaaatctaatacctgtcattggtgaaagtacttatgagtggtcagttggtactaagaaaggggcgtggagaaaggaaatacgacagcaattgtacccactttgggatagtgatattcataaaaagaatttccttgggagcagggataaacatcagaaaacagagttttagaaaaagagaagatcaagaagtaccacgttcgatgaaacactgagttataggacagtgagtatcattgatagaatagaatttaatttctgagtgtctgggcagccagctccaagtctgaattagtgagaagtcactattcccatcattaatgtccagagtgacccaaagtttttgggaaaaactcaagtagtcccagatgcagtattccacaccacggaatgctcatagaaaaaaaaaatgagtttcattttagggatcaactacaggttgcaattttcaataggatggtcaagaaagacattattgaggccaggagtggtggctcacgcctgtaattccaatactttcggaggttgaggtgggcagatcacctgaagtcaggatttcaagaccagcctggccaacacgacgaaaccccgtctctagtaaaaatacaaaaattatcgtgccacctcactccagcctggcgacaggtgagccgagatcataccactgcactccagcttgggtgacagagcaagactcgatctcaaaaaaaaaaaaaaaaaaaagaacaagaaaagaaagaaattattgagaagatgatattaaaataaaaataaaaggaggggaaggagagagggagccatggagatatctaggagcagagcattctaaccactggggacaactgcaaaggtcctgtcttaagaattgcaagaaggctagagtaggggagcagagtgaggagaaagagaagcatggaaaataggcttggagttgaggcacacccgtgggaccctatacacaaccatggttaagactttgtgttttattctgagtgaaagaaaatgctccgagatggttttttaacagaagaatacgtgatctgtgtgctggtgataagcttgtaagcatgtcctttattcctggactaaccactgcaaaatggttagctaaaagctgaaagagaagtaaatgcaggcttcattttttttgtttttcttttttatgtgataataggttcttagtatatgagcttcaataatttgtgcatagtgttttatatacctctcccagacatactatttattatttagctttctaattccttctaattttgtagcttagtcacgccaaaactaagttaaatcacatctatggagcttttgtatgtgccagacattgtgctgtatgctttatatgtagaatctcatttactcttccaacagcacataataatcatcaccaccattttattgatagggaaactgtaaagcacagaacttaggaattccagagcatgtatcgtcaccggagttaacatcatacttgtttttgtggacctgactgtccccttcagatattttctttaggttgcctaatatttcgttacaagagagtacattctccaggctgactagatgtctaagcgagaagacagtctgcattttcagtcttttgttatagcatgagatgctgcctgggacatagcatagtcagtctagtgattcaacatatgtacaaatgaatcagaacacagggttcctatcccagctcatccatttgccagctgtgtttctcactttggttctttataaaataacagtacctaaagtaggattcaagccctattagattttgagatcacattttaagagaaagaatacaaaattaggcatgaaagtgagtatttattcatgtagagaaaataaaacatagcaaaatatgaattttaaaaagttaacaaataccacacaaattataaactgcagaaaaaagtaactatattgttgttttgtaaataacatgatcctctagagtttttttcattttttaatccatttttggctatatattcttcaattgcctctgcacatgacttcaatttggtaatatcacacaactaattacacggtaaaattattttgggtaataaccccagtattgttctcttccagccctgcagtgaaagctgcccatcagactctgaggaggctgcataattaaactctactgtttcactagctaagctgctgaaacacagtaaaccaagtcctgggaaatttctttttcatggtatacttaacatcccatgaactataatgtgatatggaaatccagtttgcaatgctctgttcttcataaaacacagagtggcattattctcaagtacagtttataataagcgagaggaaggagatacagctggtaaaattttgttctactcacagatagctaagaaacttcatgtgtctccataaaggagtaatataaaatttgtgcaaataagttgcaaattcaaaaggaactcatataaggaaacatatttgtgatggtatacactcctgaatacttaacattttgatcaccgtgaactataatatataatctgcattttatggttttctggatgcttggaaatttcaggagtatttaattttaaaaagattgtcaacatgcagataaaaaatcagattattttacatctataagtgaaaccttgttatccccttcatttgaggaaatccaaggagttttaaacagctctactttactggctatctctatacttaagccactagttggtttttggtttgtttgtttttagcatttaatattagtgtgtgttttcccataacttaattaccaaattaataaaagggtcattcttcactaagtatcacagtagtagtgagtgaagatagtcattctacccaaacagcctttgttcgataaggttaagtgcagtaaccagaagttggaagtatagaagatgtgctttgaaaatgcatgctagaagacttcggtcacagtgacatgacagaggattgttggaaaataacatttgaagtcaaactttcctgaaagcccaggcatgaggcaaggctttctggacaaaagtttccagcagaccacagtctgacacaccatcatgaacaagatcagattttaagcctccaagccaatcaagaaattaccttgaaatgtgcgcagtgtattttaagtaaaaccagtctctgtaggcactcaatatatgtttgtttaatgtaattaaatttgaattaaattcagtaaggctggtttcctaatataaaatatgaaaaggcttattgaatttcaaaattatttttatggctattttaaagcaattactaactttgataataaaagtgtgaacaggactgtaattcattattaggctggcacttcttactgtgggcatttgtcaataacttttctggccaagatatggggtgatctttggaatacacttgagtaatacatataaaaacagtttgaaaaaccaaaagctgtctatattttttccactgatctatttgtcaaactatgttgattcagaagcactactgaaccaaaatatgccatcactcctaagatggaaaaaaaaaaaagcaatcccatcattattatgtattgtgggaatacatatgcatgggagtaaaaccctagctatttgtgcaagtttgatagacagctaataattaatttgatagttgttcaaaaaaatcaataccaaaaaactgaagccaacttctgtaagttgtggggcttcgtatatgggccatctgaaatcgccaaataacctggacaatttaagttattcttacataattgtgaataaagaaaatcattttgttctgagttcaagggtttagaaaaacagagcattgccaacccaagaaaattcgaaacacaatgggaacaagaaatctatatgcaaaagtgtctggcttgaataaaaaagtaaatctaaaagctgccacagtatctaatgtcctaagcctctcaaagaattagttcatggatttacttactgtcaaggattgaaacctacctagacattatttaggtagtaacaaataaacacacaaacaaaaatatatttgttggttactaaggaatgaaatttacctataatagttacccagagtttcagttcctatttctatgtgagaagaacaaaataacattttgtttactataaagattgaaatggtaacaacctgaaaagaggaaaaaaagggaaggaaaatagggaaggagttctctgtggactctccttcaactgagtgtgtccatgctttgtgctggttccctcagtatgggtgtcctatgatggtacctggctgtctttggagaatatgaaccaagtactaaagtggttttggaaggtttgcattgttgagagtttcaaaaatataatacctctgttttaaaaaaccaacgccattaagtttcatgcctggtttctataactgaagtactctgaaaaaattcaaatcaattttttggtgaataactaaactgaataaaatgtcatcaaagtcttctcaagacttattctaaaattttgtagtattcactcacatacaaataatgaattatgatgatcggctagctggcaaagatgtgcttttagccatcctgctgtccttcctggaggtaccattttacccaggagagaaaatcttcaggaactgcagctttattgaactgccaatttagctaatttttatttatttttcaaactttacttttatcatccaattgagagacgagcagcagatggcttctgcctccagctcagctgccctgctataaactaaactggaaaacatggtagtaccttggttctcccttattcgtaaatctcactgtcaaatcaggaaacgtctactggcaacctcagagtatttcctttaaagacagtcccttaacactttcctactctcgtttgagcagcttgtcttgtcagataatgaagaaattttttggagcaaattattttaattccgaatggcagacaaatcaattactttgaaaatattggtttcatattgaccaaacatgttcaaatattaaacacacataattttaaatattctttttcaaacagggaggtcaaggtttcattcaaataaggtttgaattgacgttgttttgcttgatagaatgttacctggcactcactgagcaaaaagtcacttttgtatttaaagaacatgtaagctagtattttatttcactttgctattgtggttaaattcaaatttgagaatattatttttagatcacttcctagccaaaagcattgtcaagtgatgatgtgtactatttaaatagaaagcacagaattcacgacattttacctcagtatttggttaattgtggcaaattaattgtcattcaccaaatgcttgtgacctttcttttcttcattctcccttccgtccaagctgctgttgaaaacagagactgttgttatcacttaataatactttggccaagtgtaaatgtgatattatacgtattgtgcctaggatcctaactgcgcaccttctttaattcatttataaaatttttaggctaatacgagctttgaatgcaaacacattctcttcagtgatatatctgtatagtctaattaaaaataaaaatataaagaccttaataaatactaataatggaggtcaaagggcacatagtgaagtgcagttgagaaatgacgtgacctgtgtatttgtcttattcctgctatatcgcataaacaggagaatgaattgaaaattgtaattaagatttattccattttgttaagattaaaaatgagcagtcaaataattctttctctgagagaagagtgtatggtaggtccattgagggtgtctgttgtatcttaaaatctattcgaaatgtttgggtgaattattgtctaaattgacagatgattgcttttgagctaacaaaatatttctgttagcatagctaaagaatatatgttaaggaatatatgctctttgtaagttttgattgagtagataagatgatacagacacatgaatcaggaaacaaatcaacaatcaactggaattacaaccaaatctatgtacttctgttgtgagatctttttacttgcaatcctttgcaaaacgtgctgtgcacaatgtagtaagtatgcttgtaataaacaattaaaggagcttttcacgtgtagaagtgcacgcttaatttttgttaaatcatctcaataaatacttataagtgaagccaacatgattttcttaagttttttgaaaatgtgtgtacctataactgctgtgctatttgcaagaggcagtatacacacaaatttgatgatttcattctttaccaaatactatatttagcacattaaatactaagaaatagcactaaaatgggccgggcctggtggctcatgcctgtaatcccagcactttgggaggccgtggcagacggatcacttgaggtccagagtttgagaccaacctggccaacatggtgaaaccccgtctctactaaaaatacaaaaattgctgggcctggtggtggatgcctgtaatcccagctactcgagaagcttgggcaggagaatcacttgaactcaggaggcggaggttgcagtgagctgagattgtaccactgcactccagcctgggcaataaaagcgaaactccacctcaaaaaaaaaaaaaaaaaaaaaaagagagagagagagagagagaaggaaggaagaagaaaagaaaaaaagaaatagcactaaaatggacataaaatatatattggtgttttagaactaattttacaaagactgaaatttaaatatacactcaattttaaatttttaaaataatattcagaataatgggttcatttgtaaaacaaaattgtttgtaggcataaaggattaattgaaaaaatcagtcatgcaaggaatatctcttatatgtagaatgagtattaatttccaaatgacattttaaagaaacctcttataatagtaccctttaaatcactaaaaattaatctagcatacagtcacatgtctgttgttttgtactagtgctccgtctacatttatgtgtataaaattttttaattcagttgaaaatctctttatataaaaggctcaaactgtcctttgaaatgaaacaggcccaatgaatattccattgatttcattgtaacattaatgggggaccaagtcatagtttgagcagaagagaaagttaagtaatatcaaccgctttgtttttcatagtagaacacccatccaaatgccattttcctgccagtaagtgttctgtagagcagtgttttaaattcccataataccacttctcattatgaaaacctcttcacaatttaaagggtaataacagaagactaagccactacaaatgtccaaaacatcttttaagttagtcatatgacctctgaatatattaatatcttaacctcaaattagggattatgtcaaaaactaggaaggatacttctcttacatacattttatttgctgtatatttattatttatttgctaaatattttgtcagttaattatttcttatttattgtatatttaaagtaagttactaaaagctgcgctcccagagtgcagaaagcactaggcctgaatttagaagtggtaggttgaataactgatatttctagctttgccattagtttattgtgaggatcattttggaaagtcttttgatctttgcctctacaataaattagtaacaaaattatctgtattatgaggatttgtgttgttgttgtttctttatttttgtttgaaataattgttttctatatttcttttgctgcaggaaaagttttgggtttattgtgttttctcataactgtataattttattttattttaatttacttgtgtgtctgtgcatggagatgagggccttgctttgttgcccaggctggtctcgaattcatggcttcaagcaatcctcccaccttggcctcccaaagtgctgggattacagacatgagccaacataactgtataattttaatattgcaaggaacactcttaaaaataaattaggaccgggtgtggcagctcacacctgtaatcccagcaatttgagaggcttctctatggcttcaactattttctcttacccaagttgccttccaagctttagatttgtagactctaaaggaagaagcctaataggactctgcagtctacacagaaaggaaagctggctgtggataactaagaaccacatggcaaaaaaaactagtcattgggttctagaggagaatacatccatttctgttgctagtgggatgctggaatataaatttttcaaaaatcctttgtttaaagccaaaaactgctaaaaatagcagtaagtttgaaacttaattattggaagcttaatagctccctctccaatgtatacactaacaattgccaactgatgtcaacacaaattgtgaacatgcaagaaaaactaattgttctatattattttacagttattattgattatcatgccctttgcaaatcaagaaaaagaaagtgtaataattcttaaggtgaatttaacagttactagaggagaggaagcatgtttccaaatactttcttaatcaaacattaaaatcacaggcttcatttaaagggtgtcaaccaagtataaataaaattcgactaaattttcaaacatgatctctgatcacatatagatagactggtttaagaagagacttctttcatcaagtttgaaaatatttgttttttttctctccgagggcatcctcttcagccacaaatagcttaagagagggtaaaaattgaggtgtgtagattgaccaaacacacacaaacacacacacacacactgctaagaatattttgtcctctggcctctggtagaatattttctaccattggcctctggtagaattttattgagagtattcagttaccacttgaaatgcgtttgggtcagtgcctttgaaacctagctgtatgtacatcacgtggaatacaagtaggttgagaagctgcatcacacattaaaatgagaacaaatgcaaagaaacatgaggagcatgataataaaagttgtatagcattcaacttttatctgtgttgtaagccacaattgtactcaaccctctcagtctaagctgacagactcaaaaacttcaaccagaatgaagtatctcaacatttctccttttcaaacacatatttaaataaagtggataagcttcattcaaaccaaattaataataagtacatccaaaagtaaccacattaaaatgtgacaatgtagagaattatcagaactttactgctaatactgtgaatctataaacaacccacaggcgtgagaaaacacaacaaaaacctaatcctggccatagcaacatggatccatgtgtctctaagaccagcctcaacttagatgaaaacgcaagtttcttttcctttcacttcgcttttttttcttttgatttctagtcttgtcttcttactgttcttttccctcttctttttcttttttttttaagaaatatattccttttaacattggagttctccaggtttaaacgtaatcacaaaggcttttaccttgggtttcaaccctaaaatcacagcagtggatctagaagtggcaaataaggtctgattgggccggggtctactcattatcagatgatacaattttctatggagattcctggtgccgtctcttttgtctggttctcattcagcaacttcaaagaaagaggatagaaatatcttacgctgttgaagtcttggaattcagatttggcacttgcatccaaatgtttcttgtactattttctacatggctaattatggctacgttttaaaaataaggaacacctagctttctaatatgtgatgagagatgggatattattgaaacaagaaagagtctgggagtcccaaatgaacgctcttttgtggacaaataatttataagaacatagaaacagaatttgagatgtattcttgaaaaaagttattaaaccagatcaaatactacctcgaaataaatacatagcactaaaacatcactatctccttgttttatttgtcttactacctgctttatcatctaccaacatttgtgtaacatctatttcttcccagtaaaatgtgagctgcaagagatcagggacacactgggtaaggagagcatctgtcttaaatgatatctacaaataaagctaaaagagaacagctcaacagacagcagagatgggcatctgcccaacaaaggccagctggagaaatatcaagagaaggtttctaattaaactcttaatttgggggtctatattgcttttctattattgctgtaataaattaccataaacctagtgggttaaaacaagacaactctattgtcttatagccccggatgtcagaagtccaaaatgaatcttacagggcgagtattaacgtgtgggaagggctgcattccttattgatgctataggagagaatttgtgtttttgcctttttcagcttctagaagtcacccccattccttggttcatagcccttcatcccaatgccttttccctctctgctcctttcttcacatcaccttctactcacttgatctgctgcccccttcttacaaggacccttgtaattacattgagcccaaccagatactcaaagatattcttcccatctcaaagtccttactcacatcagcaagaatgcttttgccatgtaagataacatatttatagattctggggattaggatgtggccatctttgagaggccattattctgcctactatagcgttcaatacaaacttccttcccagccagtcctaaatcaatgaaaaaatatatattgttgttgggagcactgaagatccctgtaaaatatggaacatcatttttttggcagtttttatagtcaccagatttctttttaaaattttaaataatctataaagtatctttgtgtaccacatacttgttaaatgtaaattctcatatggtaatataaaggaagcctgtatatttgaaaataaatatagaaaacccttcacataggaaaataaatgaaggagaatattggagagagtttctgagtagcaatataaaactttattgtgaaaactttattgtgattccattttttttccactcattcaatcagaaataggagaaaggatcacactgaatacaataggaattgtcccttgaatataatatctagccagtcttctggaaatattatttttgttactgagctttattgagggaaagagctgttagttaagggttcaaatcctgggcaagtacctagacatcagttgtttaagtttctgatgaagaaagcaagccgctgtatgtttttaaaacttttaagaggaagtagtcacactaacataaaagaaaaatccttctgaagaggcagcaatacacgtctcctggagtgaggacagggtttcagcacctaggtgtcactgccctttaggaattttatccccatcctttcactccagttttggatattttggcataaaaggcacatagcagttcatagcttttaatgagttggagaattacattgaaattcagtactgtgataataacctccaaattaatattttccttcagataaattgcacttgaaaaaaaaaactaatcttactgcccataaagtgacgtaataaaaccacaatgccaactatagcatgcaaaattctcccagcaaatgttacagagacagtccactttctgagtgtttgctctttgtgtttagctattaaaataagggtttaatttaaaatgcatgaataagcttcttacttgattgcagacaagcaaaggaagtaaatattgtttttctttctctcttttagaaagcaaatattcaacgcttttctttcctttgtgcaattgcaaatttagtaggtgtcctgggaatgtaaaggggagttaggggcaggggaggagggtattgagcataactgttcaggtaactgatctaatgtcctgatcatctctgtgatttccctgatgtttctgctactgtgtgactttcgcttatgctgggatttataaccctgtcattcacgaataggtgtttgagaggagccattaaacaaccatcaaagcattaaacagatacacacgggggaagtaccacaagtactgccataagttgcctggagagaatcgctaagcctggcagcagacgtgatactacttggagtaggaatctggggagctgagagttgacaacaatgtccagaggactggaggtgaaagagcaggcagcttgagtgtgtgagacagatgctgctttcaccatctcccacgtgtaatattttcaacacatcagtggagcattagagttcgtggcatgcctagtgacaggaatagaaccatgaaattgtaatgtcttgccagttttaagatgtagatgaataacttcttgtcagagcaatgaagtctttcttatcctataaaaaatccacatataactaatgagactcttgggccatcatacctgctctgttcaatgtcttacactgatttggctgttcaactacctgtggcatttggaccatgaagacaggtattttccaaattgattaacgctgtactaaatttgaatacaaatgcctacatctgagttgcatcctgaatacaatgggcaaatttgacatattatataagctattcctggtgctcctacatcaatgatcagatttccatgattcctttcatacagaaaacataaaaattagctcatgtcacacattgtggagggagactagggatggcaagatgtcagggaactgccattttgactgattgtcctcctggcaatttattatgataatagattgctttttattatatcactgcatttgactgtgatgatatttaactactgaagattaaagacatgtcatgatgccaaaggactttatgaatggactagtacattttttccacacttaaaattaataaaacagacaatcataaaaaattctggaaaaactcagtcactccactaaagaatctacaatttttgtctttcagcatttccttcagttgttgagccaatacatgtttattgtttactttttatatgatagcactaggctaggcaccactaggccaaggcacacttgaccataaactatgaccccaatctgaaagattttacagtcaagtttatcattcataaggcaagaggaaagaatgcaaaataatatataccatttctaatttgtatgctatagaaaataagtgaagtgatgcttacagaaaagagaagcagatcaattatggatagaatgatgtagaacatcattgcagtcaactggtggatggatagaattctcaagaaaagagaagagaagtcatcttacatagggaagtcaatgcgtggagaaaagaatatgcttatgaggggaacagataagaccatttcttaagtttaagggttactgtgctccagacattgtgctacatgatttatatgtcttttcttatttaaccttctcagcaattctgtaaagttatgtaaagagttatggtccccattttacagatgagaaaacaaaaccttaaagaggttacgtaaagtcatacagcttggaagaggaataacttggtctgaagcctggtgacatgactgtgtgtcggctacagtgcaaatagtggctacatgcaggttcagtctaggatggtggctgtgggaacccagaggtagacccaaatcgcagatgctgttctcacgaaaaaatggtcaggactctgtgggtatggagaaatacatgaagactgtcaaagattctaagggttttactccagaagttgggtgctgactttaagacccactcaaaaagagtggggagagtctgttctctgagatcctgcactctctggagttatcacagaatttcaagagcaaaattatctgctgcctagagagcaatattcagtcatccaaacctttggggggaaaaaaagactaagattgtttggtccctaggctgcttacctaattcttctatcaaataactaggtcaagtaggaggatgcttgggtgggattgaggaaaaaggcctttcctgagcctaaagggatttaaaaataaagggaaaagaggttaggaaagactgtgctggagcctagggagcaagagctttgtctaggtaccctaattcagtgaaaaaaatggagcaattagctgaattggagcaattcaatccccaagcgtcacttttgtcttgattttcaataagtgtacttaccagacaaatgtctactgagtacctcctatggaaagtggcttaagagatacaaatatcaattagatacagattccatcctcaaagagtttattgatatttatgggaccacatacccataattaaccctgtaactggggtgaacatgattaatagcttgagctaggcagattaaattatttcagagctcagaagagaaagacttctgtaagaagggacaagggtaggtgaaaggctaagaacagaaggtattttggaggtggtttttgaaatgtatgtgataggctttggacatttagggatggcagaagaaaagaaaccaattttaggcaaaaggaatagcatgaattaaaagattaaaaggtgggaaaacatgaaatatgaatagggaacaaacttgagtacttgggtttgcctagagagcaaagaatacatgagtatttcagaaaatacaggataattgattcaattttgcactatattctgcatatcgtttcatttgtagcagcttatgctgacaccatcgctatagtggtgcccataatgttaaagtcaactcccctgacctaagtgttgctcattgcttctgccagtcaggtcaggtgacacccggccctctttgcaaattcacagaggtgatttggaaaaatgcagacactccatcagctaaaaatccatcgaccgcatatttccccagctattggacatagtcaacgttaatagtccatgtaaatagtcagtgttagtaaaggcagtgtgagactccctttcccacctccctgttagtcttctacatcccttcatggattcagtcttttcttacctgtgggcacaatttagcttccttggatgtgctagaaaaaaaaaaataactatttgatatgagcttatggtaaatttctagaaagtgataaaattgatgtctatattcagaggccctacaaagaaactgttttctcactgttgagttaccgacaaaaaaacctgacactgaaatgctgcagtttcttagtaaaccaggcagctggagggctatgaaccacactgaaaagagtttgccttttctaaattagtgttttgctcaaggggaggagcaggaactaattgtagtaaatattgcctcccagcatttaattctttataagtaaatttacttttggtttaataaacacattatttcaccttttatattcaaatgtcgtatagccaaaatatataatattatggttttcttcttaaaggtattaacagaggagtcaacagacagtacagggatctgagtcagtcaagtatgagtatgatatagagaacttcctcagaagagcatttgtcagtgtcacacccactgtacattaaacatagtaaagtttataatataatcttgagtctcatttattgtatctagttataacggatcagctcccttttcatttcttctttaatttcactgtggtaacatgcttgagtgaattcagacatggtacatttaaccaatttggcagtatgccttaggctttttaaacaaacaaagatttgacgggctgtctctaaactcgagcccctcaggtaattcttgcagctgtaaatactacccctaaggtgatttttcactgtactgttgggacccaggatgctataagaaagtgaaacccacacacttcaggaccaatattaattcctcagatttctctcctctttttaagctgaatgttgtcttccctccaacttatgatttccgcaaccctggcactgtattgaattaaattgtaggctgttttttttcactaggtgttgcatgtacttcctaaaagccatcatggttggggattaaatatcttgcaaagttaagacatagtgaatgaattactctatcgtttttctgaatgaacagacaaaaccctcctcatagattagttaactggatttttttcctggagctccttcccagagtagggtataaataagtatatttgtttataataaatacataatttatataaatcaatatttacaataaatatataatatattaaatacaaatatctttttatggctttataaattgagaatataatttaatgtctgaggtgaaattttttaatgttgaaaagatatatacttcaattattttcttcttaaatccaatctagcaaatgatgcctaacttttattatacataagtcaaaagggaaaattggcttttaatgtattttcctaccatgtttaaattgcaacactatatgctaacaaaataaaaatatttcaaagcaagtgtcttgagaggttgcatgtaggccaaaaacaataggaagtatattccacaatgaattaaagacgtgtgaacttaaggttgcttgtcccctgggtaagagatttgtcttgttttgtattagcttggcacctaccacaaggtagatggatcataaaatttgattattactatgaactttttttataacccaaacttatgacccatgaacaccacctcatctctcatctaacagccctttaccttttttgaagtgttaccaaggtaatacatactacaaagcatgcacaacaaaagagatgggaattacaacaggaatatttcatgggcatccaaattgtaagcaatttccataatcagggatttggtagacatctacataaaccttgactcaagacaaaaaccttgtcagaaggatattattttctaaagaaatcaggttaaattacaggataattgcagttatctttacgcatattatttgtggaggaaaacaaaccttgaaatgtgcttttatatagactttatagtggctcactggtattgcatagaattatgaaggcaaaaataagtcaaccaacaaccggatatgccaaaagcttagatgctatcagttgtggacagatatcaatgagtcctctagccaactattattaaataattgcctttccctaatatcattaatggccgaagatacagatttacacaaaataacaaatttcatctttcctataatgcctttgatctttgcaatggcctatagtattgatgggagttggttttcctaatgagggaattgacacacagaaaaaggtaaggatttactaaagatcatagcagcatttcgaagttgctcttcttcgcttttgggaaatgaatcctgtctatatgaatatatcctttgaaatgcagagttctctagaatactaattgcatgattagtcaatgctcctgtgagatgatggtgaaagtcctctcttaagagcttcgtgatcagatttgtacatttgtatgctaggtttctctgacctgactttgtttactgaattctgaaattacctcttttgtggtttttttttttttcctgcttctatgagttcactttctatctccatagatatggatttcttcatcacattcctctttaatgtggttattagatatagagtgcagaagatttcatagttgagatagcgagatggaaccaagcacactgttttgaggtttgcaccctcccagtttatctcttcatatggctgcctgggatgggatcatgccttgccatctttaggagcaaggcctttcagctgctgtcagattcatttaaataacccacagtgagtgatgcccgactatgtggtgctgtttgatgtgcagaaaatgccagggtgcatatggagagtaaagccctgataccttgtttatctcattttggcctcgccgaatgtgctgcctctccccagcattccatctcaatttactgaggaactgtgagctcaaggaacttatccaaagtcacacatgagtggcttaccagaattcataccccagaactgtcatggttcctaaatcctttattatgagcattataccataccatctccaggtctcagtattaacatcatgtaaatttattctccagcatgattcattaaaatgaaaatgggccattctctctgattctccaagcacttcagaagaagcgttacatcctgaatacagatttcatttctgtgaaggagacgagaaaagaagctaaacctttgcttgtattggaggctggttcaatttttaagggcttttatgacagttttcagtttaaaatatttaaagaaaagccaagcagtgttaaggttaagaacagctacaattgcatttttaacagtaggtaaaacaaggaaactaaaaagtgcctgtaattcagtggcaaaaacctaatgaatcccctctggataaaatgttaatgtaaaactaaatgaaaaagaacacaatcaacctgtgctagacacccactcacattttaaaatgctttttgtcatcataaaatacataagcatcaaatgccttttttggcggtatctcattttttgtttaacgaattaaaataatattagagcaaccacttatatgtagctcccagtataaaacaatataaaaagaaataaaactcaacatataagcatgtttgaaattatagtgaagaggtagaaaggtgaaaataaaaagtggagaaatgtaaaaatgtgattttatctttttcttctcttcagtaagagtccttccactttgggtccgttcttctttttaaaaaatatagagaatacttgcccttttttttacatggatgcttaggttaactattatgttcaacaaaaggcacttattaagcacccatatgtgccaagtagcagaattggcactatttggaaaatatcatttcctctctcaaggaagttataattttgctgtggaacagagaatacagagaagaaaatgtcaagtaagtggcacacacagtaaatattgcgggtgttttgatgagaaatgcatgttacagcaaaaaaatcagccttccaaatcaaagcagaagcacaaaagatggttacagacagcggaagagcctgactttagggttccgatggacctgtttgcaaataccatctctaccacgatgagttgtgtgatgttgaacaggacttattccccagatacaagaagggatgatactatctacccaatagagctattttgagtattaaattagaaatatacacaactaactttcccatcaatggtaacaatgattctagtggtggtagtaataagagcatttttcaaactcctggaaccagtgacttgtatagaaaaagctctgaatgaatttcaattcccttttctaagaccccttttacctgcaacaccatctaactctaattgcatgagttgaaccttaagtcaaaatagatcctacaagtttagaattggagacagacatttcatatgtgaataaagagtaaacaaagtctggaatttgaaaatacaattagggcctttaagaaacgatgaacatactagattcagggggtaggtgttgattgtaaagtactaccacatgcgttttgaaagctgatgagctgtctaaatactacatatggtaaccgctatgtagaggatttttttctactacttgactttgaaataacttttctccatatgcatgccaaattaatatagcagagggagaagttcaattcagttcacttcatcaagtatttataattgcagaatgccagaaaaggacatttttcttgatcaacatctgcattccccttccagtaagtcccaatagacttactgtccatattgctgttttctgcataaataggaaatcttggaggtttggcctctatactctcctgaaaccacatatgacaagtagaattgttccttgatacactgagtttagatgattgccccagccttcagatcacctgatggagagaactggggacagactaggaagggggcagtgatttttaacaactgggtacaaaagaacacaggcagagccacattcatcagtcattcttctactcctccctggacactacctactacaaattttgccttcctttatacctcccagttggaatcttgaaatttttttcctaagggcctgtaaatgtcacatatataaatatagggatttagcacataatattatagtattatgtgtccctaacgaaaatgttttaggtgacaagagcttcagcaacatcacagaagaacgcagaggtaatcaaaagaccatgttcggaaaaaaaaaaaaaatcaactctctaaaaatcttgttgatgtcgacacattccaaacgcaggaaacttaactgataaagtaaaatgttctatttagcactttgacatcttttactctcttccgttttttttgtaattgaaaacatattttatggttgaaaataaactgttaactcaagtgcatgaaaattaatttttaggaataacagtttggggaaatgcaccaaaataaataccaagtggagaaaagaggttccgaatctaattctcgaggaatgtcatttctctatagaatcccagtaagtaaataggcaaagcagttttaataaaagtccattccagagtaaacatagttaacaaacatacatatagaaagatgtttactccaggcatagtccaagaaacaaatacaatagccttatgatacacatgatttaaaagtttaaaaatgaaaaaaagtgacaaaatgttagcaaagttgcaataagtctccatattcatttgtttttggtagcattgaaaattggatgattcttttagaaaatcataggtgaaagatgacaagtaggtaatatttagcatgctaactctgactttctgtttaactccagtgctgtttggcgctctgtgctgataagaatcctaaagcctcgtgtggtcttagcgggaaagagcactaggctagacgagaagtgtgtgccacgggtaagggaacaatagtaagaagtaaggataaatggttttaacattccttgatttaaaaaaactccagtcctaagcaaatgtttcaaacaatataaaaaatctatttataaagaggttcatcacagaattaactgtaatggcaaaaaatgacaactttaaaaacaatggaaataggccgggcacggtggctcacgcctgtaatctcagcactttgggaggccaagacgggtggatcatgaggtcaggagatcaagaccatcctggctaacacggtgaaaccctgtctctactaaaaatacaaaaaattagcctggcatggtggcgggggcctgtagtcccagatactcaggaggctgaggcaggagaatggcatgaacccgggaggtggcgcttgcaggagccgagatcgcgccactgcactccagcctaggtgacagagcgagactccatgtcaaaaaaaaaaaaaaaaaaagggaaatcgtttaataattatggtacctcatcaatgattttcatgtatttaaaagtatgattttaaagatcatgttgaagacaatttcctccattcctccgttatatttttccatgtaatatgcccatatggtaagcaaacagaaaataataactaagttggttaaaaagcattaggagttttctgccactgagatcagttttgtatcatccctcaccctctggcattttaaaaaataatacttatgattccctgattctatggaaagaaaagcatattttagcacagttgattctgtagaaattaaatttcaggtatatgaatttaacaaattagcacgtcatcaggctgattgtttgatctttcttaaattagaattaataaggctggaaagaaattacttccagctcgtgcctctttatacggaaatttgctaatgaaacaaaacctcaaactacttaagtatgaaacaaattttcatgccctgcattttcaggcttagtattaaagtagacaagcttctttgcaaacaaatttttcagagaaatcttcaagactaaattacaaagcacactgcattttctgcagatttgtggtaaaccaataagctatgcagcaagctgctactagaaaaacaaagcgtatcactttgctttttcagtttatttatgtgtgttttggatagtccctagtattgcatccgaaaatacctgttacaagatgttcttactttcattgatcactgtcataacaaaaaattactgttcttgtaacatttctataccatctttctaaatattattgcaatgaatgctaattttaaaaaatactttattcagcaacgacaaataaaagcacaaaggatagttatcttttaagatttacctttaaatatcacacagaattacatataatgttttgcaaaatatttgatcaaaatgtttgatcaaatattttgcaaagcattatacataatgagaagcagaagatgaaaatttggaaatcaaataagcttttggatgtataaaacagtagcctaataagtacatgtatggggtttggaaaagagattactctatatagttcaagtctttattgtagtcaaacaaggaaattgtgagacatcaaactggtcatttaaatcgatatgtgtaaaatttgtgcagttgcagtgtctctggaaatatcaaattgacttactctctctacctcaacacaagcctcacaaacgtgtctctattagtccaatttcatactactataaagaactgcctgagactgggtaatttataaaggaaagatgtttaattgactcacagttcagcatggctggggaggcctcaggaaacttacaaacatagcagaaggcaaaggggaagcagccaccttcttcacaagacagcaggaaggagaagtgctcagcaaagcgggataagccccttacagaaccatcagatctcttgagaactcactcactatcaggagaatagcatgggggaaaccgcccctatgattcaattacctccacctggtctctcccttgacacgtggggattatggggattacaatttaacatgcactttgagtgggacacaaagcctaaccatatcagtgtccaagaaatgtgtgccacataagttcctaaatgactaactggagtaagcctatgtgatggtaaattattttgttataatgtggtctaattgatgtgagctaatatgccttaatttacattgatagtaaattactctattggactatgtcatcatcatttaaccatttataaaattgtatttgctctgccagcctcaattctatcaccgcatacttttggttatagaaaagaccagttctaaaaataatggtaaacttatttggattaagggaatctaatcatctttatacttatcatgtatcatggtactcaagcttacatatttttctatcttcctaggctgtatttacacaacacgatatataaataccaagcaatacacatgtttgggttatttaaaaactaataaaaaacaaggaatattttagatcttaaaaagccagtaagcaaatcaagaatttatttttagaaagctgatcaaagtttagataaagaaatgactgaggaatataaaatttggaaagtaaggaaaaatcattttaatctttatttgtacatatattagagtctaatactctaacaacaatacatagtaccacaataactcaaaaaataaagtttatttctccctcacaatgaccgtctaggcctgcagaacagatgaacagctttgatccacacgatcactcagagatccatgttttttctattatttaattctgttgggtcctctgagaaatagtcattgtaacaaatgtaattttacaaaaaaccttatttgatgagtggaagataaaacgaggaagaagcaaaattaggctacagaagccttccaactgtgctgcaggtccgaaaactatgaaaagaaagaggaaaggaggcaagattttgcacagcaaagctgagaccatcatgtaaatctggtgaagattaggtcagcccagtgtacatctgcagagcaaatattgcttattatagaagtctcatattgggcaaaaatgggctgaccctaaagccctcactgtgctcaatttttggctgtggctgcccaagaacaatgtggccttggcttgaaagctgaggtaaatcctgaaggccttaacggttgaaggtgctcagccaactgcctatcttgcaactacatggcaagctcttttcttaatgtgagatctgggatgaatgcctccaaggctgccatattatgtaataaagggagaatgggttcagggtacaccagctgttggcacaatatgcatatatatcccattagtaggaatagaatacaaagaaatattgatttaataattggttggatcctgctaaatctatctggaagagggctgtatcagagcagtgagtgtcatgtgtgctcttaagtttgagaaacatttatagttttttcctttttcagaccagaactgatatagtcgattagagagtagaatttgttgtcaaatttgtgatattttaaaatttataaacagacactacatagaatatagtttttcatttgtattgagatttagctgaaagaataagaaagagctaatcagggtcctttgcctgaattccccacaaataagctgtaatatggagaatcagcaaggataagtgatgaattttcctgattaaattaaaaatatctctgcaatgtatctctaacactcacagtaaaaattcttactctctattgctgtccagatccaactactagaattaattctgaggaaaaggaacacaagagactgggtttgaatataaatatttttgtccagatccaaggagttaattcagtgaagaaatagcttccaatccagagagataaagaataatttctactatttattgaaagtctaccatttattgacatatgtcaagatctttctatatgttgcatgtaatctcaatatccctgcaatcagtactgttaccctcatattacagatgatggaactaaggctcagagttttactgattacccaaagacatatggccagtacagacttaacctggtgttatactcagatctcagtcatccagaacccatcaatttttaattatgccattggctttctattaatgaacagtcctttggaataagcattctttccttttcttaagtgtttataattggtcagatttgaaaatttttgctttttaaaaaaagactatagtacagtttaaatgaatgtgcactgtttatggcagactctagtgcttgctagagtctgtttattttctagaattcacacacgggggtggcaaggagtcagatttagtttagaaaaaatatttaaataatgttttaagacatagaagttttgttaagtctcttataagaaatcagaacgttgtgcttatatatataaacatatacaaatatatacatacatataaaattgtatgtgtacaagtatatatgaacacatatgttcatttatatacacataaatgtagacaaacttgaaaacataaatttaaatatccatgataccttctgtatccactcagacattattatataattgacattcctcattcctggcctcattattgcttgatttaacgatcaagaagtagaagaaagacacccttggaaggttaataagccatccagaaaattagattagaatgatcaaaccttaatgattattgtttctcattataatagatcacctaaaagtttgaggaagaaaaaaaataaattggcatcattgggcaattatacttgtagttttccacagtagattttacggatgatcaccagttatgaatccttttcatatcgaaaaccagagtttttttatacattatacttccattattatagtaatcaaaggccatgtatttgatcatcatcataatggagtacttgaggcattttcttctttgctaattgacagttggtcagttaagaagtgcttttcacaaaatcttccataaccttaagggtttgaattagcttgtaataaatgcctgagaagctcctctagattcttaagtgcatttgctaaaactctcaaccgctattttccaccttctggtcaggaaatgcctttgatctgccatctagctgccttacttgcatatatctatctgtctcaagcattgtaaccctactcatcagcacagtgacacattaccatttagatatcattttctgatgaccgatttctctgaaaaagaaaatgaaatgctaacagtaggaaaagggtcaaactgaagctcggattgtcccatttggagaattgcaggaggtggtatgtagtcagaagactgagccctgagcttgatcttcactcccactttaattacacacctaagcacttcctgtgcagactttttggctcactggctgctccctgatcactcacatgccacttcaccatctgtggtgggacaccctgccccagagcctgagttccacaatatcaaaatccagtaatacaaaattgcttccttcaatttcactctccctgccacttaccaatgaggtggtgctagtagagggtgggcaagggagtgaattggagaaatgggataaatgaacttgctgcttttttaaaaggaagagtgcagtgcatggtcttaaagcatgatgatactataatatccatagtgacagggactttatttagctcagttttctctccattctgccacttacgtgtttagtaagtgttggtggagtaaatgaagacgctagagagattggtttatatcattgaattaaaaattatatctagttttacttcgattctctcatggcattctatttttaagtaaataaagatttagagaagatatttgtggtgcatgctcccaaatattaggaatttaattgatcagtctaaaacctctgttaataataggaaaggaagaaagagaataggggagacatagaaaggagaggacaataatgcatgtgagtttctcaaatataacagagcaatagatatttgagtaaagaaagcttataactataaatatatacctataaatactaagttggaaaaaaagacttttatctctgacaaaatttagtaattttattctttttcttatgtaataaatattccctaaatacctactctgtgccaagtaatgtgtggctgctaacacacagcaaaatgaaacagattatgcccacagagagaccacagaggtagttccttacacttttacttctttccttctttgcttccttctttccttctttgcttccttctttcctttcttccatctttcttttcttcctttatttgttcctcctttttctcttccttcctcaagtacagaatacaaagtccacagtatgaaaaatgaaatgcatccttagtatctcccgcaatagttgaattaatctggaaaagttagaaattgaaaatctctttttctccactgaagttagcttcttcagtgtgcttcctaatatttaaaataaatattttgcaattagggcaaaatatgttagtgacagctgcagaggctgaaggcttctatttattcagatacccatttatctccaaaatatcaaggcaatggcagattcccagcttatcattgcttctagatgtgaacacataattaaatctctatatgccttcgttttgctttaatctcattcctcaaactgctagtaatgagagacctgttgatgtcagttgggaaggtaattctttgtaggaaatttttagccaccgaaaatgaagtctgtcctattacaagtaatatgctgctcaagggtcccatgttgtctttgtttaaactcacagagcaaaatttatacatggaagaattaggcccccatgaaaagaaagcacttttgcaaggatatacatagtatgtatgtatatatatatatatatatatatatatatatatatatatatatatataatagtactgtactctgggtataataattaatctcagtggatgagataggcatgctaatccaaactataaatataattgcaaatatagaagccagagcctcggacagaggaaccaaagatattcattatagcgacattcatccttctgtgcctagttcgagtattctaatctgtggaacctcaagccacagtaatattgatgctcgtcattaagatgtttagagaataaattagaagacagctttgtttgagctcttgggatacaatgagtatgtttttattaattaaagttttctgttgtgtttgtttatttatcaagagaaatatatacaaaaataacacacatagacacaccacacatatatgatcatagtaagatattctctccacttcatgagaagatgaaaatggcagtcatgctatctcttattttataaaatttggaagtctgaaaggctctaaaaagccctgaattgggaagattgattcatggatgctattatataatgtattcgagttatatacttgttagagcagcactacccaataacattttttgtgttaatggacatgttcacagtaaccaccagctacatgttgctgttgaccagttgaaatgtagctagtgcaactgagaagctggatttttaattttatttaattttaattaatgtaaatttaaacagctacaggtggctactagcttccgtgttggaaaatacaaacctagaacatttgatttccattttttaaaagacttgttttgttttaataatagtaatttaaaacactgcttttagacaaatattaaccaaaaagatatataaaatagtttagttatcattcaataaatatttatagaatattttatgatcacccaacaaaatggatttttgatgcttgcaataagattcctcctagaaatttagagaccaaactcactacattctccaccttctcaccaccccttttcctcaacatatgaggttttgtaatttgtaatttaaaatgttaaaactaaatataattattacaaaagtgagtcaaaccttctcagaactaatagcagcaacttaaggcaggttgatactcaggtttggataaaccacaccaagtgacatattaatttctctactggcttcttagaagaaagatttgaggtcagaaaataaaggaactataggtacccactcttttagtcatctgactatttgatttatttgatgagtgatctcagttgaccctcccaggcactgaaccatcagagagttatgctgctttgtgataagaaaccttgagagatacctaaatcttcttttaccactgggagtttcatctattctggaataaagaacatttttatgtatggtgtttctatctagatagctgtagaaatattcagaaaagattcacagacttaaattcattctgacaaagatcttaaaattgtataatatttaccaagaatatattagataacaccttattttgttttatttttgtttcttaaaaggtgaaggaatggttaatgtattatacattgagaagtcaattaactttcattagcatttgtttttctgtattttcctcagagacaaaccaaaaaatgaggaatgtttctaatttgatctctggagtaatcatagatatggatattgtatcatttaacagacttactaaacaaactagtaggttttgaagtgtacatttctacgcaccaagaatgcaactggcttcttaattttcctgaagttctgaggctggtttttatttataatctaatgttgggctgctgatgatatatagtcttgagtttttaaataggagttaaatacaagtaacttgcttaaaaaaaaaaagttgaaatcattcccagctgcactaaaactgatgtgtagtatatgtttttaaaagcaggtttcacaagtgacacccttggctgttacatcctatcccacccacagattcctgtcaacatatagcagttttcactaaggagatttcattgtttatagtatactcaccttgccctgggattctgccaggtacagctgatataaaatacacactatgattaaaacacatcttccccatttaaaaatacctcacctgaatatttttttcatttatttgcacaaacccacctatatacacagaaatcactacctcaaccatctgaccctcttaagagtaaagcaaggtacatgttttatttggaaaccctttttaggcaaaggaatgtggttaacaacctttctctttgaactgcttgtcaggcagtgtgggagcagaggaggaatgagatttgtcatgaaagacagcccatgcttctgacatggaatttagcaactcaggtggagtcctcttcatttggagtacttgtgttgtgctggtggaaggtattcctatatagaggtggttttcctgaaaaaaatgaatatgatgcagtctccgtggactactatatagactaaatctcttttcctctcccttctctcccatttaaaaatgctgtcaataccagtgcttgtacatccatataatcccgtaagaatggtgcttcagatacacaaagagaaagcatttgagtatagagacaaaatcagttgctacatatcaatatttcacaaagttttaagtatttcgtttcattaacattttctttgaatcacaccacatatttttcagggaaaaaaacttcattttatctaatctaaaaatacgaatatgcatgaagaaatctaagcagcattgaggaaaaatgaaagcaacagtacaggatgttgtgtgggtatgaatttggtcaggaaacagaatgtgtcttgagatagaaaaaaaatgtgttgcttttttttccccttttggggataccctgaatcagccacaatctgatctttgtatcaaagtgctttaagttttttaaagtatgcatgtgaatgtagcttttaaaatacaggtgattattagaaaatatttcctgtatgttctgtgaaagtgaaattgggcctatttaaggatacaagaacttaggtatattcttgcaccttttttgatagttattatcaatattagctctatagaaaaagtaaggttaaattgttctaaatgttccaacagtttcttcctatcttctgctctgctagagagcaacacctctcaaaccttatctacttctactctcacctctcgtataaggctagcagactatatattccttgcttcatactgtattttcaaaccattttcaatgcaatccagcattactacccaataaactgcttcttatttgaagttcatgctatttgcctatgccacctttccccatactttagttataagctgctgaactccacatcactatcatttttctcagtgactcagcacgtaacttattttcatatttagtcggccctctgtattgtgggttccatatccatgaattcaaccaactaaggaataaaatatttgaaaatacgtggatggttgcgtctgtactgaacatgtacagattttttcttgccatcattccctaaatacagtataaggattatttacgtagcatttacattgtagtagtataagtagcacagagatgatttaaagtagatgagaggatgtgcataggttatatgcaattactacacaattttatattaaggaatagagcatttgtggattctggtgtccacaggagttcctggaactaatccctcgcagacactgagagatgacggtactcttttttagggtaaccaatcaggtagctgggtacttgagagctaatggtgaaattgacacgtttcaggtttctaagaaggtattaggtctgtaatatagacctcatcctacatgtaagaataagcagattgcatccgtgccacttagcctcatcttgtaaaatattcaggtaatgctaggttatgtaaagttaggcagtagtagaacatcccccaaaatttagtggcttaagaaaaccaaggatcacttttcactctcactacttgttcactgcagttggttaggcaagatgctatgtggggcagctggctctgcatattgtagtcaccagaggacctgggcagagagcagctatcttaaacattgacattacacctgtccccagtacatcagtaaatcttgtcagttctcttttcaaattacatgacacatttgacactttttactatctctctgctgcacagcctcctaatttggcctcctcccttacttattcaaagcattcgctcagtagggaaagagtgctcttcagggtctgcaacttgcaattacatgctataccctgaagtgaccccgtgtcactttccactcgacaactcattagtcagaataaataatgtgacccagtcaaccacaaggcacctaggaaatgcaaacttgccttatgcctggacatttagtacacaactttaataactaccaaagggtctatttgatctttcttctcaacattggccccatagtcctcagactcctcaacttcggtttaaccatctggacatgtggttacaccttgttattacctagaacttctatgatttaaagatctcagattctgaaatttctctctctgaccactagttcttacctctcaagccccatgctaagatggatataaaatatgtgtaaatccctggcaatgtgacaagtataattgcagcataagaaacatgccaagaggctagagatgaaggtgagatggtagggtgggggaaaatcatgaaagactttgaatacaatggtaaagactgtgaattttcatccttaaagcctttgaactaaacaggcttgtatcttaatcagacttatatttttaagaagtcattcaaaattgtttattaacctgtatttcatagttattagaaatacctcattggcttctaaactgaggcataatcttaaattatatgaacagcagtgaagccctacaaaacatgagtttcaaaaattttgtcattaattccatcagtgtgactcacagtgttatggtcagacggatcctttgacatttaaaatgcttcttggatttattattgttaccaatatgctttattcattcacaaatctaaatcatagtttatacctgaaaattttagcttatgtgtccttcaatattttgtataatgtcctaaaaacaagcattaaacaaaaataataatggtgctggttaaacctaaatcttcatagtttaggccaatagcaattttccccccaaacgtgaagacatatatatatatatatatatatatatatatatatatatatatatatatatatatacacacacacacacacacacacacatttttctaaatctagaaaaaacagggaaattgattaatttccaattatattataattaagttataaggcgtttaaaaatagaaggtccatgaaacttgatgcagctaggaatgaaagcagtttgaatttaaaaacctaaagttgaaaaaattagcctcattaagaagttctaaatagagcattgttaatttttaaaaatttatctctttgcatttatctctggataaccttggtgatctaatggcagtaaaattttctctaaaactcatgcaatttttttaaaactagatgtcttttccacaaatatttattttcactttgtagtttcagactgagctaatggtttcgtaagcagacatattgattagttcaaagtcaatttctaacctattccagctcttcagctttcttagaccattttgtggggttttttttggtttgttttcttttttttcattttgtgtaagatgggcatgtcttctttcatacctgaaatcaaataaatctgaccttcctgtccttaaatgtttgaggatacatttttcttcttgttatctattttttttgtgtgtgatgatttaaaatgaagtatgtgaaaacactttgtttggatgggaatgaaacctaaggcgctgggacctccttaattggctgctagtggagcaaattccaagatggagcatcactacagaggtcttcaggggttctagcgggtagactataaattattgatttgaaaccagagcttgaggggcagttgtaagctggaagagggaatcacaggagtcactgactctaccacctagagccaatagcaaaagagaaattgtagagatgaaatagggtctctcaatgtgagtcgagtagggggtcaaggaaggtatgtagctggatctagcaaaagactgaagctaattacaggcactgaattccgtttttgccattctttctaatgttttggatattgtaattccagaagaaaaaaaaaaaacaggaactgggccttaagtaacaacactaggctggaaaatattacaggcaattcaaaaaaattattgctacaactaccgattttataaaatatgttgacctcttaaaattggctttttatattttttgctactcttttatttcattggtctatttataccaaataagttatatatttaaacaagcctgattttttaaatttcttctttacctcgacttagaagttagacttagatggatagtgtttcaggcttacagtgaaaactaatgcccatagtaggcaagtactaaaagaaaaggataaagcccttattttgtttttgtcttcatcaataagaaaagagagaaaatagcactttagtgctttcttttatccaaagtccagtgcactaaaacaaagaggctggagctccgggcaatttctgaagatatctaccagggacttcttatttatttcttacttgctcctttgctcctcccttgatccttttactcctcaatataagaaaccaaatttagatgtttcagggaaagactttttctataggctccataatatttttatctgtttttgttatgctgttttgtgtttcttattcctctgttcatacaaagatttctacttcagcatcattataaggtcaaaaattcacatttgagatgctcagccgtggacttccttcaaagaaccatcttacttggaataagagaatgactttccttcacctttaacactttcttaatgataacgccttagagtggcagagcaatttagaggttgcaaagcaaagtcacacatcctcctatttaatgtgctccacagcctgtgagctgagcagggcaggcatctcattttacaagtaaaagttctgagcctcaagaaagaatctgggcaacccaactctactttttttcgcattaggagaattttgtgaagatgcaagtgcatttagattaattaatgccattttcagttttaagtgtcactatcagattttcatttcagtaagtgacatgggagatatgtttaagaaaggcaggtttgttaagtatagaaatcagctagttagaaggtaactttaaaatttaggcaaggtatgataaagatctcaactactaccgtggtgacagaatgggaaaatatttaggacacaaacatggagtaagttattaacagattgtgaactccctctaccaaaacaaatttttagtaggttaaagttaactcaattggcaattaagtctttatttgattattcaaatgaaacttgctctatcacaaaatacctttaagttatcaaaaccaaatgccatttgctaaagacatacagaagtgtaagttaataaagatacatctttattcattagaggcttactaattagaagaattaagtacaaagttggcaagcaacaaattgatgtaaggaagacttagaaagacttaggtcttcctttattcacattaattttcctgcagtatttcacatctttttccttgtcacatcacctcaactgatgacctccttaaatgtaaatacaagagagacaatgaatacaactagaggagatcaacttcatcttgtcttttcagtggcaccacctctctacatatgtacccacatactctgccatccctcttcctccaggagaagacatggtcctgcctctaagaccaaccactacccctctgtctaaacccaatccctactttgctcctgtaattatcccctttccttcccatctaactttgttcctctatgctctatgattcctcttagcatacaatgatgcctcaacactactcttccataaaatctctctcttgaccctacatttttatccaagtaatgatgcattctctgttctcctcattagcaaatcttgcaaaagtattggctacatttgctgtttccacttagtaacctcccaggcttttctcaatctcctctaactgggatttgccctccagtagcccaagcgattgtttataatttaccaataaaaaagaaatttctcatctttcaggaattaaataaggaaaaaattaaaaaccatttatatgaatatgcataaaatgattcaaataaattatcctgggaataacaaagctatatttaattataataccatagttgatatgatatattttcatgaagtctggcatagtaacctgctctaaatgaattttgctatgcatgatatcaggctgtctgccttccttccttcatttcttcttttcttccttcctgacttcattaatctctttctcctttttaaaatgaacttagtatcttcagttgtaactcaggcttagatgataatagaattgtccctcaacatagtagctttgtattaatctcttaaattatttttcattaatatgcaaagataaattatatgtgatttctaaagaagctttgtcaagctctagcaaactagcttaattatgaaaaattaaatattctgtaatgatctcttcttttgaagtctttaatatgaaattacatttgtttaatcataagcttggttcttgggcttttcaagtggattttagaaccgtaaaccgttatgtttaagtgtaatttcaggcttcctttagtttttggcattaaaatcaatttaaaattaaaaattatcagtggtgatagattttttaatcaaaaagaaacaaagataatggatttcctccctaaaatctgaacacgttactgcactatgacactgatacatatgcagtattaatttgttttagttttatagataacaaaccaaaatgctacttcttgttttcccattttaataatacgatgtaacagtataactattattcatatggctcatatatcataatctatgaaaaaaaaggaaagtgttttcttgttcttatttttctttaaagtcatattggggtttctagggaaaatttagaaaatgttaaagaaaatatgactacagctcaaaaacaacagcttagaattgtctgggcctctaggaactgtcaacagcttccatcatttaaatacaacttactcacatgtgggagaagcatatggagggaaaactcacacaagatgcaaaataggcaagttgtacaaattaaagaacagaatggagagtttttatttaaaattttctttttatttttctaagtcaaatatgtcctttatttgagcgtaaactcacaattcagattttttgtgataatgagacaataatttttataatttattcaaaaagaaaaattgttcataactcgatagtcattttagctacaacagatatattaaatgctatcactcatcatttatttatgtaaataaagtaaaaaaagataagcctatcaagaactattttgttacctatttaagaaaaaaacacagaccactagattgatattgactaaaatagcagaaatgtgcattctaaagtttgagataaccagattaatatctgcataaaatgtgtgtaaaagctcttttctcagcctcgtaataatttaaatgagtgtagaaccagtatttttgtgtcatattttaaatctagaagtctcattatttttgttaacataacctgttagtttcagggactgcctgctttatttcacacttgatgtatgtaaatgcttctatttatgcacatttatactgcatttaatgttatgctatgcttaatttaaatgggacgtcttacatgtcagtaggagagaagtactagagctacatggaagataaaatttgaaccatgcataaagtaggaagagtagcgttacattgggagaaagccaaaatataatagaagaaacacaccttaactattatcaaatctaagctgacaaagaaagaaaatattagaaagtttaaaggcagatttggagaaaattaaaaggagatcttggtttgtgtaggtaagtaaagcaaccaaaatctgaactgtggaaagtgatgtaaaaatatttatttccttagaatttatcaagaacattgatccatattttattagtcagctttcattaggtaaagctaaaattacagatgacctcaaaatcccagaggcttacagaatcaatggcatattccttgctttgataactaaagtcaactgtggctgtgctctatgtatcttttccttctggaactggttgaaggaacagcccatattttggaatgtgtcttttttgtacagaaggaaaaagcaagaaagaagaaattcacatgatagctttttaatagcttctattaagaactctctcaattccactcacatttcaatggcaaaagcatgtcagaaaactaatgatgatatcagggaactgcaagtcatgcagctatggcaagaaacatataatccttttatcagaaagggaggaaagataatggggggaaatgatacaatctactgtgcatcatatgccaaaagtgtttttcatggagaatgtggtactatagataagtcttgaaaagttaaggcaaatacagaacagacgtcaaatcatttagtagcgattggcaggggtcttcattagtatagaaaactttagctttttgcctttgaaattaacacaaaagagtagaatggctgtataaagtaaaaataatgttttaaaaggacatgagttttatcacataggtagaaataaaatacatgacaataagaatgcaaagactggaatatgataattagaaatatattgtcataaagttagtaaatttttcatgaagtaatagaataatttaaagatacatattgtaatccttaaagcaaccaccatcataataacaaagaaacactacttccccaccaaaaatttattggagataaggtaaaacatatacctaagaatactttattacacacaaaaaagaattggaaacagagaaacaaaagattggtcaaatatgaatcaaataccaagttggtgagcttaaaactaaacatgtcaataattgaagtaaaaggactaaacacgctgattaaatccagactagattttttttataagttagactaaattgtatgtcgtttaaaagaaacacattttaaacttaaggaacaaagggattggaagtaaaataatggaaacatcaagcaaaaaattaagctggtgaggcaatatgaatatcaaaataaagtagatttcaagctgaatagtgctagcagagattttaatggggcatttcataatgataaaagaatcacttattcaagaagacataagactactgaaagtttatacccccaatacaaagctcccaagtatgagacaaaaactgacaaaacaaaagagaactagacgcaaatttactgtcaccaatatagattttaacactattttctcagtaatagataaaacaattaaataaaaatcagtacagttatggatgatttgaacaacactaaccatcaatgtaagctaattgacattaatagaaaatcattccacactagagcaagctacaacttctaaggtgcacatgaaatactcaaaaagatagacatatcctgggccataaaagaagttacaatacatttcaaagtacctaaattaaacaaagtatttaaataatacaatgatgataaattaaactattaaatttaatgaagatgaataaaaataatatacatttgaaaaccccccaaagatttggaagttaaaaacacactgctaaataattcatgagtctaagaaatctcaaaggatattccaatatatattttgaacagaaatacatgaaaacacaacatatcaatatttgtggtatgcaactaaagcaatctttagaaggcaatttatacattttaatacctatatgagaaaacaaggcataaagtcaagcatttctacttccattttaagaaactagaaaaataataaattaagtcctaagtatgtagcacaaggatataataaaaagaacagaaatcaataaaataaaaaaagtgaaatagccttgtataaagaaatcaaatttgtaattgaatagcaacaacaacaacaaaaaaaaaaaacactcccggactagatagtttcactagtgagttataacttatgaataaaaaataatactactctgacacaaactctcataaaatagcagacgtgggaacaattttcagcccatttcatgaagggcaggcatggaaaatacaagaaaagaaaattacagccagcatatctcaagaaaatagatacaaaaatgctctacaaaatattagcaaatgaaatccagcaatatattaaaaagttaatataccaagatcaagtttgacttttcccaggaatgcaaggttagcactgtcaacaaaatagaccgagaaaaatattgcaacacatatatctgacaacagatttgtacccaaaatatattaaacattcctgcaggtggagaatttaaaaaccaccaccaacaataatttttgccttaagattcagtaatcctgctgctagttatttattcaagagaaatcaaaacatatgtgtacacaaagtcttttacaaggatttgtacagcagctttattcataaatacccaattataatttccagtcagtaactgaaaacaacccagatatccttcaacaggagaatgaataaataacctgcagtgtatcattcaatggaatactaagcaataaaaagatataaactattgatacatgcaactacctgaattaatttcaaaagctatcattttgagtgaaagaaacttgacacaaaaattacatattgaattattccactgatgtgatgttctagaatagttaaaactaatctgtggtgacagacatctgcccatatatagacagggtagtggtagggcaatgcctgggaagggtaaccagggaactttctgggatgatagagttgttctatgtgtcttgatatgcactcaacactaattaaaggctactgagttagtccatttgcattgctctaaaggaatacctaaggctggataatttataaggaaaaaaagtttattctgactcatggttctccaggctgtatgagaagcatggtgccggcatctgcttccagtaaggcctcagggagctttttactcatggcagaatgcatagtggcagcaggtgtgtcatgtggcgagacggggagcaagagagagaacgaagaggttccagactcttaaacaaacccagactcttaaacaagcagatctcatgtgaactaactgagtgagaactccctcatcaccaagggtatggccctaagccattcataagggatccacccccatgatgcaaacacttcctaccaacccatacctccaacattgaggattacacctcaacatgagattcgtagaggacaaacatccaaaccatatcaggtacccttaagatctgtgcatggtcatccctcagtctcctcaggggattgggtccaggacccgccctccccacagtataccaaaatctgtggatgctcaagtccctgatgatataaagtgctgtatcctatgcacatcctcacatataatttaaatcatctctagattacttgtaatacttaatacaacataaatgctgtgtaaaaatgtgttatactctatttttatttttttattattttttatttctgcattattattttgtactttttttctgaatattttgattcaagattggctgaatttgtgaatggggaaccagcagatattgatggatgacttcatttcactgaatgtcaattttaattgcatttttatcagagtgaattacaatgcttacccatgtgtttgaacattatagttcactgttttcagaaatggtataacaggttaagaatattataagagtcacaggaagcatgatagtgagaactgggttcagcaggcacatcatcatgtaggaccagcaagaagaacagggtggtgatggaattcaaccttcagaagaaattaccagggcagagagatctgagagagaagtaactcaatcatttcttataatccctccgattccaaacctccctaaaatgattaaatacattttaatggcagggcagaatattagggataatgtgctttcagtagctccatttccctcacccctcaaatttccctcaatcgcttgccaaaacctaagtttctataaaataatgggaaataattatcttactttgcaactcaaaataaaagagcttacaatataaatgcatggttaagataatactttaagataaatgaattttattcctaatcagtgtatgaatgcaaataagcactgatctttcctgttactggtaatgtagaaagaagagaaagaagcaacagtccaatttagcacacatttactgagagtgtaacatgtactaaatcagtggttttcaagcttttgtgactgtgacctttactaagaattgcaatttatattgcagccctgcatgtacgtacatatgtataactaaagctgtgttataaaataaaacatgtacttgctaaataagatggagtctggtacttactagactagtatagtctgtttcatgtttacagaaatgcaagtcatgatgcattaatttcaccacccgctaaaaggttgtgaactgtggtttgaaaaacacagtgctattctttctactcaaaatgtggtctgtggaccaacagcagcagcatctggggacttgtaagaaatgcagaacctgagaccatacctcgcacctaatgaatcagaatctgcattttaactaaacctctaggtgcttcctgtgcactttaaagcatcagaagccctgtgctagacgatgcctgaggaggatgctctggacagatgaagtcttcttggtattgcttaaggcagagactcttcctcggagatagtctgtattcagaataggcatattgaagccccaaactaagtccaattcagtatctccaaggatatctcagggcatttttattaaaaaaaaaaaaatatgatccacgaaagcctctgaatcagaccctatttaagaaccactggtataaaaagttaaatgaaagttgtgcaccgattaagtcatttgtttgtttactgttatacaaaggtgcaaaccaatgcttccagtaatatggaaatactttattttatatttctttgtgggtgacttcatagaaaggcactttattcacacaatacttattgatgggggtattcctactgcttcttttgaatttacttctccttatcagagaatttccaaacatctccattttaccaataattgcccttttatagaaatgtaatatgacttctggtagaaatattattattagtcctgctgagatagcaaaatttatccctggatgacctccagtcaatcccttaccaaagatctcaactgctgaagaaaatggggctgtctctaagtggccatcactgttcattaaggtccttgccattgtgttcttatctttcctgagtaatgggaagctttagtctggaagttgctaatcttgctaacactaaaaggctttctcccattagcagcttctgtgttgcattaataatcagaaagtaataaagagaccgacctcagctgttcggtctcccctgagatgaggccccagcttccctcttatccccatggtccactctaatggtcttgcctatattaaagtaatagagtgaataataagataagtgctgtctattttatcagagtctaaaattccttcttctttttggggaggacacctttttttttttttaagacatccaaattgaaaactataccatcaatacttttgcaattgaaattgacctgtttaattcatattgttttaaaaatgtaagcgttgactatcaagcacaggaaaaaaatgttttagaaaaaataaatccctccacctttcttggaagagttataaaacagataactctcctagggatgtcttcttgtccttttttgagtaaatcaaattactcatctgaacagcagtaaactaaagaaaactaaagatctttgattttataagtatgaaaaacttgtcaataaacaaaaaagaaatgaagagaaaataacatattaaaactaaataagtaagattggatttgacaggttcaaggtgcatgttaataagttgtctttgttgtttaaaatgttcataaagacaggaactaatgctgggattaattgcttatgttctttttctgttgaaaatgttcttttgcagaagtgcacttcttaaaggttcccttgatttaaacatctgtttttaaatgtatatgatctgtgtatggaattatattatctatgcggtagttagttgattgtaatttttcattttaaaataaaactactttttctttcaactatatatttttaactgggaaaacaggtaattcaccttgaaagtgttgctcattccttgtactcaaatactagaaattttttctcaatttacactgttgtatcctgattttgaaagactaactttataattaggtgatatattgcctatttttgcacttgtaatttagaggaaaaaaggaccaatatcaatcatcattatcagtgactaaacagtgactcaatgtatttttttaaaataaaatatatgttcataaccctctaacaatgaatcactgtgattagctctatgcaatacttatgtaagattcagtaaatgacagtaaaaaacaactaaaaactattttctaaaaacttataatcaacatactttttcttataagtacttaacagtttgaggggaaaaatgggggcattatctaataaatcagggatgctcatctaaatttttaaaaattatacatgaaaactttctttgaacgaaaaagtccataatctggaaataagaaaatgctaaatatgtttcagtaaaatagacagtagatctctccctcagagaggtgaaaatttaactcccttttaactaaataactctttcatatggtctattaggcaaataattttgatgaatccaataaactcacatgctttttgttttatttagcatgcaaaatgcaaacgtgttcaccacataccaatgggaaacatattattgttagagttgtctttaaattggaggaaaaaaaagagttgcttttgacattcttatgaagcttcaatagcagacaggtccattgggaaagtagcagctttaattaaagaattgtcctggagttgtagatataatgcacaattacctgaattccttttactgtttttctgtcctacagtccatgaaggctctggagaaactagtcaaaaggagacatccacctgtgatatttgccagtttggtgcagaatgtgacgaagatgccgaggatgtctggtaatatgctgtttttattcttttagacaaaataatgacagtgattaatttctttttaacaccatcaaccattctgcaacagaagacattgtctgcatttttattttcttattcagttcccaagtgaaaaaaaaaatgagggcaaggaatttctggaactggattaagaggtgggccagccaagcagctatccatggcattacttgataaggcacactaaaatatcattgaagccccccaaaactgtcaatgttaggatatagagggaaaaaaaagtcttatttactagaatatctttgaaaaagtatcatcagagccaggtgtgatggctcaggcctgtactcccagcaggcctgtactcccagcactttgggaggccaaggcaggaggatcgcttgaggccagatgtttgagatcagcctgggcacaaagtgagacccacatctccataaaaaaaaataataataattagctgggtatggtcacactagcctgtagtcccaggtactcaggaggctgaggagggaggaacacttgagcacaggaggttaaggctacagtgatctgtgatcatgccattgcattccagcctgggccacagagtgagactttatctcaagatttttaaaaggcatcatcaggcagcaatagatgatcagacttagtctgtttgggtttctataacaaaataccataaactgggtagcttataaacaaaagaaatttattcctcaccattatgaaggctgagaagtccaagatcaaggcagatttagtgtctgataagagctcactttctcttaaaatagccttcttcttactgaagcttcacatggcaaaaagggcaagggaggtctgtggagcctgttttataagggcactaatcccattcatgaaggcttcacccccataacctaatcgcctcccaaaggtcctacctcccaatactatcatcttgggggttaggatttcaccatatgaatctggggagggggacagcaacattcagatcataccagttgctaatctgacttctaagatgatggagtaactactcttttaaagatatgttcatcagataatgaataatacttattattttgaatgggtgccaacattttagctttctactgtattcgtcccaccttaagcacattgaaaagtgaataactcaaacttctgagggagttctttgtgtcatgataatgaaaagcagcagcctttttttattcctctcctattctctcttctgctcctcccctcctcctcttcctcttcttcctcttccacttcctcttcttctcctcctcctcctttccctccctgtctttccccttctcctcttcttttccttctcctttgtcttcatcttcttcctattattattattgctattatttctctctttttcttttttacatatacctcacccctttcaggaaaacatctggctgctctttattttctgcagtatgtagactgtgcttgcctagagcagttaaccatcattttgatcaaacttttgtgagtagaggggaaaattcatctaaggaaaatgaagaaaaaaaattaagacaagattatgtggcagtagtaaaacagtctgcacttaaaatattttttaagtgaagattctatctgagcaaatggtggttcttagggtaaactacgtacttacaagtaaacactgcctttgaatagccaagtgaaataaacatctattactaaaatcagacagcagtagagttttcatgcctgtcaaacacttctagccaatgggcagctaggagccgagtgagagagtctatgcactggtttgaccatcttgaggtaaacaaatgtatgttttttgttttttattgagacagagtctcgcttctttttttttttttttttttttttttgagatggagtctcactctgtcgcccaggctagagtgcagtggcacgatctcaactcactgcaacctccgcctcccgggttcaagagattcttctgtctcagcctcctgagtagctgggattacaggtgcgcaccaccatgcccggctaatttttgtatttttagtagagatggggtttcatcatattggccaggctggtctcaaactcctcacctcaggtgatttgcccgcctcggcctcccaaagtgctggaattacaggtgtgagctaccacgcccagccaacaaatgtatggtttttaaaaaacatcctagggaccttaatggctgatgaatttgtggttcccaaaactgagagattgccagaagtactttgagaatttttttaaacataccagttatttagttctgccccaaaattaatgaatcagaatttcagagaagtgggactcaaaattttacttttctacaagacccccaggggattatggaaatactactctaaaataaatgactaattcaaagactctttctccttcctaaatgctttagggctcttctgtagtcataagatcaagacacacaaataggaaatgtatccttaaaatatttcgtttctaacgtttattggtgactgcatctgtatttcagcatcattttttcaagctgttttcttataaattgtttcactttttaaaaaatgtacatgagtctcttttttttaagaattttaattttcctagttccttatctttttaatgattattctttaagtggtatagctccattctccaagacatttaagacatgagcttttaagagcagctgaaaattattggttgtttactatgggttttatccatttgtatactgtttttttttctcagctatcttcaaaatagccataggaggtagattccattattattttactctaaaaagagaaaactgagttttaaagtgttaaagtggcaggaccaagatgaagatacgaggtgaaagtaactaaaggttgttagcataacaattcaaccaaagatgcaattgaaacaatatgtctttgctgtcatgtctagacaatgagatggccagattgcaggcagcatatttgcagtgactctccaaggcctgcaaggttagagctggtctaggtagatgtttgcagctggaagtgggaaaacatccaggcaagcagggggttaatcctggtattcttgcaaaagttcagatccatggtatgaaggcagtatgaaaagatatgggcaaggatagtggcaccagaaaggcttagcaattgtctacagggcccagccatggcaactgtacttcagaaaataaattcagttacaaatgagacaaggagaaggacaaaggagaaccttagtcatggagaaattggtgtcaatcagaaaaactcgtcaagaactgaaacaggaaagcctggatagatattgcaactggtatacaaagccaagccttggttacaagttgctgggagaagcatagcctacatctgagaaataaattacaagatcagaatgaaaccagcagcaaagctgagtgctaaatcagttagctcttggctatgatatcttgtatgcccccagcatagggacaagattagctccaagatgcagaataagcctgaacctccagatgggggctaagtggccacggctgtgaagattagagggctgtaggggcagggagccaagaagatcattagacttccaagacaagaacaaaagttattagtgtttaaataaaatgtatttaaaatgttgaatgtaagcaataaggaattgtgctgaaatgacaagtgcattgattttcatttacataccttgtatgttaacgtacctttgtatgttaacatattgtatttagtcatggccatgaagggcagattggaaacagctgaaggacacaggaataaagcaatgagtgaaattaaataggcatagaatgaaagaggctgtaaagtaagataggaagcaatagcggagtgatctgactatagtactaggcaacagaaccttcactaaatcaagggagcgttgatacgctattgattttggatgacaccacggccaggttctctcaaacataaaatactacatatgataagtggcaacaaagagtacaacttattgttttattttgcctttaacactaactaaactataattttatgtgtacagatttcctcaatcctgcattatgaaataataacaagatgtgaataactgctgacgtgaaataatgttcttactatatccacaatactgaaactaaggtgaaaaattaattcctgatctttctttaaccctggcctaataagttaatattttgcattttcccactgggttaaatctagttattcaaacattcttaagtactttcaagatgaagataaatctttattagaataaaaaagtcagtacacagttagctgatcatgttttcatagttagatgagtttttgagttcagaagaaagtcacactggagatgggaataaaaaaattaataaataggggaaagagaaggagaataaaagaagaagagaaaaaataataattagatggcattgacaaactatgatactaatgacataacattttaatgcttttattttgagaaaacagatggcttgtaatctaatctaagaccgtagtttatgttctatgatttcatttcaaggtttttctcttgcattttccttacatggagaacatcaaggctgtaaaaaatcagaaaattttaggttctctcaataggaaaggaagaccattgctacaaaatactttttcagttatagatattaacttaaatgtaggaaaggattaagcttccaaaagagggttaaaattcaacaggacaagttattcacacgccagtacatccattctcataatagaggtatctttcattaaggatggacttcgaaagtaactgaaacacctgtgtgaagggatgtgtgtgcctgtttatggggaaggggttaagagaagaagaaagggattaaaatatcatttctctttatatccagactgaaaacagtcaaaactaatacatttatacataaaagggattctcaaatacaccctgccaaatataatttataaagaagaagaatggcttataaataagtcaaatataataaaattgactcattgcaaagtaataaagctccatctgatagcattgggaataccaacttatgatttcagcaaatatttctgatttcactttagaaacagccttatattcccttaattatcttacctgataaattatctcagtaagtccaaagtaggtcagtggaaactcttttctctgggaactattccttagaagtaattagcctggaactttctgttggttctgtcagtcagaagtagttcagagcccgggggttgatacttgatttaatatacatatacatacaaaagcactgatagctgggtctgaccataggaatggctgggtatgaaattggctgcatgcctaatatttccaggaacagagcacaggtgcacaggtttaagagcagatgcagccagatgacaaatgacataaagggacaacttaaattattaggtatatttgctttatatgtattcttcatagctctttatccctgttttaactttgcttttgtagtattctctacatgccactcaggctccattagcgatatcatattggcataaatgctattaactccttagtagtcattttgtctttgaaagcattaataatattttccagttttagtgtataacatccttagtgtttgagtgcaatggtaagaaaggaaagaagcaaagttgttgcaaaaaaatgagttccaaagaggaatgaatgaatgtttattattttctctatttcattgatgtttcataactgaaacagggtgtgggatctggcatttcttttctgggtgtctcttacaaagacagtttagtttgaagtctttaacatcttgctcctttgatctgagaaagctccctgtcattaggaagattgtgtgttattggcaacctgcccacatttaatgcattttggattgtggaggctcatgaatatttgaagtggggcaatggccatggatgatccttggcactagatttcatcataggtataagtaaattagacattaggtcttgctgactttagtacctttggtttgtgagtttgatagggaaaattaagacacctctgaggaaaatacagaaagtggttttatttaaaaccactcctggttgacaattgaacaaaaagattgtatttaaaatggaaactgcaatctttgtattgtttttctactaagtaaaaaggtcagacttggatatggtacatttaaagaggatgctgattagtcacaaaattttagccatctaagagttcattcagtttctccctagggtgtttcccttttattaatttcctttgctttctggccccagaagtgtaactggtaaccaattttaggtgtggtttctaatataagtttactcatggagacaatgaaaaaaaaaaacccagaaaaaagataatagatctgctctagaaaatccaaggttttttttgaatgtgtgcatggctttttgagaaaacattttagtttcaagattcctggagttgaggtatgacctccctccatttacctcttatctccaccttgaagacagtagctgtcacctctgaaagctgcagtagcgttttctgtttgtgtcaatgagtgggaactgaagagtagatacctctcattcctttaatgattccatttgcccaaaaaatgtttcggggtggggagtgcacatacagctcctgacttagggaagcacatatctttccactcagaatttcaaggggaaaatgttgatagtttttagcaaaggtgtgtccaaatctgaaagttggggtttgctttcattatttctttcttttctgtatttcttcacctatcttgatcaagaaaataaacagcttatatttttctaaatttcacacgatgtaataaaatttagaagtaaaagactaggaattctgacatggtctgtacgatggtctatacagggcattaaacaatgcccagggtcaacaaatgccatatttgcaatccaaacttctctctgcagtagctgccggtaatccaacctgcaaactgaagttaaaagcttcaaatgttactcaggaagacaaatgaataacaatgacacttctaatatgcaatagtcaaataataacaaccaccaacaacaactaaccacccctccagaaaaaggagggttatgaaagtaaaaaataaaaaaaattgaaaaataaaaataaacaatagtctttaaaaccttgagtcttctgtgatgctagcctaccttttttatttaaaaaaatgggttttcacataaattctagagaatcttttaaattcttctctgtatccatacctcaactgtactagctatcacagtgattaatgaaacttaattaggttatgacagctacaaacccagatctggtgtagaataccaagaaatatggggataaagaattctgaacttcaatgtgttttatttgtttttacaatatttattaggccatgcagtttaaatcatgtaatttctattttatatcaaaatcataaaatactgcatggcaacagaacaaaggaaacaaaactcctaagtacagattgtatttctaccactaacttaacagttttcattacttgtttctctttttacttgctttttttgtttgtttgtttgagatggagtctcaccctgtggcccaggctggagtgcagtggcgctatctcagctcactgcaagctccgccttccaggttcacaccattcccctgcctcagcctcccgggtagctgggactacaggcggtcgccaccacgcccggctaattttttgtatttttagtagagatggggtttcatcgtgttagccaggatggtctcaatctcctgaccttgtgatcctcccgcctcagcctcccaaagtgctgggattacaggtataagccatcgcacctggcctttacttgctttttaaatctttgcttgcttttgaaatcttgttgcaggccacaccctgttaatggtaggttgcctaacttttggtgctcactcattaaactcactctctatttcttcttgagttttcatgtctcagtttctagcatattctgagtcagcgattcctgtctccacactcagggaatacctgctccatgttccgatgtcccagtgtaacatcccagtctcaaagataataataggaatctcattgtagttatcaaagtgtgacaaacctttccaaagcgtgtcagacaccatcctaaatgtctagatttatagagccatttaatcctcaccacagtcttatgaatgtaatacactagtaattctcatgttacaaaacagaaaactgaggcacagacaggttaatcaaacttcccaaacccaaacagcaagtgagagagccacaatttgtgccagccaggcagactccatgctcttaactaccactcagggtcttctcttataaattatgtgtgtatataagtgtatattgtgagtatgcacacacacacacacacacatagaccaaatgtatctatcttatatattcaggatagaattttacatgttttaatgggaaaacaaagactttaagtggcagtttgggatgaaattcaccactaacacacctacattgtgtatgatgcccttgaagttctttttcactcagtatataaaatatatttctttgtagtccccttcaagactgtgtagttttcatttgtttgtttttcacagaggtattgaattattcttatcatggttatgcatgcatccaatcagatgagaatgttactagacttaaggttgcatagaagagacataccttcaccaaaacctgaggtttttttagctgcttcaattcaatttgcctgttttgcagtggcagtggcaaccctgactgtgagccaaagcttattacaaatgtctatttctgctgtaagaatagaaattcctggagatgagaaatagaaaaagagggaagagtcaccaaattaaataaaaataaatatgacagtggattttaatctgtatcttagtagattaaatgccctgctgtatcttttaatttagcacttaaaatatgatgtgaagcctcttatgttccaatataacatatatttttgatggttatattaaaatgggttttacattttttctaaatataaatacacacattccatcatagtgatttaaaaaaaaatagaaatacaaaaactttaggaaaatgtcatccctctctaagataaccattgtgaaatttggagatatattttctgtgtgtgtgtgtgtgtgtgtgtgtgtgtgtgtgttttatgagaatctaataatattttacatattaacaaaaccacttatcttgaaaatttttagttaatcttgagggtgagttatttggtgattgttaggaatgccaaaccaatttaagaataatgtatttatactggaatgcaatttctgtgtcccaagctctgattattctttctaaattttcagcacttctaaaaaaaaaaaattcgtttgagcgtactgtcctaacatttgtgatctaaaaaattatcaaagcctatatcccctctaagcctgtgttaaacatttttcttgtttaactccaagagattagacagtatgttaactgaaaacatttccactgtctgtatccagagtgttcataataaatagctttctgaggcataagcattgttagatgagaaactgtcctcccaaaggtgtattaaatcgggtagaaactgttgctggtcttctgtggtttacttccaaatagtaatatattgtatgtgttgactcatctaaactacaaatcagtgaaccatcctcagcagccaacatcagtctgttccagacacatttccctacaaacagggcatataatatctaataaatgattgaacaaattgtaaaattatatgcaacacccaatcaaaacatcaatactgctgaaagtctaaatgcttattacagaaaaaagccaataaataatgaaaacgaatatctgattttctagcccccctaatgtaaagtaaaattaatcaagagtgggtccattcatccttttatcactaagctatgaatggaacataagaaatcaggacaatgcatttgggacagatgatcttctgaagattgtttaccacagctctcttttatttattgcagcctttcaaagtctttgacacagtagttcactgtattctctgagctcatcctgaaatgagctttctacaatcaaaattatattatccatggtaataaaagtaatggtaggttctaacaagccataagggcttataataagcagatattaggagatgtttatctgggagaagtgcacaacagtttggaaaaaggcaaaaataagaaataaaataaaatattagcttcacattagcaaaaattagtgatgtatttctgtaataaacataggtatctgcaggccgggcacagtggctcatgcctgtaatccaagcactttgggaagctgaggcaggcagattgcccaagctcaggagtttgtgaccaacctgggcaacacggtgaaaccttgtctcaactaaaatacaaaaaattagctaggcatggcagcatgtgcctgtagtcccagctacttgggaggctaaagcaggagaattgcctgaacctgggaggcagaggctgcagtgagccaagatcacgccactgcactccagcctgggtgacagagcaagactccatctaaaaaaataaaaattaaaaaaaaaaaaacaggtaacacaggtatctgcataaatttggaacttaggatattcaaatataacatcaaattatcaataatgatgaaaaataaaaatgatatatttgattacagtatgcaacttaactttcaattaaaattgtcttccccagaaagtatgttgatttttggaaaaagaaaacacaacagaactgcttgcattacagctacactgggtggtcagacttggggggaagaaagaaaagaaaaagaagccctgcactgatcaatatattggtatattaatcagggttattcagagaaacaaaggaataggaagcaaaaaattttctagtgaatcactagagataatagtggaaggtgacagttccatttccaccccttgatttctggaccaatgaattttggctatgggagacagagcaccacatattaaatgctgattcagagcacatacagccttctggagaaccttgcaccagtcctagaaagcagtgtcacctacctggtgttacaactgtgatttctttctcttttttcttttttcttttttttctttgagacagtgtctcgctccgtcacccaggctgaagtgcagcggcatgatcttgattcactgcaacctccacctcctgggttcaagcaattctcctgtctcagcctcccaagtagctgggactacaggtgcatgccacatgcccagctaatttttgtatttttagtagagacagggtttcaccatattagtcaggttggtctcgaactcctgacctcaggtgatccacccacctcagcctcccaaagtgctggaattacaactgtgatttcaaaaaaccattccaccactctatcaagccagcagctataggatggcaggaaacatggtaagaccagggaattccatgagcatatacccattgccatgcttctttggcagtgaagtaagttccttagtcagaagcaatgctgtgtggaataccaagatggtggataaagcattccgtaagtccatggatggtagttttgggagaagcattgtgtgcaggaagaaaaatgtatatccagtgtaaatatctatttcagtgaggacaaactgctgtctcttccatgatggaagcagtccaatataatcaacctgccacccaggagctggctggccaccatgaggattggtgccatattagggactcggtgttggtttctgcttctagcagattaagaactcagtggtggctgtagccaggttggtcttggtgagtaggagtctatgtcgctgagcctatgcataaccccccttttttgccacaatggccactttgttcatgagcccattgggcaatgaacagggttggctggagaaagaagctgagtggtagctacagaatgggctattctatccactttattattacagtcttcctctgctgaggttatccttttgtaaatatttacatgggacacaaatatcttcatggttttttgcccattgagagagatctatccacatacttcttccccaaatttccttctcaccaatattccagtcatgttcctttcaagtccttgaccatctaccaaaccattggccacagtccatgaatcagtgtacagtcacatgtcctaccttttctcccaagcaaagtgaacaatcaggtgcactgcttgaagttctgcctactggaaggatttttcttcaccattgtccttgaggaatgtttcagagaaggtctgcagttctgcagctgcccactttcaggtggtagctgtatatcatgcagaatcttctgtaaatcaggcctgagtcttttttcctctatcaactgatcacaaggagctcccctgtgaggccacagaagcaggcgggagagagaaggtcctgtaataggagtgggtgccatgacaattaggccccttcttttcatgtaacttacttgtgccaagagcctgatttgacctaatctcatacaaagtacttccatttgatgatggagtgctgctgtgcatgcccaacttcatggctttgcgagtaagacaacactcagttcatggtgggaagctcaggtcaaatagtaacttagtagtgcatagttaagtattaagtctctactaaggcccagtagcaaactaagaactgtttctcaaaaggagagtagttatccacagaagatatcagggctttgttccaaaatcctaaggatccgcactgtgattcaccaatagggggcccatcaaaggctccagacagcatccctgtctaccactgacacttcaagcaccattggatctaccggatcataaggcccaagtgacagagcagcttgcacagcagcctagacttgttgcagagtctcttcttgttctgggcctcactgaaaactagtgaaaagcagtttactcagtaaatggactagagtaacacactcaaataaggagtatgttgcctccagaatccaaagaggcccactaggcattgttcctcttttatggttgaaggtgaggcaaatacatcaacttatcctttaccttagaagtaatatctcacatgctccacatactgacccctagaaatttcactgaattttcttgaaaattcattctctgacatgcaaatgtcttaccaataactatagagtagttgctacttcttgctcactacgtcaaatcagcatcatgtcaccagtgtaatagactagtgtgatatcttttggaagggaaaggtgataaagattcctgcaaactaaattatgacatagtggtagagaattaacatacccctgatgcagcacagtgaagctatattgctgaccttactagctaaaagcaaactgattctggttgttcttattgagaggtaaggagaaaaaggcatttgctagatcaatagctgcatactaggtaccaggggatgtattaacttgctcgagcaatgaaaccacatccagtacagcagctgcaattggagtcatcacctagttaagcttataataatccactgtcattctccaagattcatctgactcccgcacaggcaagttgagtgagaacataagaatcaccccgtccctgagtctttcaagtccttgatggtgcagtctttccaggaatgtagtgtttctttgtgtttaatatttttcaaggtaaatgcagttttagcagcttccacttatcttttcctaccatcgtagccttcattccacatgtcatggaaccaatgcggggtttccgccagctgctgagaatgtctactccaattatacattccagatctgaggaaagaaacacagtgtaggttcagggacccactggatccactgtgagatggaactgagctaaagcttcactgatcacctgacctccataagcctgtactctgactgtggaccacagtgatgttttgggtcttttgtaattagtgtcagttcagagctagtgtccattagtccgtgaaaggtctgattcccaatgcacagttattctggcaaacagctgaaggtccttttgaggaaggctcagagaaagattaacagtatacatttttggcactgtaccagggccctttctcaaggggacctgacctcccctttatgcaaagggttctgtgtccataaactggctctagtctgagacttgattaagggaccatgactctctttttttatgatgtaggctagacttttgtttaagaacgtttctgcttatcaaatcaagtaagatttagtaggctttccatctattttttcacttttaggaacaccatgatcctaaaacactagcaaggaacactagccaataccataggtctccatgaatctggctattctgattgctgcttttgaccttgcttttggcagtcgagtactgccacttggcccctgctgccctgagacccaattactccaattgcatttagatttcccaagtcagtaactgctattcccatttaagttctggcctgcagagaagagtggtcctagagctcttcaaggatgttgtggctctcctcacaatctgtttctaacaatatgggtagaaggtacatcttctggacccttttggtgtgtgtgagtaggtcttaaatgacaaattgactctagcattccagtctctctaagcctttgaacctctttctctgtgttaaactgaggcatgcctagcatttctaattcgctcactgtggaccaccttttgctccatgtttcagtcaaccaagcaaccaaactgccagagctctttcaaattccccaagttgcaatattaaatgcaatattaaatatctgccaagtgagctcatatcaataaattcagcctgattcataacttcatattcttttcaccattatcccataccctagtgtccattcctacacatgtttttgggatttttgtataagttaggaacttaggtagttcttttggagtgtagcacacctcttcacggatttcacttcctatcacacttttaggtgcccgctggaacttgagttcagtacaggcatacctcattttagtgtgctttgctttactgcacttcaaagataatgtatttttcataaattaaaagtgtgtgacaacaccacgtgaagcaagcctaccagcacattttttccaacagcatgtactcaattcatgtctctatgtcatattttggcaattctcacaatatttcaaactttctcaaatatttctgttatgaagatctgtgatcagtgattttttttttttgagacagagtctcactctactgcccaggctggagttcagtggtgtgatctcggctcactgcaacctccgcctcctgagtttaagtgattatcctgcctcagcctcccaagtagctgggattacaggtgcctgccactacgcccagttaatttttgtatttttagtagagacaggttttcaccatgttggtcaggcttgtcttgaagtcctgacctcaggtgatccacctcccccagcccatgggattacaggcatgagccaccgcacctggccgatcagtgatctttaatgttactactgtaattgttttggggcacccaaaccaaacccatataaaacaagtaaacttaactgataaaacgttatatgttttactgacccgctgatcccccatctctctccttttctacggcttccctagcatgaaaagtatttccactgtatgaatataccatatttgggttatttgttcatcagttgaggaacatttgggttgtttctactttttgactactatgaataatgctgttatgaacatttatgtacgagattgtgtgggaatgtatgttttcaggtctcgggtatatacataggagtggaattgctaggtcatatggtaactttatggttaactttttgaggaagggccagactattttccaaagtacctgcaacacttatattccaccagcagcgtatgagtgtccacacttcttcacatccttgccaatgcttgtaattatctgtctttttgattattactatcctagttggtatgaagtggtatctgattgtggttttgattcacatttcacaggtctaatggtgttggtctctttttatttgtatattgaacatttgtttatctttttagaagaaatatccattcagatcatttgtctattcttaaattcagcgatttgtctatttgttattgagctgtaagagttttaaaaatatatataatctaaatataagttccctggcagatatatggtttgcaggtagtttctctattttgtggaattgcctttcactctcttgaccgtatcctttgaaacacaaactttttaattttgatgaactccaatttactttgttgttgcttgtgtttgttgttatatctaagaaggttttgctcaacccaagggagcaaatatttattccaatattttcttctaagggatttatagttttagctctatatttaggtctgtgatccattttgtggtattttttgcagatggagtgaggaaggggtccaaattcatttgttacatgtagatatccagttgtttctacaccatttgttgaaaagactagcctttcatcatcaaattttttggacacccttattgaaatcaattgaccctgtatacaaagatttatttctctagtctcattctattccggtgatctatgtatctattcttatgctacaactggacttcattttctcatatgtaaaattcaggaaatgagggtgttgctctataaggtttctatggtttctttgggctctaacatcatctatcatagcagaagaactactgtgagctctaaagaactacccccaaagcgtccccagtggtcctagtggcatttttttctctttctttttggcctaaaatttccagagtgacttttaaatttgagaagataatctatcatgtccagaaggcaagacttcccactttatattttaatccttatacattaacagaaacaagtttttcatattagctagtcacctctttagaaagcacagaaaataggaagctcttcaaaggatttgaagcagctatgacaaaaggtaaacatataatgaagatacttaaataagagagaaaattcgagttgaataaaaagacaatgttgaggagaaggaagaatgtaaaaggcaggatagaaataatagatttaaaggaaaaccaaggctaagagaagctgctactattaatcaaaaggcttatctctgagtgctctgaattcaaggtgagaaagaaaagaaataactcttatggtgtagttagaaaagacaactagttcatcaagaaatacttttaccagttctgaattctacaaaaatgtatactgtgtacatttaatatgattttgaataaaataaatgacactatctttgattactagcttataaattacataaaattatttatattggaacttaatataatttattactgataaacttgtaaaattgtaggtgattctttgttaaaacttgaatactggtatccaggcatatcattgttatagttatatgagccagtacaggagtaaaacatgaggaatacatggccactgtattccttagtctcctttcaattatcaataatctcagccagagattaggaagcatctctaaaatatctaatgtgaatctttaaaattataattcacattcacagacagcaaaactaagtagttattgagcaataaatcacttgttcatatggcagaataagaatgaatgcctggtgtcctgagatggtcctaggatagtgtttcctgaaccattctccgatttattcaaaactactttatgaacagttgggaaattagatgacttggtttgtggcaatgaagtaccatttcccaacatagtttatttttctgtaaatattttattttactactaagaataaaagaaattgctgttatataagttgcacagattggaaaacattggtctgatcaaagttttatgataaatatccttgctttaattgtaattaattgattaaaaacacaaatgagaagcaaagagaaaaatgtacaaagcaatagcaacatatccaattttgggcctagcaattataattatgggtttagaacatccaatctgactttgagataaatttacttataagacttcctactaccaattctgttctttctttttttattcatagaattgataaataaccaataattttctagttatatttgcctttttttcctataaatcctcacaataggacttgtagtccttcattagtataatcaggctgctgaaaactttaacccagttattcgtctattgcctgtcttttcctcaatttttgtttgccctaaaccaagacaccatttcaaattaaagtcttctactataatgttaagttagatggggggggcgggaaatatctttgcattaaggaccaaaaaccacatggcaataaagtagagtgcatgagggccataggcttgcatttttttaaatgtaatttagttaaattctatttttgctgcctataacattggctagaagggttgatatagaacagtgtggatattaaaaactgtagcttgcaaagttacttgtcaggaaggctttctttttaaaaggaaaacaatacaatgggtacaacaagtatcttaagtatagaaagaggaggctgggcagggtgtctcacgagtctgtaatcccagtatcttgggaggccgaggcaggtagattgctcagtccaggagttctagaccagcctgggctacatggtgaaaccctgtatctacaaaaacacctagccaggcatggtggtggacatctgtagtcccagctactctggaagctgaggtgggaggatcacttgagctggggaaggcagaggctgcagtgagctaagaacagagtgagaccccacctcaaaaaaataaataaaaaaagaaagaaaagagcagtgtcagtaggagttgggatggttaggtttgaaaggtttaaaaaaaaaatttaaaataacaactaagtattattgttgtagtgcttactttgtgcactacactcttctaaggactttgcattccttaactcattgaaccttcaaaagagcagtacaagttatgtactattagtattccagttttaaagatgatgaacttgaggtacaaaggtgttaaataacttgtctaagtttacttagctcttaaaggtcaaagccaaaatttgaacccagaggtcgtactcttacctgttctgtcaacattctttccaaatgtgctctagaaaacctggggcatagtgaagaacttgtaagactcaaaggacttttacatgtgtaaagaagggaaagaagtttcttgaagaaacagaaagaaatgtattaatgaacatatatgaagtcatgtgcaccatcttatttaatctttcacaacagaatggttagtcgtgactttcctccatctgtacaaagaaggaaagcaaggttcagagaggtgggtaacatgccgaatatatgttggtaggttgaggtggatcttgagttcaatctcaaatttaattccaaggtccatgtccttttcactgcagaatgctataggatagaagtcaaggtagaattaagacagaaaaactgtcctttcaaaagaaagaacagtttatggttgagaatgtgtatagtacttgaagagttagaaaagtgcatgtagccaaatgatggaagattttgttgccatgtatgatagggtaagcaatatcaaatgctataacagataagtgccaaattctcagaggtctctctctctctctctctctctctctctttctctctctttctctcctctctctctttctctctcacacacgcacaaacacacacacacacacacacacttgttactctcatcataggtcagagaagatggtgccaatcaggcagcctaatacaaggtcctgcaggggccaagggtctttccatatcgtggacctgcctttccttctaaggcagaaggacctgccttagaaattccttctatttctaaggaaatagaacctcactgaggttctattcattaatttaatagaaagaaaaaaaacttaagtgagaggtttttttttctgttttctgtttttctttctttctttctttctttctttctttctttctttctttctttctttctttctttctttattttggctagtcttagaagtgcattctgcacttctagcaacatcccactggccagaacatttgctatatagtaaaagtggcattaaagagaaagaagccagtaatgaggcttggtaatggtccccaaaagagagattagagtcaggaaagctttacagtatgaggagatatttatttagtacatacgataggtcatgctctgtctgagccctgggaatacagcatgtaacacagataaggtccttgcctttaaacagcttacatcctgagaaggggtgagatggaatagacaataaagaaatgaacaaacaagcaagcagacgacatcctttcagataacaagtgttttaaaaagaaaacagagttctgaaaaacaggatcctgggagaaagggatgctacttaagattggatatttaaggagtacctctctgaggattgacattttagtcaaatagcgagagccagctatgcaaagatctgttgaaacagtattctgagcaaagaaaacctctggtccaaaggcgcaagactggggattagcctggtgtgctgaaggaactgacagaggtcagtgtgtcaggagcccctaaaataagaaagaaggtcaaagttgaaaaggggtttgatcatgaaggtgctagtaggccttcatgaggaggctcaattttattctaagtatactgagaatcctccagatgttttattctggagatgtttattccagatatttattcaggagttatatgattcaatcatcactctcacttcctcctgaagccttgcacgaccattccagaatatcatcatcatccccttctctttccatatcatgggcctgcctttccttaaatcactgaggttctattcattagttaaatagaaacaaaaagaaaaacatatcttacatgagagttttattggctagtctttgaagtgcattctgctcttccagcagaatatccagttggtcagatatcccatagcaatttcccttgcttcaatcacattggtacttctggaaatatggatatgcaatctccttaactggaatgtaacctcttgaagagcagacttatatttaatttgtggcttcctcagtaacaaacacagttccaagaaaacacttaggtcttgagtaactacatgaataaatgaatgatgaataaataaataaggaatgaaaaatagttgaaggaatagagagcagtatcctcttgtatttggagtctacaacgtgctttcacttttactgtgtcatttgatccacatgagcacatcgagttcatgggggagagtttggtaactgcacaattatgagatgccagagattagaagtcaaacagaaacgaagatgttaaggctgagcactgagaagaataatggaaccactttggaaataggggatcaggaggtaaagtcaatttggagtaggggagggaggtggtgagagaaagttatgttctgattcagctgataaaaggcagaaccaagtagaatgcccagtaggcaagtaattaaaggttaagttgtgtgatgcagacagaaagagctgcaggagttcagataaatctaataaagaaaatggatttgggactgaggaatgagaatagacactgaagtcgcaaaaagttagactgctgggtgtaatgacagaaaatatttactgaaaataactggatattgggaaaaaggacagactaagtaatgggaaatagatatcaggatatattaattaagataagacatcagaaataaaccatagaagaaaaaactgaggagctgccatcttccatttgtttaattaaaaaatgaaattactgccctactcacagtgctactcactgaatatttccaatttcctacctccaaaacagtggacataggactgtgttatgggatgctgcttcctggctactttgcagttgaggacactgatgtgtctggttctagactgtgacctgtggctgaatgtttgattgccaatacaaaactctgcaaactttcctctttctgacttcataattagcagtgttcaagtaggtgactgctttgtcatccaggatccctgggtgatatagagcataaacaaacaaacaaaaaaaagatcgttgtcattttaagccactgagatattgagggtgtttgttactgcaacataacattataccctgcctgatgctctcaacatcagtgcccagtaagaaaggatgaatgtggagtgaaattgaatcctgtgacaggaaacagtggggaaactaaggatcattaaaaaaggaagagacatcaagttggcaaatgatactgaccaatcttctaacacacttatccccgaaggccttgcaggaggatagaactggaaacttcacggcaggtgtgtttacctacccatccatgccccctccagtgaaaagcaggatagggcaactccttcaggatgatggaaaatgcctcagactggctggctgtgtcactgtccttgacttctcctcacaactagtatgacaggttgatgtggccgagcgtcagaaaatcgagagaacagttagcagtgcttccaggtctccagagccacaatgcctatgacaaaggataaaatgaaccagagacaatcataaccaaaattataaagtaggacaacaatttataaacaggagagagtaaaatgcttgattgggttctgacaagaagaatatatttagaaagataaaaccaagcttacaagaataaagcagaaattgattttccatataggacctaccaatgtagagattagtaaaaggaaaagaagacaaaaaaggtaaatccatttttgttcctacaacgtgcaacatattcgtgattttttttccccatggaggagtgatgggagagtggaagggaagggaatgaatatatttttcagctcaatctttgactacttctcataacctaactttaaattttaggatttgtacttaacactatattgagattgttattttaactggaattctaagatttgtgaactgtaaatgaaaaacatactcattaaattttattttttcttgatactcaaaatcatatttataaaaaaaggatttttttttttttttttttgaaatggagtcctgctctgtcacccaggctggagtgcagtggcacgatctcggctcactgcaagctccgcctcccgggttcacgccattctccttcctcagcctcctgagtagctgggactacaggcgcttgccaccacgcccggctaattttttgtatttttagtagagatggggtttcaccatgttagccaggatggtctcaatctcctgacctcgtgatctgcccacctaggcctcccagagtgctgggattacgggcgtgagccaccatgcctggccaaaaaaaggattttttaaaggagaaagaggtgcaaacctctttagttagtaaaaactaactagagaattctcactaacaaaaggccttgttaccaggatagatggtcaatttgtgactgagttgtagccaaatcataggtgtgggataatcacactatatcaaaatttaaatgtaaaaatctgcctatctttattcattgaccatgaaccaagagctccagtcctcctggtcatatttaatagggaaaaatatgtttggatggattgatggatggagggccaaacagatggatgtatggagagacttatctaatgaggcagcttggtattttgagagagcacaggttttgtgtaaaaaaaaaaaaaaaaaaaatccaaactggtttttttgtgctaaaagcagtctaattaagagctgagctgctaaaatcagtttgcttggcttaaattttggtgtgtccacttactgctgtgtggccttatgcaaatttcttaaccttcctgagtcaccaggttctcattcatataaagagaatttgaacatctattatatgaagttattaggaatatacgtaataactatcatcaatctcagttttctttgaattgcttatctaaagaagtttatctcaaaagtatctttgcctatgtcttaaacatttattatttatactgatttggaggaacgtatttgttctgtcattattgattacctgtatgatagtgtcttagttcatcacagaaattctttatctgactccaaagcagacacttaaataggccatgcatgttagcacttattctactgggggcttgaggtgagtgggtattaacacaatcaaaccaattgtttgggtttgtaaaaacaaaattagtgctttaatctatttttatactttgaatactagtgtaggtattaaataaagagcttaaaccaagaaaaaccataccatcctgaatcttaggaaagttactttgttgttgttagagaaaaaaacaacaggtttatttataatataaaattaacagcaattgttcacaaagacgactttgtttgctactcaaaaggaccctgtgagtgttcctatcctgattttgctgatgaggaaacggggagaaactgttaggaggtacattccttacactatgtcctatggctgataagtgaagggggccaagatctgaacataggcattctggctccagagcccaggcttctcactacctcattaaattgcctctcaaataatcataccgtgttaaatgggctggatgggaccttggagatcatataatcctgtctctttgtattaccgcttgtaactgtaaagcagagagaagttaaacgatctgcccaaggttatacacttccgtctctttcccaacataataacacactctcgttgaaactcatttctaggatttatacaaactaatggcaaagtcatgacattttttaattgaatgcccaataaaagaatcattttcatcttgttttaccatctcatgtccatgagtaaaatgttgaaaacgtgttgcaaagccaaaagggtccttatcttcatgaatagcctgcttttttatagaagaaggaaaaccatcactaggctgagtctgttttaaatgaaataagtatgtagtcattttcttggtgaagagaatctctggggcattaagggaaaagatggcacatctgaccttctaagtcatgtaacttcaacttagacaatatatgacttcaagaaaagtatcatctttcctatagttgctggtcttatatatcttatgagatccttcaggtcacttcactctggtttcaggtagaaaaccaatggggctaaaagtgctttgtgtttccaacagaccaatcaattttatttttaactgttaaagtatttgttgctgttcagtcaatcttttactcttgctttagtcagacattagagaggatgattataagtaagtatattatctgaatgatcttctgatttcaaagtcagggattattttccttgaatgtttaagtggtcatctctaccttttccaaagccagaaagcaagaaaggctgtgggtcatcttccttgaaaaactacataccacaactgaacacaatttaaaattgcagccattagattaaaatctctctcaagggttctacacaagggctcattttggtgttttatataaaggcccagctccctgaccaactttttgaccttagttgagttacctaatctctctgaacctcagcctctctacctgtaaagtgggagagacaacagtacttacccacaggatttttataagagttaaatcctaaaatgtatataaaatttttaagacatgacttgatgcttaataaatctcagatgttatctctgtgaattcagcattcaattacaatgcacttatctagttctgaggcttccgtttttatctttaggcatattatggacaaatatttttgccgctctgattctcacgctccaagtattcattcatttatataacacattcactgactgtctgctaagtgtcaggcattgtcccaggcactggagctacaaagtgagcaaaacagataaaaagttccattattgagcttaccttctattaggaaaacatgataaataagtaagcatatatgtagtttaatataaataaatgctcaggtaaaaaaatagtgtagaagtgacacaggacttattaggatatattggacaagagtgttaaggaagtaggtcatgaatattgcaatttcagataggatgaccaaggaaggctttcctaaggcagcaatattttagtaaaaatgtgaaggagatgaggaaacaaaccctatgactatcagatcatttctgtcccagatcacagcaaacatttatgtaagcaccaaccacatgcactctattttaggtatctgtttcttgactctgtatgtcccaatttaacccatcaactccccgccccgcccaacctgcagtatttctgttctattcttctaatcatgcaggcgaagaattaaccatgccattgctgatgcttgccttctgttcccctgtccgtgcatgccaatgtccatctactcagctgctaagtcctaaaaatttatctccacagttctttcacatttactgtattctttttgtttctgttgacaccagtgtagttcagacccatagtacctttaacttgactatcttaataatcacctcactgatgcctcaaaggccagcccacagtgatcagttcactctttgtagacatccatgggcttgtcagttcacaatttcagaatcttcaggaattccctgaatcaaaataacaataaaagaggttgggcaactctgtggcttgtcaacaacatgcgggctctgggtcagctcacagattcctttggccttctcatcattgaaacaggaaggctacagcaagcagaagcagcacaataaccaaaggcagaaatgagtaagcctctgtatcaatgaaagcttacactttgctatcaccaccaaccacagctgatttcttttcatcaccatggttgtgtcacatatgtgtgcttatagcaatcatgggaaagggaacaccaatcaacatgctttccctcaactcatgaccttctaatatctgaacagattcaaggattctttagcaaggaagaaagggagcagaaatggcttttggatgggcagcaaataatgtctgccaaatcctctactgaataaactattgactatgatatgcaagccttctgagaataaccttatttttccttcttcaacatggtttagtcagtatgtgctctggactctctcatctccatgccctagatcggtttgtctcaatgtgtggtccagcgactaagatattatttgccttttttattctcattcttacacaaatgcacagtggagttttccagaggctacttgatatgtgctcttcaacagattcaatgaagaagcaggtatagaatccagctttgttgtattaagccaaggattaaaggggttttcaaaaatgtacacagtgccattcttctcactgaatttatttttagaaagcatattcatttttttaaaaatgttatctatctcaacatgcaatgggtatgttattgtttctaaatccatcgataaatacaaattttaaatgcctcaattgcattttctaatatgataaatatcaatatgtatagaatgcataaataaaagctctttggggtcttccaataatttttaagattatgatggggttctgtgagaaagtggtttgggaaatgttgtcctggcctagattacgtagcatcttctacctgtgatgccacttcctccatcacgaaatgctcatcctaaaagatttaggtcagaggactcttcctcagtccttgggaggaagctgtcattccactgaatctcaatgtattccttttctattgctgcattacaaatcatcctacaatttagcagcttaaaacaacaatgtttatacctcagagtttatgtgggttgggaatctgggtgtggcttagctgtgcttctgacttagggttcctcctacaactgcaatcaagatgtcagccagggctgcagttctctcaaggctcagcagggggaagatccacttgcaagctcactcatgcgtctgctggcaatactcaggctcttggtggttgttggccaaggtgtcttgacaaaatggctgaaattccctcccttcccccaacccctaagaaagagatggtaggtagagaatggacgtggggggagggggagaagaggtggatgccagagtattatttttataatctagtcttggaagcaacatagcatcattgtggcctgttatttgtggggcccaatgcaaaagaaatatgtgaagtccctagttcaaaaagcaggaagaagttcccttaaagggttttttctttcttctgttggtgtctttttcttgacttcctatggtgatttttacttgctttgtcattctgagtagagaaaggttaaaattttaaataattagcataattttaccattcatttttatattgtactatgccaggtttagatgcaaatataagagcatctaatttttatatagaatcaccaaaattacacaatttgtatctcatagcttatacattcatgtgtatttcattcttacaagaatagtggaaacttacacaaaacgaatttaactgtttttattgcacatcatgatgctcacgcattctaccaactctgcctacctttgcttgctgataagaaatgactgaaaggaaaagaaaatacagtctgccctgtctttttccaccagtgtcataattttcagtataaatggttggctaatccagggaagtcaacttccacacatccagggaagtcacacacacacacacacacacacacacaaaacagtatgatagcgttccttggtcattcgtatttctcaggacattattgccatctttctctgtgataaacaagctctggtttgaacaaaagaggcatcttgttggggcaatctgcttcctccttacttactcatagaagtaatgcacttgtattagtctgttttcacactgctgataaagacatacccaagactgggcaatttacaaaagaaagaggtttaatggacttacagtcccacatggctggggaagcctcacaatcatggcagaaggcaaggaggagcaagtcacctcttacatgcatggtagcaggcaaaaagagagcttgtgcagggaaacttccatttttaaaaccatcagatctcatgagactcattcactatcacaagaacagtgcaagaaagaccccccccccccccataattcaatcactcccactaggttcctcccacaggagaattacgggagttaaattcaagatgagatttgggtggggacacagccaaaccataacagcacttaccttgtacttgctttgagtctcacgagttcccatgactcatggggtcaccagaatcctgcgctcatgaggcactgagaaccatctatgtgaacaaggtggcaaggggaggaggcagacacacatattgaacacagctcatggagctcatgctctgatccattgtctcacttgacttcatttacaaaattcaaagctaaaatgattaagaatatcaagttgatgacaacagaacattaaaccaagttcaggactctgtgtgccctgtgtgcactggccacatgcctgtaaagccagccctgcccatcacttctcctgttttacaagaatagttactagttacagcccacactcaagggtagggcattacacaagggcatgaataccaggaggcaagacccttgaggaccattttagatgttgctgccacatccaacatcatctttctgttttgacttgttcttttctttcgtatactctctatatagttactcatgtacatattattttgtatactgttctatgtgataatctccttaaggatagcgctcctctctgatatatatcctgacatgcctttatcatatgtaatatacaacacaaagcaaggactgaatacatgcttttggaatgaatgaataagtgaattaatgatgcagtggaactttgatttaaattctggtaatcagtcttcgtgaaaaattaccataatgagaagttgaccttaatattttcctcaaatattgcaagattaagactgtcgttattatttcagatccttatttttgcacaagccacatatactgatttctctttattcccccttgtcatgaactgtcccccctctaaacatggattttttctgacctcttaaaaaatcttatttaagttattgttaggggtgaattattgtacttgaaaagaaaattaatgatacaagggacagctggagaatatctggagaaactgttccattggcatttatatttttattttggactgcatcaaaatggcaggggagctacgcccttttaatggcttgcacatgtggtcaggcattgtgtgagcaaataatgcttcccagtgcttgtattcaattttcagaaaaagaaaataaaaatgaacagaagtctttgtagatctaagcattttcttcagttttcttcttcggtctatcccacaatgcataagctttcacttctagatctgtttcaagggtcttttataatgacagaagctaagtctttgtttccaagtagcagaatacagaatgcatcagtgtgccatttaagaaaaactgttttgtcagtcttgtttatgcactcaagataatacagtgttttaaaaaaaggctggactcaacctctgcctgtttattcaatataaacagaagcatcccttttgacgttgtaaggacaggatgtgtgctaatttcaacaagtaaaagccactgcacttggccacataaatccttgtctgaagcaaccttgctgcttcacaatattgtgaaagggcacataaaggatgataacgatgatgcgcatcaaatattaatgtgcattgacacacagtcgtctattacagcaggaaagtacccacagtgagctgctatagggttatgcctcccttcacctttgtctttacacttgagctttccctccacttcccatgcctaagtaaaacaaagcactctgtaccctaaggagcaactccaggaaggtctggcagccaagtgactggtggcctgtttagttaaaataaaacgcctattgggctaatgtgtgatcaagagaggattgacatttattgtttcaggtttatgatactgtgaactgagcaaaagtgaaagccacttgggggcttagggtggggaggggcgcacaggggcaggagttcacaagcaatgaattgtattttttttctttaccattttcttcccagcatgttagcaataaatgcattgtctttttatcatgttttatgtaagaatgtatgaataaccaagcaacaagtcaactccgcagtttagaaataaatgtgttggttaaatagttcagtcagggatgtatttttctctttgtattaagcggcaaaagcagctgtgctgtatctgtgccctgcattcagacattgtatctcccccttgtggatcaggccccctcgagctagcacccatcccatatcctgcttcattttagaatagtaccacacctaaataggaaggaagcaccaggaatctgtttatgcaattctaaatcttccaatttaaaaagacatatgccgaaaaatcaacatattgcttccagacagagttttttattattatggcacatctacagatctcttcccatagaaaatgcaagtactgaattttataccccacgataatatgctgaagcagaaattttgctttttgctacacagaaaacaatttctacactttataagtgatgcctaagtgagagttgcaccaacttcttagatttgaactgtgctgttttccatgtcttcttatgaagcaagtttgggtttttggtttttaacaagaacgctatatcattaaattaaaaaaaaaaaaaacccttctgttagctgaatttttgcctcagataagaccttacccagcatcagcttaaccagtaacttcacacttggttgtaggctcatccttcatcatccccgatcaataattcaaaagctcaatagaaatgctttaaattgaaattgaacacaccattaacagtcctagaaaagtgggcatcattcaaacaaaacaaccataggcactctgtccatcaccaacacaatgcttgatatagcttgaagtctggattcctcactaactaccatgcatttccctcggatcattacttagtcctgagtgagtaaacttctgatcacctcccttcatcttggcattagtctatttcctttataataggcaacagtatacctcattcattccctctttgttcgggcctctctgcttttcgttaattttctcctggccaaccagccaactctggctccctgtggttataggaaattatccatgcaatgaacttaatttagaaaactctgctgcataaagaggtggcagaattattcttctcatagtccagtctatgttgactttcatgctacagcatttcaacagtcattgacatagaaatagatgcttaatttaaaatgtttttgcaaaagtcattggacgattgataaataaagccgaggctagactccaaataaagtgcttaaaaaagtaaaattctggcattcatcttccttatcccttaatggggaaaaactctcatgaaacaccaaccatatatgtactccgcgagtatatattttaaaacgtgtctccattattagaaaatgtgcctgctatgcacacttaaaataggtgaattctaactcaaattttaaaattttactgtagaataattgtttttaaattcattcaggaactaccagtgttctccacatgcctgacacagctctattctataccatgctaacataaggaagcatttcacttactttgataaattgtaaagcttctctctttctgcttatgaaagaacaagaatccatcatatttttaaaagcaaaacaaaaagaacaaaatactgaagggcactcctgaattttttacaatatacaattttatgctatatataaattgaaataatgtgttggcctaatacagcttgtgttgacttaatgcagcttatagtagaatgaagagtgggaagtatccataaaatataattctattttagtatttatgataaatcaactatggaaaaccctcatctatgggaaatacattcaaaattatcacatgaatagagaaatatgggaatattgtgccttagcaatcataaagatatgcataggagatttgtgactgtcacaaggaatatctgtgaatttgtcacacattcatccccaaactgtccccttggcagtgttctttcacagaattccagaagaaacactctatttagtgttaatctttctttagcatgccttttaatcactttgaagcttgtgattatctttactcaatgaaagttgctaaaccttcatccaatgagtatagtctgcccccaagtcaggtgatctaaggataatagacatatcactaaaaaggagctatagaggtgatgagaggaaagctctcccagtttaattctgtgtctgactagcagacctaatgaaattttcccaactaataaatagaaacatagatagaagataaacaaacagacagacagagatatgaaaaagtcaaattagcataagtgcaaagccaataaaactggacttaaaaatttaatcaacaccctccatttctttgtctgcagaaacaaagagtgcccacccctacctccagcctattttgaagaacataaggacaaaccaatcaaaaactgtgcagcctttcctttatagattgatgttgcttttggagaaaaaaataatactgtcatcacctttctgtttcccatgagttgtcacctctctctcaaaactcaggcagaaattacagttcctagcgtataattaggcatgacatagaaataggaagtacctggtgttgatgtagttcccacaagaaaaaaatgctacaggcagaagaggtagagaatataggcagagtcatggatgttgaaaatatccatgattatagatttgtgtgtactcaatctattcatgtcttagagggcaaaggtcagccattttagataaaagcctaggcactcggctttgaactaagaactttgtccatcaacctgccaacatagacaaataagggaatatggccagtgtgcaagaaaacagaaaatagcataaatcacaatccgtacaacttgcatattggcaaactaggtttaggtaaatcaggacttattcaaagatgaataagcaagtaaaaaaaaagataaaaaaatcttcaatgtcttttctatcttccatacttcataacaaaaggaaatcaaacataatacttagtgtgactgattgggagatacttacttcataagcttattgtaataagataaagaatgtaatttatctagaaagcacttagcacagctcctggcaagtagtaaacatccaataaagagtaagtattattattattgataaacaattgaaactaaagagatgactcaaaaactgctttcctgagtccaagtaaatccaaaaaacaaaaactcagtgcagattaaaagaaaaaatctcaggcaaaatcagtgaattagtgaatagatgcccactccaagatatatcataaaataagattttaattataaagacagagaagaaaaactgacaaatatccaggtacaaagaaacactttgcttcctctatcagaagggttctaccaaagaaacaaagccactactaatgttacaaaattagggatgtttcatgagaataagcccctacacatttgtgagagctgctaaagtaataaagtagaacatggtagggggttgcctctgcatgttgagttggtcccaaagtcactatagactaacagggttattaatcaggaagaaaagttgaatgtgagtcaaggacaaaccagaacatgcaaggacaaactggaccacatatctctctctcctagccttcaacttcaatgatgaggatgacctgtagaagatgaaacctttactatgaagctgcacacccacctgggtttggactcagagaggcttatggaggagatctagtgggagcttgagatgctgcaggcctccctgctgccccacaccaacaacttgaggcagcaacagatcagcagtgatcagtgtgatcagcaggtgcacctggcaccctccatagatgtgcagagactaatgggtatagcttcacttccagacaattctcttatggccaacactaacccaaaaccgtgcacaagaggatttctgtgaaatgcagttgcaacttagatacctacaaaggaacaaaaatgagaatgacctcaggcttctcttctacaaatcttaattccaggcaacaatggaacaatggcaactgaattatgaaagaactaagctatgagctaaggacttagttcctgtatttgcttttttcgtatccgaagacatctatcctccttacttcagctcacacagattttcaaaattccttagatttcccacacctccatctgcccctgctccttttcagtttgaagttcttctccacagcccaatgttaccatgtactatgatgctcttgggggcagttctcaaattcacacttttgcttgcgtcttgtcacttagttatggcacatggagtcctgcatgttattctatcacactacctttctatctcttctttccactttggttctagccacgttattctttaaattgctctcaggtttactatggtctctgttctttcagtttggggcccacacataccacaaaatcagtacctaggaggaatggtagagtctgctttgaaagataattctcttgtgtctgtttcaccctttgtctttttctatatcttctcattttctatatcttctcatttttcttactttttcaaattttattctattccctttcttaatttctatacttatctaaagggagaaagtactctggaaccttcaataatcaaaattctattttctttctttgatgttctgcttcagcctagttcttctaagagccctgtgatcagttctcctaggaaagtgactggtaaaatcaaagaaaattgagtaagtaagtgtcctcaaccccagagtagtattggtgtgagaatttaaaaagaaagacaacacctgtgcttgcaaagatacagtctctctttaagatgtaagggaggactaggtattcttaaactttttaatatgcttttcaaactactctgaatgatcaatgcttaagaaaaactattaaatagataaagtgttgttgagtattacacatttgagaggtcactttaaaatggaacaaaagttcaaaagtaaaacaagaaatgtattttgcccttaaagtattagcatacaattcaatatgctgttgaaagcacagacacagagatggttgcaagtcaaatgaaggttatattataattgatactttgaattgttaaggagaagcaaaggtgaaatggaatgcttttactattatttttgttgaaatcttattaaaaacttttaatggaatgcaaactagagaccatcttcaaggtctcaagttaaattagatatgcagccattaatagtatcccttaccataacactttttgaaaataactttcccaacacagagatgggctaatccattttctaacttatttgtattttctttgctatttcagagaaattcatgagctcaaatgatataagatataatcatcatacttactcctgattctcaaatatagttgaaaatatctggattgcaatttatactaagtatatacatatatataaaatgagtaaatttagcattataattcagtggtttgcagtcatgtttaagtgcttgagcacctgaaaatcttgatatttggtgaaaatgttcatgaaataacgacattttaattgaactgaattagaaggaaattcacctgcagaaatatgactttttatatgtatgcaagtctctacacataaaaagtaatgattcataacatatatttgagaattaacatatgtaagatttgccttgcttcttacatattcttggttcattcattttgtcaaatttagcagcacatgccactaggcaaattgaagaaccaacaatactagggaaaagagggtagggaagaaaaacttacaattcagaacaatttcttttttagcttgttttcctcagagcctggaaaaaagctgttattattttattttagtggcagaacatcttggttgtgctcccaacagaatggtttcctagaagcatagtatgaaacctactattttagtgtgtgtatctgctcagacacatttctgaaagagaacactttatctatgtgagcaaagaaaaatagtataactgcagtaaaattttcacattatgaaacctcaaggcctttaaaataattctcatcatccaaaaccaattctccatgtagtgttctaatcattttgaacatagtttacatattattctaattatttgattaaccgcgcctgtcctattgaatcaccatccagcaccttttcaatgccctttattcttagtaaagaaaaatgtgcaaactttaatatatcatcaggaaaagccaatgcaaaatacaaggaccctgaaaaagaaaaaaaaaagacaacatttaaaaatgtaatattttgtgcatgttataatcatcatttcagaggaaggaagcaattctaaaaacaaattttcaaagctatttttacattaacattattttttctaaatgtgcatccattatagtagagttatcttttccttccttaagctcagaattaagtcaatttcctggtatgcaatgtggctttattttttttgttatttaaattgtttagccaaagtgagatcagcaactacttatttatatgtttgagggcactgtgagctgaaataacaaattttgtataacttatctaactaaaaatatttataatacttctcaataatgattctaatgaagatgtattgagtaatttattaccatcttttatgttttaagagttctgatagtacaagttaaaaaaaaatagcctacttctactcttttactgaaatcaaatagatggcatgtgatgattaacataaaaaagaacacattcaacataatatattgcgatagtggcagtctaatagaaaaatagcaactatttatttacttttatttattcgttttatttataatagatatgtacaaaatgtaaaattatttctaagaagatttttctttaaacaccaagcattacagtagatgttgtctgaatgtgtgtaattgagaataataatattgtataataatattaatatgattgtggctagaaggaatttatttgatcacataagtacagcaaattaagaataagatctcagcatatcctggctactacataaatgtagcaaagttattttgctaccttgaaaaaaatacaagtggacaaaaaattgcctaatttcatggaaaaactataattttgccagttaatacatgagattctcaaattcacgaatttaaaatgtttaaataattatacttttgctgcctgaaaatatattggatcaaaatttcaagtgaatatcatcaggggatttggatggggaagagcaagaggggaagaaggaggagaggagatttagtctagcactatttccagctgatccccacccagcattgccaagctacaggacaccaattcaataggatgaagtcagtcaaatcctcttttaagtaatggttgaataaaataaaatgaggggaagaaaatcaagtactctaaatgattaaagcgtatgaataagtgaaaaatgtttgcaaaattgagaaggaaggagaatcgggaagtggttatttatggtgtctcaatatgtaagggtaaaaaaagaaatttaatataataaggataagctaaaagcaaagaggaaacgttgaagccctttacctctcactctgtgatgtatagaaattctaacacagctagatagtttttcctcctggctatctcaagtgagtttgccaattagaaagaatatttgtttattgagagagaatagaaatctgagactcagataaacaaaaactgcctctaacaaggcttgcattcttacagactccagtagaatttatcatcctcatagaatcaaatggtacaaattctccccctcccctccaatctcttgctgtgactccatcaacaagccaaaggcttgttatctttgataagcttgtcacctgaggtaacagtggagaaagtgagggtaaagaggtgaaagattacagtgagaggtaagaaaggatatatcaactctggctcataggcttctaacttgcctaggtggatgtagatgccaattactgaggagggtcaactcaagtagaagcaaatttctgagaaaagaacaagtgtttaatttttaatgttagtttatggtgcctatgagacacccaagtggatatatgaagcaggcagttgaattctagtggttgggttctaatggattctggcctggagaaataaatttgaacgtatcagactgaattgaagagactgcctatagagaaactgcaaagagagaaaaaggggaattaggactgagctttaaagaacaccaacctataaagcatgaaagataaaaagagatattaaacaggctgagaagggggaaagagaggtacaaggaaaaccagcgagagtggtaacacaacaagtgagaaaaagaatagaatgttcatctatggtgagtgctgccaaaaggcataatgagatagttaatccaggcctccacatttctccactatattgatatatggcttttgaattggtctccctgcttcctgtctcaatctctccaatcgattcctattcctcctgacagagggtacttctaaaataggcaactctctctgtcattcttctgctcccattcttcaaagctccctgtgtcttcaaggtccttagcagttcatacacctaccacatggttaatttcaaagtccttagcaggtcatatacctgctgcatgacctggccccacctgcctctccagcctcactgcactcctctccccagtgcatgggaacctccagctctaccaagccacctgtagctccttaaacaatggcttcatgcctctgtgtttgggcataaactctttcctctatattggagatttgtctcccacttctgtgcccgaccaagtcctactcgacttacattccttctctaggaaaccttgacactccaccacaccccaagctcagttaatcatgcagccttgcatttgcctctaaaacaacactctgtaattaatttttttgtcttttcctcttaattgtagggtattgtcttgcccatctttgtatccaaaaaaacagtgatgcgacatgttagatattcagcacagatctgttgagtaaatgactaaatgaatgaaaacactaaaattctgctttgcaatttttcttctacagctttctgccatacttctttattactcaattggaagatgtaatatttggtaatgctcaagaaaacacaacttagcttctttttcctcatttcatttgaggatagcaccttttggactctgattttcattctttggctgcaaaagagaaacatccagttttactggacttctaataactagctgctaaaagaacatgaatgaaagtgtgaaaggctgtaagatggactcacaggatccttggcatatttcatctactgagagcagggtcttcttaagccaggagtcagtattagtgtctcacagctcatgtttcggttgatgaggcatgggatcaaaatgatattagtcatttgattgagtgccttatgcagatagttactgcagagttttaggttgccatgatcaaactgtagtgtccaaaaagattataaaataaatgacccttgatcaatctaacctaattttgacttgttaataaagaaaggtagacatgtattcaccaattaattagacaatgttgaatgaaaatgaaaatcatcccattcagctccctataccctgatttctaatgattttcttaagagttaattgtatctctcaattcaggggatgctgtcagctttggtccatgtgcaagttctgtcttatgatatggccacaaccccaaatattggtaccatcattgttctctgtttaaagtagtctttagaatttataggccaaaaagtgagtacctttctgtgtgacccaaggcattgaatagatatattgatacatctctgtacagaccttatgtttaatcaacattcattttaagtgtcttgtcctgtgaaaacttctatcattttctaagactataagcctatacttttagttagtttaggctgacagtgattgcttgaactatgacactgtattatgatacagtgagacaacaccaacatttgtgacactggcattatgcttcaaagaaaagagaatggaccctagtctcttaagtaacctgacagctctggttccactttccacaatatgataccaagtaaaatcacatgtattttctcatagaaacgagccttcccctaaatgtcacatttcaaatgttttcagctacttattaagtggtcaccattgtttcctgcatatgtattatcttttaaaaatatagttgcccttttatttagtgtggactgcttaaatacaattacttcaaagtgtattatattttaaaggcttgtgctttctgctgtttaaaaacatcgtgaatatgataatcattctttagcctttaaaaaacagtagaccctaatgtgtgcaatttagccacagttgcagactttaatcataaattattttaaaggggcacacatatcgcagattatgtagctgaatggaccaagtttggaatgagcatctaaaaccctgtatacattttagtcattaccagactggcaaaaaaaaaaaaaaaaaaaaaaaagcttcagtgatagcctctagaatgccattgaaccattttaatgtccctctgtcaataaaaatattccaatgacaagtcacagttatcatctttagattcaatttttataaatctttgtttagcctaaaccttatatatcaagatacagcccaatccctaatgttaactaggcacaaacctaacagcatgctgtctccccaggcagaacatgtgtatcagaaaggcagaagaacattgctgcctaagaagtctctttaagtatgcaaagggaggtattatccgctttgcagttgcttgccttattaactacatttactgcaaagatgccttatgagtactaggctctggaaatcatagtcaaaataaaaacattgcctgtgaaaaggcaacatctttcacttcaaagtatttatgtaatatttaacatccttctgttgtagttcatgatttaataatagttgcataagtaatacattgatactcatttttcctcttgttctacctaaacttttgaacccacagaaagtagtttcaaccaaaacaggcccaagtttatttgctttctcagtagctgtccctgcatctttgaaatgaaatagatgtcttgatgcaagtataatcggaagtcagatcagaataatcaaatgatcaaattacttaaattagacacatactgaattgcctaaagaagaaactgctcagttgggaaaggcttacagcagacagtaaccttcaatcattttccacctctggaataaatattgagtcatattttgaaggataggtgatcttaaggatactaacaacaaagattggtacagattaactaaccattgaaagaaaaggctgattgagtttttgttcagaataaggagattcagacagagaatctaaagcattttgggcatgacaatgaaaaaatatgaaaattatataatatggattttaatactaagaatgtatatagatagtgaaaaggctaattgtatgcactgcatgtagcctagggctctcaaactctggggacctttaccgttcacattgattactgaagactgatcattagggcacaaaattcatcatcatgtttaaaataacctgttctacctaataggactatttggaccattgtttggtaattaaataccaaaatgtctaataacctgtacatggtaggtactccatttattcaacaaatatctattgcacatccactatgagctagtcatttaacaaaaattaacaaatatttatcatatgtataaatgaactaatactttttgataattggagcaaaacaatatgcattgatctaattaacatgtaatttgaatctaaactttatgtctagatcactgaaatataagcatattttaaattcagaatgtattcatttacttattcattttttcaacaaatatttattgagtgcctattttgcatcaaccattgttctagttgtgaagagtacaacactgaacaaagcagacaaggtcactttctatgtgtaagtgtacattctagtgaagaaaacagacaattaaaaaaatcaagtatgggccaggtgcagtggttcatgcctgtaaatcccagcactttgggaggccaaggcgggcggatcgcctgaggtcaggagtttgagactagcctggtcaacatagcgaaaccctgtctctactaaaaatagaaaaattagctgggcatggtggtgggcgcctgtaattccagctacttggaggctgaggcatgagaatcgcttgaacccaggaggcggaggttacagtgcagtgagattgtgccactgcgctacagcctgggggatagagcgagactgtctcaaaaaaaaaaaaaaagtatgtaatataccatgattcagagaggaaataggtgctgtgttagatagggcactcagggtaggtttgttagaaaagtaatatttgagccatgcaagtatctgagattaggacattccaggcagagggaacagcaagtgaaaagtgctggtggcagaagcatgtggcatgttggaggagcagtaaaagtctagtgtggttggagcacggaaagagtgtataagattgatcagaaataaaatggcataggtagtcaagagccggatcacacagggcctcatgaaccacggtaaggactacaagttttattctaaggtccaggggaaggaagcctttgctagattttgagcaagggactgattctcatttacattttaaaggcattgccctagctgcagcatgaactgacttgaggaaaggcaagtagaaatgggagagcaattcagaaactctcttatttccctggtaatttatacatatggacttatcttttgctgttttttatatcctgagcatcttagtatcctaattgtggactagcctctaggtttttctataatcaaggaggagtatttttaatttgtatacatttttactaatttttctatacctttgtattccaatttatatactggtaatttttcctaacattataatgagtattttgtgatccaagtgactctgtaatctatgagtatgatacaaagttaaagtcatcacatttctttctaaatattttacatatttttaattatattctgttacttttgattagaactttacattttaaaagtacttttgccgattaggaaaaaaaatcctaaattagagaacaaactagttcatttatttaggggctagcattttatcaaggaaaacataagcttaaacttcaactcctgtgaaggggcccctagctaatacaacatttggatgaataatgaaagtatcctgcatggtttgttggcccaggtcccattgtaccttgatatgtgtgtgatgataatctatctaagcatgctccaaatctgcctgcctgataactgtcaagtctcagtagaccttatgtcagtgacaaaggtatagaacacatactattcagagacacaacaaaagttatcacccagtgattttaaattgtaatcaactataagctaacttatttaaacagaatttatgttttatgctatgtccatatatagtgtgacacttaaagatatttattttgaaaacaagataaaagataatatgtaggccaggcgcagtggctcacgcctgtaatcccagcactttgggaggccgaggcgggtggatcacgaggtcaggagattgagaccatcctggctaacacagtgaaccctggtctctactaaaaatacaaaaaattagccgggcctggtggtgggccgggcgaggtcgtgggcgcctatagtcccagctactcgagaggctgaggcaggagaatggcgagaacttgggaggcagagcttgcagtaagcggagactgcgccactgcactccagcctggatgacagagcgagacgctgtctcaaaaaaaaaagataatatgtaaaaataaaaaatattttgaatttagagtttataactgagcttgcttaaaatagaagactgacaatgtataaaatggatgactagactgggtaaagatgaatcagatctctcttacacactatatataatatatacattgaccaaacaaattacagtaattaaaatactgccaaatttcaggtaataactgataagtctaatgtttgtcaatagcttgttggtttcataaaaatgatatttcctcttagaagtaattcaaaacacccatttaaaaaaacatattatattcctgtagcatccacttactattattgaaagaaaagtctacatttgtttatgcagcttaaaaagtcttctgagatgaagccaagagcaaaaccattttgtacactcaggcttaagaataatatcaattgtttatccagctcattcttgtcttcctaccacccttgcagtctttgctgattcttctctgctggatcctttgctacgtgaatttagcaagttcctctgccttccctgacccctagcacagtgttttgcacagagtagccactccacatagaatggttgagtgaatgaatggattaatgaggattcctgtttgatttttcagcatttctttaatgtccttccaatcagtaaattattcagtgatttgtaagtgtccagggttccaactatgctctttatcattggggaatgcttccttcctggggtggatgctcctaggttctttgttccttctttatctgtagctatagtcacttaatctccaacccgttttcttcacacagtttagtgaaaaatacatagacccatgaatcttgcaatgaggaattcagcccattatcagtacctaaaaaatgcttttgagtgaatgatagatttaggttaaaatacaattctgagttacttgacttatctgggatgagaatgacactgttagggggaaatcctcagtggagaaaggatttacatgtcctcttgttagaaggcaccagggagaccacctgctgaaattctactccttttccaagttccagcttaagcatcacatcctccgtgaaagcttttttgtacccgccaggtgtaagtagttattactgctcagtgatagcaaaatacattttcatgctaacaagcccaagctctgatgactctgttttatgaatatttgttttcctccttctgttgtgatctctgttgccaaccgtaatcacaagcatcatctttgtctctgatgttcagcctagtacctggtaccaagtaggtgctcagctacacttatgtgattcaattgaattaaatgagatctatggtaaactaaaaggtatatgcctcagtggggggaaaaaaaagtggcagtaatagctgcagacctccaaacacctttgaccagaggaccttacctggggttcactctaggagggtactcacagatcctttcctttcttactttttaaagcttaatatttttgagaaactcagaagcatttttatttcaaggcaaaatgttgaaatatttctacttaaagtccttcatcgcaagagtttcagaatagctcacaactatttctgaccacacagtcctctctcggagcaatcagaactcaccggcaatactgcaggaagtcagtgaggaacggctggtttgagcctgtaaactaaaatgccaccatgtgtttttgagtttaacattttagtggacaaacacataagatgaggacaaagagagagatgattcccttcatatgataaactctgcttgaaagtcgcttttatacagacacaaactcaaatagttgtttacaaagaaacattatcttggtccagtggaatgtctccatgcacatatttctttttcaaagtttgtttaaacaacttagaaataaactttcctgatcaaaatcatgcaaaaactatttaccaaggttgataatttaaacatttttaagcaaaatgtcaaaactaatatttttattttaaatgataaagtacagtgttttgaaaatattaaaagtaatataatacttgtgctctaccacctaatttgaacagatgcaaacatttagcatatttgcttttgatcttaagaaccataatattacagataaaattaaggtgttctcctaccttaatcatatttcccgtcttctctttccaggtttcaagtacagtactcctataaatatttctattatatttgtcttcattcaaatatgatatttattatagcatggtataatatgtattaaatattattttttaaagtaaatttaaagtaaattgaccccaaaatcagtaagtaaaagattgatataatcatgaaggataaacatttggtatcagttctaattatgaagagttaataccagcatgatttcattagtactttatttttatactcaattatagcagtataatctttagcaaacatcaattgggaaataacatgttacaaaaacactaagaattaattccatgatgatttgttgcaagtgcacaaatgtcaccttattttcctacctttatatcataagatgaaaaaatctattgaaacttgtgaaattgaggatttgttgttttcatataccacctgtccttcattttatatacacacacgcacaatcacacacacttactcactgcttatctctgagctccctgagagccaagaccaaaggaaaatacaaaagatcttataactgactcgattatctaataaaaggagatgtgccatatcaccaggtaggactaccttgtgttctctgaaaataattatcatgagtgttcttacaataagataaacaaacataagccaaacaaataaaagccacctgaacaatgtagtggccaattattttcaaactagcaactttaccagaatgcaaagctgtaatttgtctgttgtttcttatctttcatggataaaatccaagggcatgatgtgaaattgcagtttcgtgggaaatctaaactgtaatgatgttcatacacatttactcctaaaagccttttgtcaagtgaaagcataacagagggccagttggtaaaacacaaacatgaagccaccccgatcactaaagtgggtgtgggaatcctggcgcttgggaatgtgcttaaacgttcaatatgataatgacagaatgcagcaagtgggaatctagtctaccacatgattcaaaagtgatttttttaagtaactttattgtattgtttttccttccaactttttattctggggttttcatgcttcctgactcaggtgtgtataaagacccatccagtcggagcgaccgcacttctctgtgatcatgaagttacccttggttattgaatatgttttccagcttaatgagcaagcacatacacatgatgctaatgaggaattttgcttcaagatacttttaaaaacgtacatgaggaagaattgtttgctttgagtattttaagatgtaaatgcagctacttctaaaaagaaagaataatcctgaggaaaaggcaatcgtgacctatgacaatggatggagaattaaatcctgcttccatctatcatatgcactgaagagggacgtgggagcaacttctgcctcgaaaggagccttgtttgctcactaacacagtgggcgttaataagtctctgctgcccctgtggttttgtttcagtcattttaaatcaaccctggaaccaggcagagtatacattaatacaaggcattattctccttcagctgtagttaagggtgcttgcatgctgtcactgttgtgatagaagcctgtttgcttctgtcccaatagtgagggcagaaaactctccctatgaggaaagaaagctttcctgagtcacacacacagctgcctccctccctgagcttggcagctcctataataagtttctagtttggaacgtagtacagatcaggaaaaaagcaggaaagagtagagcaggaaggacatggggtgacatttttgccttagtgcttcactacaatatgccttaagtagcgagccaccaaaccctaatgattcttccttttcttccatatagtgaatgcctcactctggggctttccttccttgtctctatacctaacagcagtagcctgggaactagtccctctgcctgcactctactgctagcgccatctttctaaagcaccgctttcatcatgttgaccttctcatcacactgtgctcaaaaacctttcaggcctcctcattccccagaagataaaggtcactccttggactggaattgaggccctttgcaatctgtctagagcgttgtgttcagccacattggatgggaagagttcattctaatcagactgatctgtgatcctcccagcacactgtatactgtcttcctccatacatttccccaggcattctctccaccactcttcttcatctaaatcctactcttctttccagacagttcactttccacctcctcctccctatcttatgagcattaaacaaaagagtcttaaggaagtaggagcaaggcgccagacacaggggaacctcatgataatttcacccccttttctgccacttggtcttggttttacttggcaaattaattctgctgacagctttgccactgatgttttttagatcagtgtgtttaatcacctgtccctctcatctgacaccaaacacattgcatggagtatgtgccatatgaataaagccttttaaagcatgtcactgaatagtgtacattaaacaagaatattaaatttcttaaaatggaatgaataggaaagggaaaaaagatgtggctggagtcagagtagctgagatttctcaataggggatgcaaaccttctcccacagaaagagctaacttgctttaagatactgatttctgaatgcccctccagatattattgcaccaaaatttgtcacaataaatcttatatacagtaaatctggaaaatctcttagtcttagagggtgagaaagagtatctaatataactccaactcaccatgtctgcacatcagaatcacccgtagcatttttgacaacagcgactacctaggcctcacaccagacctcctaaatgagaatctctgagttgcaacccagtcatctggtttttttaagtatgccacagaagattttgatctgcatccagaatttgaaatccaggatttgaaagccagaagttaatgatggacagtatgtatttgattacaacttctcagaaactttgttaagcagttgatatgcatttagtgactacagtcttgagtcattatctccattttcacaggtgaggattctaaagcttgggaaagtgaagtagcccagtgccatccagctagtaaataagcctcattaaatagaggtctaataccaagttccaacctgtagtcacattctccatctgtctttattataattagacattatttcaatatgtggccatcagtctctttcccagcaatagttccctctcttcaaaatgtgattccgttttttggaagtcctgggaccacccagggcaagagtttcgcagctcagttttcctctgattggctatttgttgtcctagtctatttctgatcagtgaggaccagtattcccaagaccttccccatgtaatgggccaacttctatgttttgcatccttataaagagatcgatactaatggcaactaagctttttccacgtgcaagatgagcctggccaccctggaaaacctgagtgcagtcctgggtaatgtttctggagaagggcattattcattcctcctagatttcaaaactaaaaggattgcccactataagttaaaaaaaaaaaaaaaagtcacctgagacctgagtaatgacatgggagacttattagccttaccagtcagttaatgcttttctaccctttgaatacagggtttaatttttcaatgcattttcacatctcttacctcattttctctcacaactcacagtcattcctgcactgcagtttccttacagataaaatacttataatcaagttccatcaaaaggagtgatgtgagagttaatgagtaaatgggcttaaagtatcataagcatcttgaatgaaaggtacacactgtttttactgttattaatataatgcagttcatccattacagatctgacagggatcacagacagcagctctgaccttatttactggccaggccagagagggtctgcgtaatggccccagagacagacaccctcaagagaaacaaaaaaaccacagttaaggtccgaaacaaccagaaagccagcctcactgcggtatagttgggtgctttgaaactaactaggaatattgtatggtcaaaatacggaatggacaccaagtcaaagaccttgggagaggaataagtgacagccatgtttaatagatgaaacaaaatctagtgaaattagagggcagccacaaaccagacacatgaatatgtaatttgctagctgccaggttctgcattctcacactctggcagatgacaaggcacttctaaatacacagagaagcttatttaactcattgcagatcatccttggaagagccatttcaagtgaggcagggaattaaattaatgtcaaaccccccgaaaatattgatgagatagttacaaatgtatgtgagttgtctcaaatgctaccttttactgctataatttaagttccttactccatcaagtggtctttaaaaattatttcctatttctcttctatcttataattcagagagctaaggttttcagtcaatgttaattttctttgaaggattttcagagggtagtattaccacatacagacccctgaaattattattttcgagtaaggctgattctttttctttgtagcctagaagaaaagagatctatgtaatcgcagtgtcaaaatgtcaaaagactgagataggttgaaaaaacgaagaagaaaagaaaagaaaacacaaaaaaccttaaaggcattcgtgcagtcctcagccttacaaatctttggctcacataaaatacttgtgacatgctataattaactagttactcctctcagaatgaataataatgcaattatttgccaaaagcagtgaagggatagtttctgttttcaaaaacgtgtgcttttcatttctgcagaaagaaaaacccttgattaatttacataagttggtaaagtgacctgcagtttcaccattacattatatgataattgctaccttttttctttttcttttttaatcttcaaaacgtatttttaattatttatttagagacggggtctcactattttgcccaggttgctctcaaattcctgacctcaagtgatctttctgcctcagcctcctgagtggctgggactacaggcatacaccactgaacctggctcttctgtcacctttttatcagagccttatgtttttcagtggtttaatgtagcaataaactgacaagttgctatcatgttcaaattatattggtgcctgaaactgtacccaaataccacaaatgagaagtagtagcctgcctggtgaaaacattttcttgccccagttggactttgatgccatcaagattactaactgtttgtttcctgtttcctttgtctgtggaaacacaaataaaaggaggacagtgagccttagttcttcaggaaccccctctcctttggagaccccacatctgccaagtagcacaaagttatctctcctaggtgttaatatatagcacaatgaatattttcaactctttcaacaccatctgccattctcagtaatttattcaacaaccatttattgaagatgtttgtaatgcactgtactaggtaccaggatgtcaaaggtaagtaaaacaccttgcccttgagaaggttgcagaaaagtagaggtataaacaagtaaacaggtgcattaccaatgcagtaaatgcaccatggaggtgagtgtgagccccccccccacacacacacacaaattttttcactcatataaacacacaaaaccacctctaccccatgaatgtaaacttccccaaattcctctttgaaagttttgaagcagacacctggaaaaaaattaatgctaaaactctctaattttgtaatttcagtagagttcattgagctatacatttgtgtgtttgtgtgtatgtgtatttgcgtgtaaatattagttttcatgtggatctttatatagcattttatttaaggataaaatattttgagcaactgatgctttagatagtcaggttaatctaatgcccataaaattagttactaattctaaaaccaggttttaatttgcaatgtcttaaaactaacattcactgatatatcccagtgatgcacaaaaagtctggattgcttgtttgagaagacaaggaccaagagtcaatatgatttaaattcataaaatcatgacatattccaagagtagacatagccttggttttcaaatcctatttactcaaaggattcctttaatcagagagtgataggaatttgggtctgtgataggagtttgggtctgtctttctttgtactttcagtatgtagaacagggcaggctctgacatcagactgcctaaatttgaatttaggctcttcgattttcaagctgtgagacttctccaagtctcaattttcttatctgtaagatgggcatagtaatagtaacttttagaatagcaacctttctttaagaatgtaaaattgttagtgtattcattcatttcatttagctatccaacatgtagttattgaaagtttcatgtgtgcaagatattgggcgggttggggattgcaaagataattcaatcactgcaaatagagatcaagatggacttagagtttcagaccatggtcttggaatcctgcatgtttttctgactgaataagcttaatagacatatatacatggaatatagtaaataatgattatgtaatcagagtttattggtcttttggaaacatagaaatggtaggtccttggtaatccagtcacaacatttccttttccccaagcttcatcgtttttgtgttttgttttgttttgtttttgaaacagagtcccactctgttgcccaggctggagtgtagtggtgggatctcagctcaccgcaacctccgcctcccccgttcaagtgattctcctgcctcagcctcctgagtagctgggattacaggtgcccaacagcacatctgactactttttgtatttttagtagagtcagcctttcaccgtgtcggccaggctggtctccaactgctgaactcaggtgatccgcccaccttggcctcccagggtgctgggattacaggcatgagacaccacgcccggccagcttattgttttcaagccattttagcaaatctttgaagtttcttccacttattcacaaaaaaaaaaaaaatattctccatagatttccaatttccagtgattgctgagagtcacaggaagtatttttaaaatgtactcttgcatttatttaatatatgcaagtatatagagtagggagcaaagatggaagttaatgatgaggatatgcaattgagaaaaagaccaatataatccatgcattcctgaagcttatatcccagggaaactttcacctcaaggaatgaatctatgtcctcctcttgggctgagaataaaaacatcaaccatctatacctgtttcttagccattccatgaaaggctttatttgaggcaacaagagccaggaattttgagaggaaacaaatcttaaaaggaggccttgagcaagcgatgctaggaaaggaaagggggaaggatgtcagcagcagaaaagctgtgggaccaaaatcagattagtcaaactgaaaaataataaataaataaataaataaatacaccaattggagaatcttgtaaaatatcccacacaattgttcaatttggtgttaaagcttaagtgaatttttcagtgaaacactgattctaaccagtccaattcaatcaaattttatctttctgtctgtattagtctgttttcaccctactgataaagacatacccaagactgggcaatttacaaaagaaagaggtttaatggactcacagttccacgtgggtagggaggcctcacaatcatggcagaaggtgaaaggtgtggcagcagacaagagaagagagcttgtgcagggaaacttccctttataaaaccatcagatctcatgagacttattcactatcatgagaacagcaagggaaatacctgcccccatgattcaattatctcccaccaggtcgctcccacaacacataggaattatgggagctacaattcaagatgaaatttaggtggggacacagacaaactatatcaccatctctattccctttgcaccattttgtcatgctatcaaatgggtttctgaactgccaattactttctgtctatatatatatgtgactttttcactgaaacatttagaaatgtacactgtatatatatataatctatttacaaaacatttacaaaaacataaatattaataaaaatgtaaaatatatatatagtgtacatttctaaatttctttggacttaatttggatataccgtcaaagccctaatatcttatctaatttaccatttaggtagacaagtgacagaacatacctttctgtttttcagttgctaacaaacaactttatagaagaccttgaaggagataattcctagagtctaacacaacaacagtcagaatctaaactggtttgaaggcaaaagaaactacctttttaaaaatgcaaatgtcaacctcctcactccttttttatttaatacaatgattaaggcttggcctacagagtcacttatccacatccgctctataagaaccagaagctctttgaacatgtaggcagctcctgatctcaggttttcagatgccaagaatcagctgaggtagcaatgtcatgttccagtagcttgtgatcacatggcaacatcaaagctaaggtaggaacaccgctcctcaatgagttaagtgtttagagatggttgccatctgttgtagctatttgttcctaaataggtaaatgtaaaaataaccaggcattcctacagcaattctcttacaaaataaataaataaataagtaagttcattagcacattttctgccagcatttttaaacagcaatctaggtaattctgacacagatggtctaaggactacactctgagatgcactggtgtgtatacaaagcctctctcaatcaacagactgatcaagcagtgattcccaggaattgagtctggtgccaggatgactacttaagaatatagaatgttagaagctaccctagatttactggagcccagaaatctgcttatgaatctgtatacttaaaagttctccaggagattctaataacacagtctgtggtattagagagagggggttgggttttagcttaacaaatctatgagtgggaccttattccacaatttactagtgtctaaccttatgtaatgtctttggtctgtaaaacagctgttgtgaggattaaataaagcaatacatgttgagagtctagcatgtagtaacctgcttgccattgtatgcctagctctcagtaaaatatacagaagtaaaaatgtatgcttcatgactttgagaaacatataatctatttacaaaaacaacataaatattaataaaaatttaaaatatgagtttatattctaaagctgtaacatggttgtacacatacaccagaaaacacacaagacacaatattcagaataataaaatagagaagtgtaaagatataggaacaatcatataaaattttcttgaaaatgtttaattcttctttaggtaacctaattctcattaaatcactgaatttttatttagattatagaaaaatattaacatcatgagtggcaatcaacttgtatttattattttattatttaaaatgagaggtagaaaaatagtagtgtatatctcggaaggggtttcataggatatgcttaaaggggcccaagacaaccctgaaattttatacagaagggttgtttatatgaatatggatatttctggggagagatctatagctttcatttttccaaagggttttgtggcccccccaaaatgttaaggaccattgaagattggtccttttagtacattttatgtgcgtccttatttatgccaaagaaatacgactcctgattgcatgccaaataatttacttgtttgctttctctgaactgtcctctgagtcagttttccacaagctttaaccattcaaatatcccaagaaaagaaggaagagtaagattcaatttaagaaaactctaaagcagagtttcatgacctcagcctattcatattctgcagatatcagcatggaaatttatgtacatgttttaaaagttccagggcagaaattaactgatgatcatttttgagtttttccttttattttttatccattgctcagttgtttgaattattttccattagttctgtgtttcttttcttctcagttagaaaagtgaaggaacttccctggaaggatacaattcaattttgccaacttgcattttgtcaacttagcaattctttcatttgtgttttatttataatgtggtaacaacactattgatgttacatgtttttatttctctctttttttaggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaaggtaatgttcataccaaaattcatttcaaagaatgattttagtctttgtgcaaaaatgaaaagtgaagaaaactccttattaggcagctattccatttccaaaatgcagtgcttatttacaatggatagtagagtctactgtagcatttgtgtcgattataggattttgaggggctctcagcaaccgtccagatctgtctctatacaatggaactgtattgtcacaatgccataaacacagaagccaatattcacaagatagcagacaattttcttgcaaagggaaaaaagaaactcaaaaacatttttaaaacgaatctaagaatttattagacatccttgaaactaaaagcaaatcacttcatttttatgtattgattcagtacaaatatttaaaatgcatttttaaaagcaagaggtactagaatgttctattttctttcttgttcagaaacaagcattttcttaggttttgttactcctttgaccaatttttctcagttataattgtgaatcttcttcttctcccaaactttagaaagctctcttcattttattatttgctctcagacagaaattgacattgtaaatctgtcttagtatgatgcaggttgcttagaactacagttgtaaaaattccttaattgcaatgaagatattgttggaggaaatatataagtttgatattagatatttaggaagcagttaatcaatttttattgttaattttttaacacagataacacaactacaactactaagtctgaagatgggcattatgcaagaacagattatgcaggtacataatattttcttctacaaaatgtgagctcttctattaaaagagagtcctgggaaatggttgtttactacttattccaaagtgaagcttgcaagacttctaacatgtgctagccttctcttgcttagttcaagctttcattaggcaagagtaattttttgttgaagcaaagaagacatacggtttttgccagagttaaagcaattgtcaaaaatgtcactaagatataattagcttgtctttacagtgcaaatagtacaaataacaaaacatttatcaaattaatagcatcaatggaaatgaatgcaatttctggcaatatattataataaatgcaaatgttcttgtttaaattttcataaaagtcaacaatgaaaagtttgctagtctctaaaaagctagaaaggacagctacaaataataatgcaggttgtctttatttagatgcaaagttaaaaatgtatgtataggtttttttaatagtaaatttctttaacttattttgaaactaaaatgtagtttctcagacatgcaaaattataaagcattttatataaatataaatcatatttaacaattatttcactttgaagaatgtctctagctaatctaacttttctagagtgagaaataattcatgggtatacaactgaaattttaacagatacttaaattttatagaaatttgggataaaatatataaatagtatataggttgataatgatatgtgaagttttttaggcagagcttttcatttagatattaagcaatcataactagatttatggtaaatattcaatcaaaaagagttgtttcttgtcttttaaaatatatactaccatctattctttctttctgaaatttcattttctttaacatcaggataaatgtgtatgaaatttaaaaaattagttaatatagagatctgaaatctcttagaatttggaaataaaaaagatattttaaacatttatattttaaacattttccacattttatcttaatgtttttcaatatgtagatggattttttatgtgctataagacagaaattatcatggacaattatacatggaaaaacattggttctaccaatgtatagccattcccaaagcgtccaggagagaaatttacagatgttccttgaaaagaatagttcagtgatctgtaagtttggaagagctcatacagacaaatgggtcttctacccagaacttctcacagctcttatgttcattataaaatatttaagagacatacatcttttatttatttattttactttttgttgtggagaatttcaaataaaggtaaaatacacaaatgtaggttctatagcttactgaacccacaagtactcatcattcaagcccagtaacaccaacccgtggctaacccagccctgtcctcacccctatcctttttccatactttcataatatgtggaagcaaatcctgaaaattttatcatttcattcacaaatactttagcatgcatcttgaaaaaaaatcaacaattttttaacaaagttacaatactgtaatcatacctaataaaattatgaatagttccttatagtacacagcttttaacaaaattgtttgataacacatttttgtggcatgttttgcagtattgtttccaagaatgtacattgtgatatgctgatccacagaaatattatcaaaaataataaaagataataatgaaaaataaaagtctgaggctaattgtatatattttaaattttaaatgaaaacaaatttaaattgtatatattttataaacaattattatattttgatggtattataagccactgctactaactgcaattaaaatacctttactcctattttgcaaactaattcatttggaaaaatcttcaaaaatgtagaatttatgcatatcttctttagtgaaccatccgtctttgtactcattgaaaaatcaagcctctccctgagaattttgttcctgaaacaaagaactcttcaagttgatcagtgtcaatatacaaatatatatgcatttataaagttattccaataaatatcatgagagattctactgatctctcaaagtcattcatattgcatgttaacattttgcccatttcaaagagatttgataattgaatttttattccaaaaagtatttatatatgggtttggttttttaaacagattatctctaatgttgagtgtcactgttcttaattggcatttttttttcctatcttactgctttattaggcataggaagaaaaaaatacatttttaatacatgcaaatgaaaactcttctgtcactcattgtagtccaggatcttctagtttggtgtcagatttatcctgcaaactctaaagaaaaacttttaagataaaagtaaattttaaaaatacatgtttgttgaaatccaagtataagacaggaacaaagataatgtcaattgaagcttgtaattcctagttaaacatagattgcatacgtcaagattctcaagaaattttagatatatttgtcttcattaatggtttcattagaatacaatatacaccctctttagaaatcatttaagtaatagtcatgttcctcaacatttccaagcttccaatagtatttacagtttcctgaatttgggaacacaaactgtggaaaaaattaaaaggaaccaaatagagagtctatgtgtcattgtcctcttaattactatttcatatgctaaaatctgtccaaggagggaaaacaggaactgtgtgactcgtatccctcaaactttgctgtgtgctcacagctcatttaatgtcacagccacttcccttgttagacacacattcacggactctcccacctgagggaagtaaggatctaacatactatcatttttgccttatatctagttaacactatagattaaaaacccttatttatccctctcagttttttctttgagcctactttaagagctattaatacaggaacacatgtttctgattataaaaatggagatcttcttgaaagaaagtctaaatcttaaaataaattaattgtatctcatttttaatatcagttaaaagagatcccagcaaggatcagcaggaggtgaattaccaaaacgtgcaataaatgcaaacgaagggagcaatgccttcaacaaaactaatatgtgcagtatactagagtgtggcatacttgctcagagatgtgaattccatgatcctcaaaggcacataaatgtagtcaacactaggaaaccaaagaatttgctcaatcatccctgccagtattactttctggttgcatttgatttggatctctattctgccctctctcctttaatgagacccaaggcattacagagctttgaataaagggctttggatctcttcatttcaaagcccagtgacaggatacttgtcagatgagctaaccaggccatttaatgttattctcccttcatcaatataagacttgggcttagagttaggtctgtctctacacccacagaaagattcgggaacacaaattttacaaacacacaaagctagggctttccaggcttttcattgtcttaaattgctaaaattaaactgtcctttgggaagtttttaaatagcaaatgttttacacctcttgaaatttgcaacattttctttcatatatatgtgtatatatgtgtgtgtgtgtgtccctcatgtcttctaatggaaaagaaaaatgaagttcaactatttgtttttctttatccagtatatatatgtatattttctgattgtgttgtttttctgtctaaaagtttggtcatgcttcaaaaaaaaaaaggctatattttttccagtaaaaatgtacttaattttataagttgttagatattttataaaatgaagtcagatgatattggttttaattatctagaaaataaaatgttttttattttatgacatcctacaccagttttcagagtttggagtgttttataattaaaatacatttgtatttttcttccatattttttaaattgaaattgtttaaatagaaattgaaaacataaaatcagaattgttaaagaaaatacatataccagcaacacagactattacagttactgtatttagccctaagtttctttgcaaccaatacaaaagaagaaattatggttgaatcaattcattcaacaaatatttgcagtcaccgcaatatgcaagcccctgtcctggggttttacaaaggtgaacaagtcaacataggtatctgctaaatgaaacttagatttttattgtctgataaaaaataaaaaataagttcagagacaaaagacaaagtttctctatgctaaattataaaggaactatttagcatagatctttctacaaggcatcagtgaaaaacataaaatgaataaaatcttcaacaatgatttttacaaaatacgccaagaggctctccgtatggctgggaatttttaaaatcaatttttgacaacatcctagagcatagaattaaaatatgtataactcaaggacagtgtttctatgacagactaaagtaatgactttcatttatgggtatttccaattttccaaattggaaaaaatacagaggaaatagctatgaggaggagcatgttgagcttattttcctcatggatacataggttgaacaggaacaggagtaaagttaagataaagactatgctggattatagtatgtatgtggggagaagatatttcccctggctgttcgtgaaaaatgtaagtcctggatttcatgtcctcggaggggagacagggcctccctatctctgagtctagctacaggcctgcgtcgagttcctgtgtttacttgttgaacattatactgtggcaattcattatttcttgtaatatttatttttaggaaaatttccattcctcatcttcaaacaataatttatacattaatctcaggtctgaaatgtggaagaaagaaatcagaaatagttaaacgacattctgtccatcctattagtaacatcccgtttttccacattaaaggaagctgacatctggaaagggtatctagatagtttaagtgagttgtcctaataacttgttctctgtagaagccattgcaatttacaaagccttttcatatatactgtctccttcagtcttcacaacaaacatgtgaaagagatactatatgcttttgacaggtgagatatgaggttcagggagattaaataaaaagagaatgtgatagaactaaggttaaaaccatcattgctaattccagaatccagcaagtgtgaggaccagggaagaagtgtcactatctaacaagtcccagctttgggactgactctgcaccctaagcgttaaccatttggcagttccagacccaaaaatatttcatcatgatgttacgttttgtgagatgctcaaaagagttactcaaatctatatattctaagcatcctataagtgatataatgtttgcttttaaatttttccttcttctgtttcctatttttccacatagagaagagaaagcaagaggaaagtgtttgctactgagtaatcctgcattaataaaaaaataaaaataaacagaaagtaaaaatttttagccatattgtgatatgtcatagctttactaagattcactcacattgcttcatttcttctatgtcaacccaataaagcactaagggtacaaatactagaggaaataaaattgagtctcaaagaagctaagtggctgagccggaaccggacacagtattttgacattttgactgcctacctgtgtaaatagggtgcttgcttgatttacctaatatttgccttgattatgcctcaactgtacatatttaggcatggatatcaaatgatttcatatcatatttataaaatgaattaattcagtcatgtggcaaaaacctacatttaaaatggaagctttttccatttgctcgtgaacacaaggagcacttcaccagaaaccacgttttgtctgggccaataatttgatctgtaggaaataaataaatagcagcaaatgcaggcagcagcttgtagcacaaatattggtatcaacagtgaaataaataaaaatgtttgcccaggctattacagtgccaccagactagcctagaatatttaagcctaggaaatgaattaagatgtcaagattttttcaagatttctgagggaaagtgtctcattgcaagtattttcccctctgggatttacattagagtgctgcaaaattcataaagctttctatgaactctaactcacaatttttcctgctctcttgaacttctgtgctttcattgttttccccataaaatcatgtagccagtcatctgtaatattatgttatgttcatggttatagataaacatagaaatggtatttccaatacagatgaagattttccactgaagagttgccttgggccctggtagacactctggaaaactttgtatttatgcaccagttcataaacgcatcctgcatcatttatgtgcactttttcctatttgaaatgctcctttctgatacaaatcgttcaccttgcagtgttacttatctactcttctctgccataagtgtgcagcagctggtttagcggttgtaaccacaagattagagggaactgagtttaaacattggccatgctatcgtggtaatttaaccttgttaaattagttgaaggctcggtttcttgattagttgaagcctcagtttcttgatctgtttaatggagataataagtctacttccaaaggattgaagtttaaattaaaagacatcatgtaaggcattaacaagcaaattagcaagctagctattgttactttccttttggtctgaaaattgaagagaattgatttttatgggaaatagagcacattttatggaatatagtctatctgtatgatatgtgttcagagttgttatacatatattatcctttatggactcgtacaattacaagaagtttctggattatttttcctacccaagtcatctaacagcttgttgcaagagaccttggctgactttttaattcatctataaagaaatatttattgaatacttatttataagttttcagcacattaacacgtctaaatattcacaaagcaaattttctggttttcctctagtcaacataatttatgtatggtatatttagatcacataaaatataatatgatcatgagattattacaacatgaaattcaaatagaaattcagtaggaagacatagcttatgacacaactgcagaatgatgatatcatatgctttcctcaatgtaaccttcaaagtcaatcacttatactctagtccatatgtttagaggacctaaatattcattatttaaaaaaaggaatgtagtatatggaaatgtatttctgtttacataaaacattatttttcactcagaaatgttaatgttcacatgtcaataattcacacacacacacacacacacacacaccccgcaaagagatcaaaacaaatgtttttaatgaactcatagtaaagaaaagacaggtctatttagcatggaagacgaagagaaaaaagctatgtgagttcaaacatctagacaattgctagtggaatgccataattctccaccttaatttatctttttacctcaagtatatgttatttcaattcctaggaagagtaatgtaagtgcaggtagaatgtatgaagcttaaagaagagtaggatatatcccaatgctctgtataatttcaaggcacaatgttttccataaacctagtaaatagaatttaagccatttcgaacaaaaacaacacacacacacacacacactattctgagcactttgatttgctgcttttgttaaagagtctgacatgccccaaatatataagccaacattatcaagagctttaaaaatgcagttctcacatcttaatgatttgaaactatatataaacattatcaactaaaaaagtcttaaaatatctatacaacaaaatgtctcaaagaaattacatttctaaacagctatttgtttcatggttgtagtttgtttcctccagttgttcattcagaaaacacacttttacttttgaacttggatgtaatcaaaaggaaccaaacttgtggaccaaactccaggcataacaagaatgtagtaatcagtgctaaggcttgagggaagtggtggcctagtaatctaggaatagtaatgaggattaaggaggacagtactccacctctgagtcctgaagtgcaggggaggagggtagaatatacagccactttgtgagagggtggaaggggtttggtattctcagaaaaatctagtgtttcagtatgcaagaagaaaggtgagaatttcattgaagcatctgaggctagaagggaatttgccagttctggagcatagttttgggtgagctttgggaagtttttggaagttggggggcagagaaatgggcttaatcaagggccaagaaccaacaagggcagcacattgtgggtctgatgatttggtgcaagatggataactggacaggatatgccagaattatactttggatagtgactaaattcatgatcagggcaggtatggctctcagacttgtggactcagatatctaaattttcactcagaaatgttaatgttcacagacaatttacatcctctgaccagtgttttctcttcctagagttgaattgcctgagaagcccagttatactgaggttacttggtaagcctaactagagcatatattctttagatgtttagggcatcaaggcatcgagctaaaacagcctgatgcaaatgtcaacacaatagggattccactgccctcaaattaggataaataagtgtccttggctaggacctcctccccaactgtcataacttgctctaacattcttgacctgaccatccttggtctgagtttccatttctgggtggcctcccactcagtccacctgtgttctcagatatagtaaatttaatcaggataaaattgaggcctggtttcacggaagccatttcatgactttaagcctgagctcctctgggatctgtagctcagtagcccccaagaaatgaccattttagtatatatctcagtccttattggattgctatgtccttctgcaatgggaaacctgcaaatgttttttcacaaagttaactttgaaaggcattttttaacatatagtttaaagtggtttggccaataacaaagaaaagtgaatattttttcctatggtagatcagcatttatgctagcaaatgctttttatggtgacgttgttaatgtttaacttaataaaacacagagtgaatgtactaattatcctgcatttctgcagagttattgatgcattatcaatgtttgatagcgttacgtaatgttcctgtaaaatatatttcacatgattttcaaaaaaacaaaaaaaaaaaacctctgccttaatctttctttcacatcttctgaggttgaaagctgtgtgtgtcatagattagaaaactccctcccaaaagtatgtctttaaaaatttcatttactaatgaaaataaatgtctgtttagctaaaaaaaaaaatagtttttaagtattcataaaatggagactaaaatcaagctccatttgtcctctagaaagtcagtattccagaaagaccatgttattagtctatagactttaaacgaacaagcgatcagtgctttgtcaggcagtacacatccaaattcacttctgcagattggctgttcgtgtaatgtcaaaattattctacaaatcttgcaccactggattttttcctatttacttttctattatttaaagagcaccagggaagttgaaggtttcctgttgtttgaaataatctctgagctatcctcacacccctagccactcactcattccctacagctggcacataggcctttgttattgatttttgatttttaatgaaatatagctatagaagcatgagaaacaaccaacaggcagaccagggaaacttatctgtaagatggttttaataaagtgtccacattgtcttctatatgtagaaaaattaagagtaagcctaacattccatcaacagtgataggcaactattaatgcttatgtgtctaagtagattgtcagtgctatattctaatattgaagctggttgttttctgcagcttaacatacttccgagctgttcatcttagccatgaattgatacgtactcaggaaacatagctaattgtaatgttatcctaagaaaaccattatcatcttcattatactcatgattatcatcatgattataatcatcaggaaaataataccactggaataggctcattttagttcattccaaaatcacctagaaattatatgtgtgttatctgttgttttggattctctacaaggctattctccaatgacatggataatcatatttttaatttcacttggattttagagccaatgacttacaaatagcattttgcagaagagcttggagtaggatgcagaacttttgacttagtctcatctctgttctaattcatctaaatttagttacttagcttctcagaacctgttttctcatcagtaacatttgaaagtaagattaaccagcctgggcaacatggtgaaatcctgtctctacaaaaagcacgaaaattagctgggtgtggtggcatgcgcctgtagtcccagctattcaggaggctaaagtgataggatagcttgagccccagagtccaaggttgcagtgagccaagatcatgccactgcactccagcctggataacagagtgagactctgtctcaaaaaaaaaaaagtaaaaagaaagtaagattatgatgttgtctttccaactttcgatgtctataacaaagtatatagctttagttcagaaatcatgattgagggaaaattgttgaccatcaccttatggcagcagttctcaattttgcctctaccaaccttcctcctcctcatttccctcccacctcccattcaggggacattggcattatctggagacatttttgattgtctggggaaggggcaggggtaagtactgctggcatctagtgggtggaggccagatatacggctatacatcctacaatgcacaggacaacattatccagccagaatgtcaatcgtgttgtgtttaaaatcctgctttttggtgctagggattaggggaaagtacatattagatgaggtctagaagttaggaggtattgtggagtccagagttggcctgcctaatcattcttgaattctcccgttccccaaaaggagacaaaatcccagaatgaagatcaccagctcagtcatttcatcttgctgcttcaaacacacttttttttttttttttttttctgagacggagtctcactctgtcgcccagcctggagtgcagtgacaccatgtcagctcacggcaacctctgcttccctggttctagtgattctcctgcctcagcctcctgagtagctgggattacaggcatgcgccaccatgcctggctaatttttgtatttttagtagatacatggttttaccatgttggtcaggctggtctcaaactcctgaccttgtgatctgcccacgttggcctcccaaagtgctgggattacaggcgtgagctaccacactcggccccacttaaaaaaaaaaaaaaagatagttgtcccaaaatagaaatgtgaggtttcacaaataagaggcaatatctgtctctacaaaggctcattagaatgatgaaaattcatctggctaaagaagttgtttttcttttagttataggttattgaggaaagtctcacagacataattggatcgcttatcttattcagtattcctaactagtatttgcataacttgggtccctgcttttcttctgttcaaagccatgtcatccttttgttcattctagctacttcttacaaattttgattaaattactgagccaaacactgactgtttgaaagattgtttaatgatgatttttaaggaggcaacagcaaccatttcaaagcttctttatatctgggcacttcctctttatacatttttgtaagccttggctcatagaaatatatttaaaaacaactggctaaattctattaaaacactcaatggcaatttttaaaactgttgtgttgctcatggaacaaaatgtttggcatgccattaaaactgaagtgttcatgaaaactttcatagctcaaggagacggggaacctgaagaggttcttaaatggcaacttagtacccagatacactgtgtcacattcttctgggaaggacaggaatgtgcaatactgttaggtggctccaagtaacagaccctccttggaacaggaatagacctgattgtattggtgtgctgtcttacctactgaaataaagttattggtcttgcaacaaggacagtgaggatatttgtttaaaaagacagcttgaaaaaatagcaaagacaacaggaaatgataaacgagcaagactttgccacaataattactgtagtattgaaacaaatgaataactttcacagcaatgttattttctgtcttagattacactactacctattcatacagtatgtgcaccattgctcttttactgggaaaaatatctaagaaggaggagttggttaataagttgtctgataaatttgtgttaatgtttcagaaaacttacaatgtcttgtgaaaacagactatctctgaaagatggaacagttgttttgttttttatcttcactagttttatgctaaaagtcattaaaagaaaaactgaggtaaatccctctgatacagactggtgaaataatatacaattatttataacctattttgtgaatgttattccatatgtgatttgttagttcctactgaaatgttttggttttgtgaaaaatacttgggacaaattatcaaaaaaactaaattctatacctagctcctaaatttataaatgttatataacttctctgagaatctgtaaaatattgtatctacatctcttttttttcctttttcctatgtttcagatattaaagccctttgtgagatataactcactatggaattgtaagagattattattgacaaagatttaggatatggatatgcctcattctaagtgtttttcatattgtcatcaaattcatattttctagatagaagtaattgtttcatttggatagcataatttgatctaatcttaacaaaattcagactgaagatttttaaattctacatttttattttcccatttttgtgtatcagtatattaactgggtaatatttttaaaaattagatgataaggatgatggactcttttttgatatatgttaatatatatataaagcttcaaatttatgctccacgtagttctgttccccactgattggcttaaatctcattcaaactccatttcccaaaaggataagggctctttggagcaactgttcatattattacaatgagtttttttcccctcccctaatgggtttctaactaatggacgagtttattgggctcaacatgtttagaatgtttcagaatgtgtgcacaaagtatactatgttagtctaagatgatattatttagccttagaaaagaaatctattatataatttgaatgtaatagtaatgcccattaaatttatgagtttaaaatgttaagagcatgttaccccatcgttcctacatttcattccctcatttcagggatttcattgagatttttttctcaatgaatagaaacataaacttttctagtatcatcaaaggaaggattttacgttgtagctcttgttctctctctggataaacagaaagtaaggaagtcaccaatgtagttactggggttcaggaagattaaattctaacccctcccatcatatatatgagactttatcctgtttttaaatttatttggagaaacttagattaactttggaaaaacagattttctaagttttcttgatcacctaatccaatagctaatatcccttgtataaaaaggaaattcatttttttaattaacaaaattttttcactggacttgatttccaacagtgccctttattactttaaaaagaaaaataaaagaaaaaaagaacttacgaagtttacctccatagcttatattacctttaattaacataatattttcagcagatggactactagggtttagcagaatacatacaaactattattcgactttggattacattttgagccttgaaatagcatagttcattcattgctgtatgtgacattttaaaaagctgaacaaacaatattattcttggaaaagaaaagttctttctcactggattcaccatttagaaacgatattgaattgatttgaatcagaaaattgtctctaaaaacttgaaatgaatataaacattaggcagatgatctcacctcttatttcctgctttagtcctgttctgtttcctttgagtggttcttaatattcattcaaacattgtatgtgttcagatgtatcccagagccacagtttgctgtcacttttgtcagagcccaggtttactgggctctgtacttcagagctgtgcaaggctcctatgccctggggtagacccctcttaataagaggcatgttataatcattctaccaggcactgtcatcttatatatcaagagcacttgcatattttaccactatttcttcacctgtagaaagcatatggtgcttttaggtgactaaagttctcctgccttagccttcaggcaaaattcttacattccttggagtaacaaaggttcatatccctttttgccccaggagaaaaaaaaaaaaaggctaagatgcatcattaatcatggaaactgtctactgcaacagtgccaagaaaatgatcatccttgtactacccatcaatattcctgacacctgtctaaaaactcaggtcatgcatatccatctgcctttagagaagtgtcaatgtgcaaacatccttccactatttttagggtcatgttaaaattattcaccacctgcctgtcagttcatccaatttgtaatattatcctgatctaccattgtctattattggtcattcctcttttgcattgtgtttttaaagcattagagtgtaggatgtttttgaaactgtcaaataggagacagtagaatcctactggaggccagagttcccaccaataaattgctacactcggtgtcccctcatgcttcatagaatatgcagacatttcggactcccatttctactgcaagctccacctcaatcttatttctggtaaatgaattattgtttctaatgacttttattataaaatccaccatatttctatcttgggaaattgttctaagaggttaaaacacaccttacaaataaacaaaacttttaaaattaaggagtcaaagaagagctgttctgataaaactgtacatactcaaatgcctagtaatattatattacattcaaaatttaaaatgaaatggaaattttgatagaaaaatatgatgtagcatgagaaactcaagcaatatcttggtatgtctcatctattattcttagtataaaactcataacttctaaaactagctagtcagtcaaattgttcactggtgtcaagtcactttttaacatttgtattttacatctaatgtaattttgaaactagtgtaactttctccatgctctttgactttttttttttttttgcctgttttcattgtcttgtgctaacacctgtgaaacaggttataatatcttagaagtgaggcatttccatgtagatgggaaaatctcagaactgagatttaatgcacccttggttctagttgttgctatacactaatcctcaggaggaagacctgtattaggtattacatttgaccataacctccgtgagtctttgttttcttatctgtaaattacagatcttagatagataatctctaatgtctgtttcatataatagcctacctttctattaatttgtacaataatgacacataaagccatggactgaagtgctcagtccttggtaaataatgacttttcccagaatttgcataaatatggatatggtagaatcctgaaaatgggtagcaaattcagagtgtctcttcagaattgttgttgctgtagtcaacgttgctggcccaaaccatcaaaatgataaattgtaagcctagaaaagtaccagtgattttcagacagtatcaagtgacttgagtttaactgtgacattcataaagtcacgtgtcctggttcttaggcttgctggtatccaggacttcaaagcggcagatataacaaagcaacctaagacctacgaaatctattcatgtggaagatgaaggggcttagggagcttatgatttaattagctagttgggatcagaattttaattagtaatttccttatgaggattgataaatgtattaccgatgctggtaatatttgttatgactttttggaaataaggaaattcaggggcaaactgcacccaagcttctctaactttatattcagaaacccatgttactcaaacaaatacacatatgccaaattataattattcaaataacttttatggcaaatagaaaataaagcattaagaatgctaaagtagaaataatagaaacacatttaattttgcatttactttgtgtcatgcattatatatacaacacgctatctcatctcttcacaacctgcctggggatcaggtataatgaggaaagcatagctcagaaatgttgatgcaatagaacagggattccagctgatgtgtgtaactataactggcaacaagggaagtcaagagtgtttcagaaaatggtagtgtttgcattgagtgtgcctggcagagaagagaaaaaatgttatagacatagggaacaacatttaaaaggcaaagaggcttcagtgagtgggaatgcccagggaatgacaaatagtttcatggctaaagcatggaatgaaaaagtggagcaactggagctaagtgagagtagtagtttgttgcttcaattaagtctctttcctcatttgcaatagaagttaaaatttatcttctgctcaataggggagtcactaaggtattttaaatcatgtcgtattttttattaaataaaaaaaaaaaacctggcagcagagtgaagaacaggctagagagggagggcattaggcaagattaattagaagactacggtcataacaatgaagaatgagtgttgtggatgatggtagcaacagagagaaatacatagattttagttggatttaggagataaaaggttaccagatttgctaactgaccaggcaaagagaagtggaaagtcaggaaaaatacgaaggttcctggttcatctggctgcctagatgaatgacagttccattccctaagatagatagggaaaaaagtatcaggaagagtaggactcggggccaaataatgaatatgttcatttctatgttgatgtcttcatcaacatagatgactggaggtctggagagaagagggcatggaaatgattatgtggtaaccctcaagtagaggcagacgctgggggtggcagtgaattcaagtggaggaaaaagcaaagatgaccaaataaatacctgggtaaccatggggcaaataacaagaagccctggaagcagatggaaattgtgaaaacactcattagcttctttctcctttgttttcttcctttcttcttgcttcatgtttttctttaatgccagatgaataatgatttcactgtgagagttgtattttaaaatgttgttcctgttgcaacacttatttttctgtacactggggcctaacacaatatgccctggttgttttctgtgctcacaaagatgtgcttcctcatcgtctcctggcctgcccttcacaccttccagggtagggctgctgggccactctctttcctgtccatgtcactccatgcattctctctgccaatagtgtattatttccttcactgtgtttaatgtgagcagatttatttatgtatttatgcttttacctttttattttatgtcatcttttctcataatagaaactccatgagggcagggaatttgtcttgctcctccctgtaaatgcagtgcctaaaagaatgcctgacaaatagtagactctcagtaattatttgttgagtaaacgaataagactgagagctacctctctagaaaccaaactacataaaattttaaaggaagctccataccaaattaatatctctttgctttcttctcaagaaattctaaccatactaatattatttaaccaacttataatgcaaagccacatacaggtgctaaaacatatagatagatagatagatcgatagatagatagagatatatatagatatatattaatcataaattaaaaattttcactcctgacaaaatggatcctagttagagggtttaattttttttttttatctctactgggcatttaaaaaacattttaaggaagaacttgtatagaaaatataattccaaacattgctttggaagtaatagcacagcctgtttactgagaggggaaaaaagagaccttcatatgcaaatgtatggcatttgaaaatgtcatatagctacatctacatataaataagctgctctctgaattccagggaaggggagagttttgtatagcgttagccaatttctctatcaaagtaaagtaaactaatagaatagcagtgactcaagatatagaaaagcacatctttactacctcttaatacagttgtggcactccaggtcaaagaccacctggccaaaatccaaacctaaatgaaatcaaatcccacagtgtttgaatggcaatagaaatgaatcagctggaagaaaagggattcacagatcaaaaaactgagaacttcctatcaagtatttgcttcctttctaaacagtgacatgaaaaccaaaggcttcgtgaggtctcctacacttagcctctatgccagaattgtttttcaggtggggtcctaaaggttaagccaaaagaagaaaagatttaatttttacctctttcctatttcatatttgtttcattgcccatatacaagacggtcactttgggaacatttctccggtaaatcctaatatgtaaactaccatatagggataaataactccttgtattaaatgaatttttcctccagaagaccagagtaccattcaattaaactatatttttcctacattgtatggttctcccagctcctggaggagttaattggcctcacttgaataggcagcccattcctggagacgaggtgccctggtattatttttacaataggccatttgctgctttccaagttgaggctacggaattcaccataagaagaaaaaaatcttaataaattattttatgtaatttttactgaccatttcatgcagtccatgtgggagttatgtttccctaccaggaagagctgactgcaatctaccaggggtgcctgcaccacaatttcattttaggtgctaaaaagcataccaaagcctgccctggcccttatatagcatatttataagggagctcaggctgagaaaataagcttctagaatgataactgaagggcaatacttgtattttagagaaaaagacattttagtaagcttaaggtatcaatggggaagaaaaaggaaaattcaatagtcaaaggaaagcaagaaatcagggtggtcttcagatagatcaatataattgcttttttttttttaatagggctgaatgcttggcaattttattagtgcttctctttgaaatgacttttcaatgaaagaattattatcaccattacaaagataaagaaatttaggctcagaaagattaagcaatttttccaaggccacccacctatttaagaagctgagagtatgtataaactgagatccctttgaccacaaagctggccgatcgctttccattataccggcctgcctctcgataaattgagtaacagggaaaaggtagcaagatgcatactggctacatccgaaactatacagtctcttgtggcagatattaaaggaacccaaacaaatccctaatgaggattaaaaatatcgtatcaaaagaacatgttcaggaaactaaaaaaggaaaaaagaagtagagaaaattttgttgagtttctgctaaaagtgctgacatgtggggatatttatgtttttctgaacatctggtggatattagtatgtttttattcacaatcttctgttattaatgataaaagctgagtaattatgatatactgccacaatgaatgaataccatgcattttttccagtgtattacagaatctcatcattccatcaaacataaaaacatagttatttttgaaaagaggaatatggatattatcttattataacaaacttgtttccatcagaatagatcacattgagtcagcaactctgtttctaagagatgagatacacttcaagtcataagatttgttgttattaataagtaattcaaattacaattttaatattgcctttagtttgagaaatgacctaaacctaatatatatttattttgtcaagacaaaaaatccatttctaagatttcatggaaggagagattattttattagcaacagacacaccatggcttttgtttcctttgtaaattgtcaaaatgaagtgtatctttactgaccctgtaatcttctccctggcttctgtctagagctccttcaactatgcaagcctttaaaaaaaattcattactgaatacaattgactgtcttccacaaaatgccagcaatgacacacgctcagaggctaaaacaagcctggcagtgggactgcccataggtgagagcatagcaggtgatggttagtgggtgccgcctttgcagcgggactgtacaatagctcctatggcatggaccacactcctcaatccatgccctctagcctgctccaggcacaactagttcccccacaagccatgctctctctcccgtctaagttttttgtgtctattggtccagcatggaatactcttctgcttttgtctttggctaattcatgttcatatttcatgtatcggcttcagatagccttcctctgagaatgaaaataatataacagccactttcatttattgagcacttactatgtgccaggaacttggctaaacaaagacttcacatttaaaactcttttactcatgacacacattagtttaaaatagctatagtttattgagtacttactgtgtgccagacaggcataaaggttaataagttgcccgtggtcacagataggaaaaaaggaaaacaaacgaaaataggatttgaaccaagacattcaaactcccaagcctgtgatcttattacttcataagtgtgtataggtatctgttatttcacccgttttaaatggaggtcttcactccccaccttccacccggagtctgggcctaagtcctgttgtgtccaacatgggcctcctatctcttcccagtcatcacattgcattgtatttgcctgtttgcttttcagactctttctttctagataaggaaacaaaagccttgaggaatgaaggaaattgccaaaagaccattaacaataataaatgactaagccctctgttccacagtctgcacttttctttctgcggaatgacccttgtaattgtaagccagggcatttctccacagatggatatcccataaaaacaaagccaaagtgacctgaaaagcacagagaaaatgtatgtctatgtccatttcttccttctcaatggttcctttttattcgtttgaaaataagagtgtgaagatgtgattctaatgactaataacaactaaaacatttattaagtgctgattatttgccagctcttttgctgagggttttatatggatcctctcatgtattcctcataataaacctgtaaggcaaatactatgattatccccatttcacagataaggaaatatctacagaggagtatttgacttgatttgggccccataactaataggcagaggcactggcttttaaactcaatttgacacaattactctttatttgtataagaagtgagattattttcagtattgcaaaaattcactgtcaattaccaaactatttgacttagataacatatcaattatgtgttgtgagacaaacagcaaacataccttatgttcagaatcctttagaaaacactgagaaatatttagagaataagagagaaatgaatatgcctaaagctctccatgctcatattttgctcctggtttctttggaatgtcctagcttgaagagatgataaagggcttgtatgggtccaattctgtgttgtagaaaggcagatgggatcctgaggctctgtaaaactgttcctctgctaggcatacttcatattctctatattaaactcatctttaattggcatggaagattcattgttccaaatctcagatgaagatccctatattggatgcaattaagcctggcagcgccctcaaaagacagtcttgtcactgctagccacagccaggacacagtaacagttccttctagtgacccaagaccaataaaaaaataaaactactaaagaagttctgacctccaaaggcaattagcccattcctggtattgccaattatgatagaaaaaaattgccaagctcctgggacatggaaatacactcagtaacatttgagaactggagaaactattttccaaaatagtatgaagacatgaaggtgatttgtagatatttgagtttggagaaagttgagggaaatcagattacacatgtttactacaagagattgttaataagtaaagaaaggctctgatataacaaatctaaacagacgaagtgagaataaaatcttaaattcaaaaacttgaccatccctttttaggcaaaaaaaaaaaaaaaagaagaaaaagaaaaaaatcacctgatgaccttcatttttcaattattagagttatctctactacctagaaataatcactgtcaaattttggtgaatttccttctagttttttatatttcctatatatttttttaattagcatccttctcattttctatgtcatcaaaattcttcatgatttttttctatttaaataacattttatcattttgttgtaacattatttaaccattacactgttgtggaaaatttaggtaatttcccattttttaccattttggatgatgttataattaattaatctctttgtaacctgagtctttgtgcttgaggctcttgatatatgagctactacattcctctttgaaagtctctaccatattctttccaattgatggtatcttaaattttctctgcaccattaaccactggccaactaacataataagtggacttccaaaaactacaattcttctccagatagactaaatggtctacttacaatgacccacactgaacattaacttccctgatattttagagcagcttttatagacatggctggaaattaagcttacaattaaaaaaaataaagaaacataaaaaagaatgccatttgcataaactaagcaaacagatccaaaatatatacatagtaaaaagaccagatgtaaataaataaaattttgattttggccttctttaggttgtgaactttcagtacttttgttcttttcctatctatattttctactattctcaaatcaatgtgaattgcttttatagcaaaaaagccaatatactttatttttaagaaaaagatatatagaaccaagcaatttagtcctccaaaaaaaaaccacattcttcatattgaatgatatacagtatcctattacagtagtatgcgaaacacctatagttatgactgtacctacagactcaactgaaagaagaaggcaatcataggaatctctccaggccacacacacacacaaaaaaaattctgtctcaattatctatagctttcacacaaaattgttttctgatctggaattatccagatgactgactctttcatttttcttctaactctacatgtaaaactctaagacaattatttaccactgaaaaattgtgaagaaaacaccagattaaaaatgagaacacacagaaaaattgggcatgagtatgtaataattctccgtactttctgggtattagtccattctcattctgctaataagacatatccaagattggataatttataaaggaaaggggtttaattgactcacagatctgagcgctggggaggcctcaggaaacttacaatcatggtggaagggaaagtagacacatccttcttcacatggtgacagcaaggagaagtgcagagtgaaggtggggaaaaacaccttataaaaccatcagatcttttgaaaactcactaactatcatgagaacagcatagaggtaactgcccccatgattcaattacctcccaccggatccctcctgtgacatgtggggattatgggaactacagttcaaaatgagatttgagtggggacactgccaaaccatgtcactatctttgttaacttttctctaaacctaaatctattttaaagtagatttttaggagacacacatggcttctggagttctctgcctttagccctctcatgacattagagattcactgaatatttctgacctcaagctcctactttatcaaagaaaaaaccgtatctatacacaaacacataaatatatatgtatgcatgtataggtatatatatgcatatgtgtatatatgcatgtgcgtgtatgtgtatatacacacacatatatataaatatgtattcatgttcttaaacttacatacctgttaggagtgttgcagtctcaaacaaaataagagctacaaaaacaaaattttaagtcactatatgattataaaataataatattatttaataatcttttggcaagtagaaaacctacgttatataatggacattgaagagaccaaatctatgaactttttatcttaaaagaactcttattttcttgtgataaatttttcaaaaagaaagcaaagttttgcttaaaagcatttctcactgatgtttctgcatagtctaattttttcctttcacttcatgatttacttatcttgcctttaaatttacatccccaaattcttcgtagacaattacaaatgtccttcctcctactttagatatcacgtagctgtaagttttcatttcttaatcatacattatcttactattatttagtagctagttcaccccttaataattttccactgaactacggattctttccagttaacatcaattctactgtagacatacccaaatataaacatagaattttcaatgtaatctcaaaaatcctaataagggatatctgtcatgtttatacattggagcttaaatgtttcttctaatttttcccattgtacaaaatagcactaccaagatgttttagccaaaaactgcatcatcttggaatagttcctaccattttgcaatacataaacaggtcatattcaatccacctgtaaggtacaagggaaataaaagtaattttttcccttcttccattgctactacccaagttgaagactgggacattgtctttctcccacaccactgtactggtctcctgtttgctctccctgcttcctctgtgtccccttaatgatcaatttttagtaacagacagatgtgctggaaactacccaaatgctttcccattgatctttaaactaggtcaggcacagtggttcatgcctgtaatcccaaccctttgggaggccgaggtgggcagatcacctgaggtcaggagttcaagaccagcatggacaacatggtgaaactccatctctacaaaaatacaaaaaaaaaaaaaaaaaaaaaaaaaaagctgggcatgatggtgggtgcctgtaatcccagctattcgggaggctgaggcaggagaatcacttgaatccgggaggcggaggttgcagtgagccaagattgcaccactgcactccagcctgggcaacagagtgagactcggtctaaaaaaaaaaaaaaacaaaaaaacactaacgcaatacttcttagcttggtgtatagtaaggatcttactgacctctccaacttcattttatccctctctccaccatagctggcacattctccattctagccacaaggctgtttcctggaacacctctttcctgcatttgtctttctctctgtgttcactcagtcagaagctcttccggggctatctctgaccagctctttctcatccttcctttcctcaatatgacttttatcacctctctagtatcccacgctactattctgtatctgagcaccctattttttcctgtgacatttctaatttagatgttgatttttgtttttatctattgcctatctcactctctaatatgcatgctcttccagagagaaactgtctatttaactcaccactgtacatactatacctgtagtatttaacacatagaaggaaaccatcaatattttaaatgaatgaatattattgatgaattaattaggtgtgagtaggatcaagctctagtaaatttagaaacctcatgagagaaaacatgtttgttaccttctctggatccagggggctatatagtcacacatcaagaaacaaaagttgtgggttgctattgacaacatcaatcaaagcaaaagtgaggggctctgtttgatttatcaatgtcatatttcgctcccaactctgaacatacctattttgtgctttttctatttcaaaataaatggctccctataagcccaattctaaatgttagccattttacttctaggaacaagatagaagtttgactctctccaaattcaaatttgtacatgttttataacccctattgatttcttgagtggttaaccatgtacttagaaaggagtgtaattatatacctggagggtgttaaacctgttaaaaggtaaactaacactataagatcacaaggtaccatttagttaataactaatctccagccctaaatgatgtccatgtagaagtaaactgtttagactcacattggatccttaactgtttctaaagtagttttttgcactccagttatcactgactagaaattaaggaagtgccagaagcaagtcagttgttcaaaactgggaagaaaaaaaaatgaatcttagctacacatcagctcttaaaaacataattttggggatgcaaatgcaatgaatcacgggtacttcaacttaagcttaagctaaggtgatcatacaattcatcattcaaagtaggaaacttttgagagtaaaacagtacacgattaataatttatgctgggaaaatagacataaataaaggaagactttccaggtcacatcctagccgaaaccaatctttcagctcactttcattgactccatttggactattaaaagatacactctatcaatatgagtttgattggtaaatggttaccaaccatgtacaaaccctactttttctagggctgccataacaaaattaccatgaatgaggagacttaaaactacagaaatttattatctcacatttctagaggctaaaagactgaaattcaggcattagaaaggccacactttctctcaagtttcaaaaggagaatttttcctgggctgttccagcttttggtggctcctgcatgttttggttttagtggcacatctccaatgtctgctgccattttcatatgaccttctgcttgtgcgtcttcccttgcccttcctcttgaggacaccagtcatggatttgggacccaccctcatccagtatgacctcattttaagtaattacttatttccaaataagattacattctgaggttccaggtgaatgtgaatttggggtaaacatggatctaccaaagacagtaaccaataaactattggttccattattttaccaatcactagatataatattttgctgatagaaaaaaaaagtaatgctgggcatgaaaaaaacttgctcattggtattactgtgtctctttaacaggttaaatagagggacaacacggaaatctaccatggatcttcacatcttaaaagttttattttaggcagcattatcacattcaatgacagtcttactgtgcttaaacacaaagatatttgattcactgacatgtaccaatagatgattgagaaataccaaaagttgttaaattcttcagggcttatactggctttggaagttattttttagcaaaacctataaaattctgtgattttcttagagtgattccatgacttttttattgccagttttatttagaatgctcatttaacatgtcaaacccaccttcagaaatactcatagcacaatcagctacatttgtttctttaaataattttatcttattcctgactatgagaagagatggtatgccttctggctctttcaatgagaattgcttacactaatttggtcaggtactgtcaaatggcagtactccagatttataaattaattcagatctacacaataaattctctcattgccatttctgggccatgacatcattcaggagacatacacaaacccatcaacatttgcttatgcttgacctttcacaccattcatggatatccttcttgtctttcatgattagcaacacatttttgctctgcatatttttaccttttgctgaaggagactgaaatacataggaaatatggctcttacctatgcacctagtctttttgtactggaatgtatactttctattgagtagacttctctgccatattgcaccttaccttgtcacctaaggtagggattgattgtacctttatggacatttcactgaagtggtgatgagctggctctgatgcaaacaaccaggggcattaattttttcaaagccaccacactgaggtagaagtagctgccaaacatatctcctatgcctataatattcatttatttattcattctatatattgaacactttgtgtcagtctctgtcctaaacgttagctctctctctctatatatatatatacacacacacacatagatacacacacacatacacaaacatacatacatatatacacaaacatatatatatatatataaacctggaaacaatacacagtctctgcccaaagagagggtataatctagtgcaaaactttcttatgtgccctgaataggtaacaggtgtgttagtgcagtgatccaccttagccttctgggtggcttgggtggctagagccccaaggcttataatgtcctctttttaccaaaaactcaatttatttttttctgtatgtatggtgatgttaaaaatttggagatgccataatctaatgcagtgtttcccagaatgaagtctgatggaatagtcccacaaaatgttcctccaaagagcagggaggttccattgagaaatgagtctagaagcactacataatgcttgtcccctcctggcatctcacagtgtaagttagccttttaagggctctgaggaaagcagcagtaaagaaaccaatataatttggtttaatccactctatcccaaatttatttgactacagaacccctttttcccgtgaattctgctacagaagtagtcaggcatcaacagagctcccctcaggaaactctggtctaaagagcatgttctatgtccgtaaggcctgcaatttagaagcacaggtggccatttgtcctgccccatgaaaccaaagagatatttctcaacttctgcctcttctattctgctgtcaatacccactctttgttttaatatcatttatctcagttgccacagtgacacaaatagtaattttgcctccaattgttttcctctatttgtcttctttcctgccgctgttacctttcttgtgacttcatctttcccacggactagctgagctgatatagatatcaccagtggcccaatgctcctttactctcatctgtaaattgaagcaatcataaacattggtataatctgcaccttttctcagctgtgttatctgttcctgtatttgcaaggatgcttcatttgctttcacacagggtgttcttgttgtcaattctgttagttatacaacagagtcattaaagaagcctggagatttgaaaaaattggtctccaaatatctgagaattgacaaaatctagaaatctctcacagatgttggcacttgttacaggcacacaggccatacatggagtggagtgttctcaaaagagacaaagacattctaaaacagagtgagttttccaggctgactacgaagggtaaggaaggcttggcaagctgaggtcccctgaggacttcccgtaacatccaagagtggatgcgggaagagcagcagagggcaaaccatggctcacacactcatagaccacagcggagactggcactttacagagaggagctaagatagacctgggaccagaaaggtgggccactgtaggacagttatcaggggaaggaagggggatccagggtgcaggaaagcctagcatcagatagccaaagcctgcgagaggtaagaaaaaatggtgacgtgaggtcaggaacaccaggctgcacactatttgcacgtcagaatcacctaaagcaccttttaaaagacagatccaggcccctcagctggtaattctgattgagctgatcaagaccaaagcctggaaatctatttttcacaagggaaggaggtcaatctgcactagaacaagaagcattgcccttaaaatgggaattttagtgtactataattctattttatccttaaaattagctatttgtaagagatcatagtagaattgtgtttatacaaaactcacagatatatatatatctatatacatacttctgtgaggggtgtcagagcatcaacagcatcctctaagatcctgtgatgtccaaatacagtactaaggtgctgtacctataatacctataaattctgctcaggtatctagcattgcataatatccccaactgtggctatctacaatttctaaactgggtagttcattagtgtttagaattaaacattaaacttaaatattccatttaaataatacaaaacatttctagctattagaagcacttttactaccaattttatggaacttttcagtttcctttttttttttctcagaagttcagttttaaaccagttttcatcgagaattttacatttcttctagtgtcttttctcaagcacttttgagactgtgctcaagaaagcctattgaagagtaaaagctatacctctgttccttagtttaataaattataaaaacccctccagttctttttaggatgctcttgtagaaaaccaaactgatcactagttttatttatcacagtatcatcaagtatatctgtgctgctaattgtggtgtttagcatctattaccataaaatacttttaagtatgagaataaatgcatggttttattctgaagctgacaagtaaggaaaatgttttattaatttaaaatactagtttctattttgaaattcatttgcctgttttttgttttgttttgcttttttaaataaaagtttccttctgccctgaaaattttcaatattctcacttctggacaatgctatacacacagtgtgaatggccaaattagaatctgttaattcagaattgaccatacatagttccactgtgatttttgaggtatgacatgcatacaaatgacaaatttttccacctagaactaaagttcccatacttcaatctttaaatgaaaggggtaataaattcttcctttcaggatcacacacatccctggctaacagaagtgatattatttttaaaactcgatgatctgttcatttctccattagcctcaccagaagctgtggaaagaagaaaccacatccccttctctggctccacttctccaggatctgcagccactcccctctggcagatattctttcataaggcagtacttacagtcccctttgacatgccaccctcacctacaaaaagttgttcccatgaagcaaagttaagattccttttctactgcttttacttttgtatattttctggaaacttcccaatatcagtagagaaacctagggaaacattcctttattttaaaaactatgtattcatcatcttgtgctatgttctgtgctacgtacagagactacgcaagttttttttttttttcttaaatcaaatatattaccagcctttaaaagggagtttctgaactaacgtgtcacacagacaagtaaacaataatgaagatttggtgtggatggtgccagaataggagagtggttttaggtcagaggggcagtgagcccagactgaggagacagaagagaacattgcagaagtttcttagaggaaataatgccaaggatgagacctaagtgatgagcaggactttggtaaacgaaaaggaaggaaagtgagcattccaggcaaagggaatagcatatgggaagtcccagaggggagagaaaaatttcatatgatgaatgtaagaagatgcagaagaattgcaaaaggtgagaatggagaagctgggactagattctgaattgccttctgagtactgttagcatttggctcattaaaggaacagtgaggaataacttgagaattatttctttgggaagttttaagggcgatcaaaatgtactcacgttttctcttctagaaagatcactctggcctaggtggaaaacatatttcgagagggcaaaattggaggcatggtgatttgctgacatatggtctgactttagtgagtagcagtagaaatgtagagaaatagacaaatttgggagatacttaagaagtagaaatcttggtgatttactcagttagaatttaaaagtgaaacccagatttcctgtttggtcaatgagtagataaatatgcctgggataagaagcaggggaaggaagtgggagaaggatctgatgagtttgaggtacctgggagaccctaggaatgttgatatatagatatgaaactccataaaagtgtgatcacctcatcacctataaaaagttgatctgggctgactaatcaatatttggaagtcagaggcagtaaaatgacaaataaaggccttgggtgatgatgagctctctcagggaaaatgtttaaactgcaacaagagaagaaccttagggaagtatcaacatttaaggaatcagttggaaaatgggagcctacacagtagactatgaaggaccaaccaaaaagaacaagaactgggtggtatcatggaaacccagggaagagagggcttcaaaaaggaggatgtggtcagctgtagtgaatattactgagagattgtgatggctgaggcctgagaagagactactagttttaacaacagtgttgttggtaacattggtcataatagtttctctgaaggggtgaccagagagctgcaagaatgaggagaggtgagtgcagaagtgaagaaaaggagcagagacaacacttgtaagtttcactgtaaatggaataaaggaaacgaggtctaccaagggacatggattgagagggcctttttcatttttattttaagaaggaagacacttgagtgtgttgaaatgctgatggaaatgagcaaagagtgaggaagagttgaagatacaagaacaaagggagataattgacggagagcccttgaggatgatggaggggttgagattcatgagggattggccctagacaaggtacatgggttaaaaggcagaaagaaagaaagaaagaaagaaagaaagaaagaaagagaaagaaagaaagaaagaaagaaagagaaagaaagaaagaaagaaagaaagaaagaaagaaagaaggaaagaaaggaaggaaggaaagaaagaaggaaagaaggaaagaaggaaaaggaaaagaaaaaagaaaagaaaggaggaaggaaggaaggaaggaaggaaggaaagaaagacagacagaaagagagaaagaaagagaaaggaaggaaattgttttttagagtagcaatagaatctaggtgggataaagagtcaggagtcatcaaacacaaatgataaataagatatgaaggccagatgttgtcgtgtatttttataagttcctaactatcatactgtacatatcacactggaaagagccctgacttcgacagcaattctgtttacaagttgtgtaaattactaagacaagtaatttaacctactttaatttcattttcctaatctataaaaaaatggaaattttataaatctaccttgaaaggctatactaaggaatacattttgaccatgttaagtattaacacaatgatggtcctgttgtaagattctcaagtaatttaagacataattactatcatcttgtcttaagaatcagttttcttgattgtctttagaagataataagcaaaatcactgagcgacaaccaatagctttagcgtatggatacacaacacatagcatagtgccagacacataatagctactcaagaaatattcatataataaattactgaaagacagctttggtgttctatctgtgttattcagacctttgctttcactatattccagtaaatgctctagcctcaatcctcttcactctctgccagttagtcacttcagggtcacagaagaaaacggttacatcacctgaggaggtttgtcttgactatccatttctgcacacgcagcctacaaagaagaaaactgcttggctcacatggcccagaagactagagtagatgggacctgacccgttgcttctttcttctgttacttagtgtcattttcagcattgtcaccaatgaagctcactaagaaaggatgcctggattaaccacaagcaaataattttggccaaaaatgcatagatttagttcaagacaaaaaggaagagaataaatatattcttagcataaaatggcttcccatggcattttctttctctaaagtttatagcaaactttgtctcctgagagcagcttgaaagcaaggagatgctgaggggaaaactcaatggggagagctgcaacaaattgccccagataagcttaaggcaactccagctctggactcccaagaggctaatgaaccatagattcctacctcttcccaaggcctgatacttacagaaatgttgtcaaagacttctaaagttccattaaatactgtatttttaaaaggtcttcaaaccaagacctgtaaactgataggagttacccacttgctgagagttaataggctctggactgagtggtgaagtttgaaaaggaccattagagacagaacacaacttctcccagcggcctgctctcttcactcttctgagggctctgccatcgaaagccaggcagggcattgccgagtcaaaaaacagagcaaacagctaaggagctacttattttgcaattaataataaaattttttgaggtccaggatttctaactaaatctacatgagccttgttatgccaaattattggattataattgtatttggatgtcaagtgaaaatgttgcatacaagtttttctcccaagattttacagatttttcagtatttatctatgtaaatatattacaaatagaaactgagttaataaaagcccatgcaaataatcatccactattgttgcatttcaattactccagtccccaaattactatgtatatttcagatgctggtactttttccaatttaaattctagcaatccctgaatcatgtcatcaaggccttgcctgataatccagtaacatggaaattagttttcttacactttattttaattttatgttcaataagaatatttatagcatatgcaagcaacgataaggataatcacatttcacattttatattagtgcctatcaatggtggaatgaagaggaatttctgtttgtttgcatccatcctgttcccaacccataccactgcctcactagcaaagtttctgatccaagtagtttcaattatttttctgaaaaaaatagaataatgttcaacttgcagaagaaatgttaaatttgtagcaagaatgttgaaggacttggtctctgttttgaagtgttattttctaagtctttaacagagattaaataacaagaatgttatgactgggtctctgctctttacaaaacttgagaattgattgtatccttaaattctctgtgtccctcatgctaggctgtcacttttaactagcatttttatttgagtctgtgtcccagaagctttaaaaaggagagactcttctcatctactcgtatatgccttgcagaagctatgacagcaggtgaggttattgtggaatctgttaagttgcaggaactcagacttcattacattcagaacccattcaataggaatgcttttctagtctttaaaaaacttggattgcaactcaagctagatatgaggttttactgcctcatatgtttatacctgataagataaggagaggaaatcataagaactgtatatcttctttgaaaccaactctaaccaacaatgggaacaatcatgactttatttctgtatttataatttatttctgtcccaggcacaatgtaaatataaggagaacagaacagttttttccttttctagttaaataaaagtagtttcattttgctttggagaaatggcagtaagtcggggagggtaaaattaagtaattacaaaaggtgtgtaagaatatgaatatttcaatactggagtttccctctactgtcattacatgtaaaaaatagcaagattacataaacacattcaaaactgaaaatttttgtttttctatagaagtatgacacattttgtggaccaacagcaaaagatagttgaaaagataataaaccaaactgtaatactcgcatgtgcgtgtcaagatcatatgggatgttaaagcatgattttaaaaattgaacttaggtccactaaacaaaagaaaggcaatacattacatagtaaaggtcctctctgctagaatgtctgaattatagacacagtcaaaatttaagatattttataccctttcaaaaggtagcatgtcccataattaaggcaaaagtaatttattttgtttaatatatataaataatatctctatttctctacgtctttctcctagcgtatcaaaaataatattctctagtaaatgttagtaaatattcatgattaatcataagtaaatattagcaatagaaataaatgttactttcagaattcaatgaacttagagctctgaagtaatctaaccgatatacattaacagtctacaacatccctgagaaatggccacacagctcctttcaataccaccagaagcccactattttacaatggaactcactcattctcctactgaacagctctagttgtttaaaaatatgcagtggagatctgcccacctaaaacatccactaaattcctgatgtttcctctagtttaggatcttttcaattttctcagaaacgcttacacagaatcagactcttctgtatgaatcaatggcctaagaatttgtatacatttgcaataaagtcctgattaaagtggggcattaccagagaaatatcatttgaccagcccccaaaggcctcgcagactgtagtgaacaacgggtagggtctagttctctggtctatacagcacaagtttgaccttaaaaaacttcagaattgagtgggatgaagatgacatgtgaccccctcaaaaaataaacagaaattcagaactagtcaattctctgaaatgaaatatgttaactgttaaatgggtaagatattcatgttgttttgtcaaagccattccaatgtgaaggctacatagaagtcgaattattttaagaatgactagacaacagagcatcagaacaagagaaatgggttaactgaataaatatttaatagcatcagaaactaataacctggtgcatctatctctgcacctgggactctgggttggctagttcaggctggttttttaagacacaccaacttgggctgggtgtagtgactcacgactgtaatcccagcactttgggaggctgaggcaggtggatcacttgaggccaggagttcaagaccagcctggccaacatggaaaacccccatctctgctaaaaaatacaaaaagttagctagtcccacatgcctatagtcccacctaagagggaggcagagacacgagaatcacttgagcccaggaggtggaggtggtagtgagccaaaatcacgccactgcattccatcctgggtaatagagtaagactctcaaactaaaaaacaaagacacaccagcttggagagcacttggatagataatacaacttaactttcaggacttctttggccaacctttaatctttgtccaaaggaaaacattctcttttttagaaatatggatagatttagtcaaattttacactgtaatatttctgctttgatccataatgtgttcctttgatagattaattatctaaacaacatcttattttcaactttttagggaaaggaatacaggggcaatggtaaacacatacacacacatgtacatactggactgtattgatttaagtctgaactgctaaatctggctttgccccctttctacccacttaaccttacttgacttgcagtaaggtaaggcctcaccatttgccattctctgtctctttagctttccctgtttctttccctgcaagcaccagggtagaaacaatatgagtagctgtactatagaacagcccacttcaatagctcttgactgaagtgttgactagcaatgggcatggagccctattagctctgctgcagataactcagattgtatcagaattgttttttcaaagggtcaggaactctctagaacaaaccatttgtaaacatttaaacaggaaactagttgaggattttaaacacagacatgaagagtttctaccatagccttttatctattttagaagaaagagcacaacccttacattaaacctctttttaaatggaggacagagaaatcaatgtctaaatcataagctactgaaggaaacatgcagacttccagaaatatataatttttatataatttaaaatgttttaatgctttgttattgcttaatacctactatacataaacattaagatcacaaacactatggttcatatacatgtttgtttggatattagatttctgtgtttctactcttaatatactaaaatcttgtttctaaaatatgtctattgcattactagcagtggttatatattcaggttttcaatcaactgatttacttggttggattgactataaatttgttgacatatattgatgattcctcattttcttgcccagagatcatttcttctactaatttattttcaatctctctgctttcttatttgacagtatcctatgagcagcataacagagcactccaagctcataaggaatagtgtaaactaattagcagattttacaatggaaactattccctacccatgtgatcaccctggctggataatgaactttgtgaaaatatccatctcttaccacactaaggcagcagcctcattcagacaagctcttatttttcccttatacttcagttcataattgtgaatatggcacgaatccagaaacaaactgtcagtatggggtgaggtacagtgttaaaaataaaatagactaaaaaccggattttcactttaaaaaattcttgacattcttttgtaactgacagaaagaaaaatagtcctaataagatgtgtttggaaaatactatatctgaaaagacagtgtataactgaaatttagggaagtcacagaaaatttccctgcatgcaggtgttcagaagcactgaggggttattaatgaaccatagaagtgtcgaatagtttgttatgggaagaaggtccagaaataaaagtgaaaatcagagctggttcattacaccagcagtgtgactggcaaaccccactgctaaagtctcctttaaacagcaggtgcatggtttgatcgctatagtgtgtagcccccggccctggcacagaatgaacacagcctcctccatgggttcatgaactgccccgcttccattttggtcacacgttcccatgtgggaaatttcacccaacactacccactttaattttggtgtatttgcttactgcagctgcacttgctaccaaaaacattataccacaaaattccaaagtaacttcaaagaagagggaagaaaccaaaaaagttctatacattcttagttttctccatggaagtggtatgttcagttaaatagctgctatcgatgtgcaaatactgtaattcaaacaaaaaaatcaccaaccatcctagctaaagagacacagataagaaacaaactaatgatttaaatgtcatctacaggctctctagtatcttgatggtaaatcccttacaaatttgggtgtgtaacataaaatattgcccatcataatgatgcatataaatatctctacacaagaaagcactatacatcttttacaacttttttcagactttgttttgcagatggcatctggatcttaaagatgtatagatattttgcagctctgtttaatcataaataatagatttgtctgattcgctaataccagaggcatgtttttttcttccaatgaatatgcttatcatccgtgactgctaataataaaacctatacccttatatggaaataaaccatttcataaaaataggaattcatttgccattttccattactgctgactaattactagggtgttgaagagtaccttcagattgaagagtgtcttcagattgagttcataaaagctatatttctcatgtgtttgggcagaaattttcaagaatatcatatttcagatttagggaaaactcaaaagttttatcataaaatgaacatattaagactcaaaagacacttaaatatggcattacaaatatgaagcaaacgtttttggactaacaaaggtcaaaaaatttcaaatatctatgaaaacatggcaaaacaagtagaacatgttgtaatggcaggcaaaagtgttcactttagaatccacgtttattcgttatcgtaagtttaggtttcacatagcattgttaatacaggccaaatatgcatttaaatacacttacagtattcagtgtatactatgtgaatatctacataagtgattttgaaataacgttttcttatttaataggtttattgtggcaacaaaaaaatgtgtggatgctagtgaaaatcatgtttgcagtagattttaaaagcctgaaagaatacatttgttgaaatttgcattcggtttggaaaatgtgtgtttaacaattgaacacggccatattttaacttttaagctttcgtattgcgaaagtatcaaggtattacagcaatttactcttaaggacattatgctgggctttgaaatttaaaaaataggatatttcttcttggagtatttcatgatcaatgtacggtccctatgtgaggaaaattaaagctgtctgacaagtcctagaaacaccactagctgttaaagatgtaggaaattgcatgaaagcataaaaagcactgggtaattttgcaaatttcatctctaaacacaattgtaaagacgtctttcagttctttcttcctcttatttctgaagcatagccctttagttcttgcccttttaaatatctttgcctaccatagctttgcttcttaatgtactggttgatcttaccaggctaagtatttacagggggtgcttacttttatctgtattcacagagaatgctaacaaattagaagaaagtgccagagaacaccacataccttgtccggaacattacaatggcttctgcatgcatgggaagtgtgagcattctatcaatatgcaggagccatcttgcaggtaacatttttactcgcaagaatagttaatgtataaagttaatatgtagaaactaaattgtagatgtttatagaaaattggtagacattcttcttgaatgggtaatcagcaacaaaacttttctctgctcctcctgtgcatgcatacacacatacacacatactcacacactaaaaaaaaacaaaaatatgtgcaccttacacactcaagtactatataacacattactgaactgttctagaatttgaaattgtactttgtgcattataagctccttaaaggtacaagttcctccatattaccactctttctcctgaacacagaatagttgctcaataagtatttatcagacaaatgaatggatgaagccttatgtatattagattgcatagttgcttctcagagttcatcttttcctaagtccttcaggtcttctcataaatatcatcaatccttgttttgccaggcattcactattttctatagatctgctctcccatggagccgtgcaaagtgaaatcattagccatacccccccagtttcaaactcagtagagacacaaagaagttgtttatctggatttagtttataaatataaatactggccaggcatgatggctcacacctgtaatcccgcattttgggaagccaaggtgagaggatcacttgaagccagcctgggcaacaaagggagatcctatctctaaaaaaaaaaaaaaaaaaaaaaaattaagaattagccaggcacggtggcatgcaacctgtagtccaggagctacttgagagctgagatgggatgatcccttgagcccaggagttcaagcctgcagtgagctatggtcacaccactacactccagcctgggcaactgagcaagaccccgcctcttatatatatattaatatatatgtatttaaatacctactgtatgtctaaaatataattatttcagagatggcaaagccaaaatgaaaacataatttatttttatttttatttacattaagtacaagtgacatatgatgaaatagattgtattttcatttacaacagaagatttctctctctctctctctctccctctctctcccactcttcctccctcccccctccccgccccccacctagagctgtcttcctttcatgttttccctccacaaaatatactagcacaggccttcaactgaagtaaggcagagtgaacaaaactgagaagttactcttgctaccccctcactccccagcagtgtcattattattaaacccttcctgatggagagaaaaaatttctcaggatgtagttatgagaaattcaaagtgaagtaatagaatagttccacaaaatcaatgatatgttgatcctctttaagtattgttttcttatgagctattttctcatttcattgacacatgctaattttcctatgtagattgtctacctgagctttccatgagggttgagtgagaggaggcaacattcattctcagatgaacaatacctcgtcttgttttgcagaactatgttgcctacgtcatacttacttttttctaacaaaatttgactctatcatcagcagatgatttttttgaccagaaaattaatgactcatcctgtaactctgatcctaatatttctcaacatttattctgacaatggcatagagaatgtttcatccaaaacagactaatttttgtacccatgtcatcagaaacacatattttttcaagtaaacatgttgacttaggttgattaaagagcaaattaaataaaatgtaaagctcaccttccagaaaatatagaaataacagtcattcctggacatgtattatctctctatattgtcaccaaaaacaaattatctagtaatcctcctacctttgaaattattatcataaatgtaaaaggaaaccacatatctgataaccgagaaacacaaagacatcttgttgaaaataagtagttgagagccatagccacaaagtaatatttatttagaaagggacacaaaaagccctaattttgtgatgaaaataaatgcccatcaatcaactataaaaatgaatgcaggccgggcgcggtggctcacgcctgtaatcccagcactttgggaggctgaggtgggcggatcacgaggtcaggaaatcgagaccatcctggctaacagggtgaaacccggtctctactaaaaatacaaaaaattagccgggcatagtggcgggcgcctgtagtcccagctactcgggaggctgaggcaggagaatggcgtgaacccggaggcggaacttgcagtgagccgagatgcgccactgcactccagcctgggcgacagagcgagactccgtctcaaaaaaaaaaaaaaaaaaaaaaaatgaatgcagcaccctacaggtaactgggcactataatttcttccaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggtcagtaacagcacttggtggctacccaaataaagggatatattgttactcttttatttaatcagatccctccgaggtgagttccttcatggactctgcagccatccattctctatgagtcctatgtccttagcataagagtatttgaatagccaatggagtggtacaatagcatattggggtggtacaaattattttccttaattttgcctgatgataaagattgttttttttacctgcttgaactagtatccttatctacctggattagtatccttatgtatctgaatcagttttaacatatcttggtataataacaaacacatttttatcttaggatgacaaaatagttttcagtcacaaaatgcaaaaatacaagtagttgtacttttatggtaaatgaaaaccttagatacagaaaaacatgcagcaaatatcacaacaaccttttatatcaaattcccagcctaatcaaaaggtaattgtttcctggagaatcaggttaaaagacacaggggtttcctttagtttcaacagaaaagaaaaccatgattaattagcaatgtctgacgttgggcttggagtaaaggaatgaggccagtacttgcttaatttcatttgcatgcaaaccagtggtaaccaagaattggacttcaagccaaatgcaaaccaaccaagaattggactttaagcaaaatgcgtatcatttatgttctgtgtaaccagaaaagtcattgaagatagtccttactgacttgatttcactcttctataaaaagttccaaggaagtttttaagattttcaccaaattcacaaggcgtttagactttcttcatttgtgcagctctccagtaaatcagaatgtttctctaaaaattgttttgaacagatacaaaaataaaagaaagtatcgtatctttagaaaataagggtcataatgcatttcagtatggtattgcacaatcttctttgaggacaagtgtggcatttgctcttgaaaaagacaaaatatggttcataaatcctcgcctggcctcaaggcttaagggcaggtcattgactaaagctttgggctgctctaagccgagttgagttcatcaactcgactctcacgtttagatgccaagtgattatattaaaatagattctggggaacataaggattacaagaaaccaaaaatactgcatataaaaagaaaaagaaaagaatctaaaacataggaaactatgccatattactctaatatctagccaatatcagtacatgaaaaacaaaacctatatttaatggatataatctcaacaatttgattgctacttcgactactgacacaaatgcaaaactgtaaatactttagctcatgttttcaattctgttatgaatcacagttgcattcccatacataataaaagcaacagaaatatacagggtcctttcctcactaggaattgtgtaagcacatattatgtgtgtgtatcgtatatgtgtatacacatatacacacatatatatgcacatttaataacattacaaagaagaaacaattatctccactttcaagatagagaccctgaggtagaagttggcaaattgctgacttcacacagctgagcaacaagggcagcaatggtgtccaggtggcctagtgccagagcctggacacttcaccatgctcatactgcactgtgtctgggaaggattttgtgtattctgctgctcaagattatctaaactgagctccaaattagagtaagctatttttccaaggcacatagacttactcattttccatgttataataaaataaaacctgtcctcaatttattggcttttgaggggaaggcatagcacataaactgtattagtattttgtaatgccttttacaaatctgccttaagaccaccaaaccttctagagcctttccaggattcatactagtcaataaagcacaccaattcccagtgtggattcatttcactcacctgaaaacattctgctctgaaaccagactttccaactaggctgtctgtctccaaaccccagaaaccctactttcctgatgacctggccacatttgtctgtcaagacctatttcaaaataggtcttgctaaaagatttacaaaattgcaacaagcagaagtcctcccatttcctttgatttttcgtcttcctcatctggtctctcctgtcttctacatctctcttctatctcttctccttctttctactttctttttttaaaaaaatcttttctcttttgcatcactattttagccaaacacctgccctcctcctaaacaccacatgtgtcacaaaaagtatggacatttggagacatgtttcaaaatgaagagttgccctgttgagaagttggatttttgatctttttatctctagctgccatttgctgggaatgtgatttcagctccatgttctctttaacagatctatcctccctctaaaactatacatatatatatttatatacacatacatacacacacacacatacatacacataaacccacatatacacacgtgatatatatgtgtatgtatattcatatatttttatatattctgatacttcacagattattataatagaattttatatgaactttccactattctcatttgcatagtcaaagcattttttgttacaagagaaaaaagtcagacattttcagataatttgactgaatattagatttttatagatgctaaataactggtaccaatttatgtccctaatttatactagtaatgtacaaaaatgatattaggctggtccaaaacaatattcctttccattacatatcagatattaacagttggttcattctctggtttgataggatttaaactcataacattgaaaagtcaatataacattcattcttaggacatttgaaatataaaattgttgaagacctttaaagtgagataaaatgggcccatgacttgcttgattgcattgtgctgagtcattctttgtgccttaatgagtaagcagttaaggacaaagtaaatgtcttcctcttcaacttctgcctgtgttcaattcccaacaaaaatttaaagacaactgcacagaaaagcaaaataataacttttccaaaataatccaagcttctactaatgataaattctttcatctgaaatattttaataatttgcttaatccacatctttattctgtgattgtagggccaaactttaggtaatagcattggactgagatttgtaaactttccaaccttccaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgagaaaaaattggcattcttaaatttgcggtatctcataactgtaaatataatcagactagtacaatctgtacagctaccaatatttcatgtttcttctcatcttgagacagcacattagttcgtacaggactcagtggctaggttttgaatgattccaagatcaagggaaatgatggttattggaaaagagaaaaaataatttactttatatcgagtgaggataaaatatttccgatctttgaatcatctctatttcatcaactttcttccctggtcttccattttcatccctagagcagaaaaatctctggcatataaactaaataaaagaagaaggggagggaaagtgttttataactcataaaggagagggaaagaaaatattggtttttattggggaagtagcttagaatcccccagttaagtgcatatatctgaacttactgaacaagttacatactaggtatacacagagtggcaaaatatattccatttaggtgggtggaattaccaggggaaaaatgtaataacaccactagatgtgaaacaccaaaatcgtgaattctcaaaagcaccatacaatatgtatagtatatagttctttgaaaagaagttagaatcacaaccaataccccatgaatagctttgtggctaatgcagcaccataatttgtaatggaactaagatgatgatgacgatatttcatgaaaacagagagatgttttgagcatatttatgtggtgaggtaagaaagaaaattaatcctatagcatctgaaagacctcactgggaagttggtatggatttttgtttgatttgtgcatacaaataggtatcacaacttgatctggaaaaaataagctgtgaaaattctcaaggaataagatgaaaataaatcaattattatcatttagctctgcaaagctttccatggctaacacagtaaatttaaataaagctctctttgtctccttcaaataa

SEQ ID NO: 57 - DNA, 156521 bp, Homo sapiens
gtggtgcgcgagcccagtgcgtgccgggtgcggcgccagcagcggaggggcggcccggcgcccagcggagagccgctggctgggtgggtgtcggcctccccgcctccttcttctccccgccggcttgccggggatgcttgcgcgaggcgccccctcgcctttaagctcccggccccggggggcggtgtgtgtgagtagctgggagggggccgcgaggcgctccgccgagggctcgtccgggtttgtccgccgccgtcacctgactcgtcggaggagccacagctgaggtgggggcggggatggggacgcagctcggagcgctagagagacgcggcggcgctggcagaagaggcggcggcgggcgggtactggcttctggggccaggggccaggggcggtgggcgccgggaccgcggagctgaggagcggggcccggccagggctggagactttgcgcccgggggcaccggggctacgcgcggtcgcacacatccaccggcgcggcttccctcggcggcccgggctccgctcatcctgcggcgggcggcgccgctcaggggcggggtgagtacccgcggccgtactcggccccctccccgcgccagggtctcgcggggatccgcagaggataatcccagggtgcggagaagggcagcggccgagtgacagctccgcggagcgctccagggcgggcgggggactgggcttcgctgtcagcccggctcctctccaaagccaggaagggtgaggcgccccaagactccggcgcctccgcagagctcccgggcggcccctgcggcagggatttggaaccggggggaaggggcccgggcgatgggcctcggcgaggctttggagccggcggcgaggaaggaaggggaggcgagggcataacatggcgcaacgctaggataatctccttcgcgactgagggaggacgagccctttgctgcagcagcgcgaggaggaggagggaggcagccagggcttgggtatccgatgcattccccgaagcctgcgggctgctaggaggaaagtctgctgaggtgggagatgggcaccggtgggtgcggcgcccagggaataaccccaacgcacgttgtggctagtccagcacccgcgggtcaggttgcggggaaagtgctgattgacaggggggtccccagggggtgagtctggccctatgtgggggccgggggagaatggggacggtgtcacgatgctgcgactggagcccacgctggggttccgtgacggccctactcacggccaagactccctggaccgcatcgcaggagcggggcttggcgcgttgctggctccgagaggtggtgccagggtggggatggaggaggagagagccgccgcgcggctggaggaggcaaggcctgggtgcttggagggtagggtctgcggattaaagccggaccgtctccccttgtttcctgcagaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactgtaagcatctctttatataagagggacatgcgcacggcagaggcgcctgggatgctggtggtgcggcctgcgctcttggtccataatgctgtggcctctgatactcccagccaggttgcccctgagctgaaattcttcagctgtgaaggtgttcccttgggttagccatgaaaccttgtcttgtgagccattttttcctcttattgacctccaaggtcttggtggagggggaaaaatacacacacacacacacacacacacgcatatgtatatacacacacacaagagagagattgtacacactgaattagatgtttttcacctttttttctttctccacccaccctcccttctccaaattagaggaaattagaggttgcacagtcaaaaaaaaaaaagatgaatttatggaaggtcaaacttgtcaccctagttctttcctaaatacatttcagatagttctaaggtagtataatctttttaagtgttgctcctgaggattgtttttgtgagtatgggtgtgtgtgtgtgtgtgtgaggtatgttaccataccaaactgaaataaattcaaggtactgaatgaggaaattggacttcatagctatggcaatttcattttacacatcctggcacactttgtcccattctcagaaaatgctgggtgagatgactatgctatggtcacaaaatggatgtacttccccagcatctgagatggtgcaattttagatgaaaccgtttaattcttaatattatttttgtaactggttatttgatggaaaaggctttattctactctggaatctatatatttctgaaataccttaattaacagtaaatcttttgtcaccgaaggataaacagaggcacttagaaaagaaaaaggctttcacctgctttgggtggtgaggtttctcataagtcaggctatatgagtgtatgttcagcagttgctatttagttctcttgacctgcttaggatcttctgttctattgtgatgtttttggtaaaggtgaatgttggcatgagagacacaggtatggccacagccatttcctcagctggcttcctttgcccatcttctgggtttttttggtcttgggtctttttcctgctatttcctttgtgcagctaagaaaatggcaccagtgtcagaattcactctagccctattatctgcataagcgaagcttgatgaagcttacaactggacattgtaagagttgtccagccttgtgaacctgttgtctcatagaattgaataattttgtttctagaagctcatcggaggggaaagtaccattatgcctttcccaagggaatgtttaactaaatttattgattacagcattatatgttatatatgcagtacaggatgaaagaggccaccagggccagggcacctaagagaagtagaaattgtaaatttgtgaccagatcactttgctgcagcatgctgaatcatttagccattttcccatcagtttccccaactctggaagaatgattcatgtcttaaaggtatatatcagtctagaaaatcctcataataagaaaggtataggttatgaatttgctacatgctgatctataattaaaatgataaatcagtatactgatatatttcagagaacattcacaggtttgaacatttcattaaaacatcattcagataaaggctgacttctccagatctaaatatttagtcacattagtattttagtggaaaagtcttttgaaaatttgaaggtaggaggttttccaatatgatttctaagatgtggaaaatagggggaagattccatgttataaaagaaagcagctgaaataggaactggtgttgaattattaatatgaatggtcataagagctgaacatttattgagcagttactatatagcacgaactgaactttatattattaatctttcatcacttaatgggttcagggagggtaattaactttcatggctttttttttttctctttgtgagatggagtctcactctgtcacccaggctggagtgcagtggtgcattgtcggcccactgcagcctcccaggttcgagtgattctcctgcctcagcctcctgagtagctgggacttacaggaatgcaccaccacgcctggctcatttttgtgtattttttttagtagagatggggtttcttcatgttggccaggctggtcttgaactccttccctcaggttatctgcccaccttggcctcccaaagtgctgggattacaggagtgagctgctacttcccctgtccaaactttcatagcttttaaccagtacacttaactgccatctgtagattagtaatatactttattgagagaggagagaaaatgaaccatattaacctaaatggtctaatctctaaaacacccaccttgcttgcatagctttctgtggaattgagcatcaaaatccgcgtacatattgcagtctttataatatgcatgaaaaaattttaattctatcatgaaaaaattgaatgaaaatattttaattctgttgcataaaaaaatgaccaaaaaccaagcactgaggagtattggttagtggtttttctttttaatgttttacttttctaataagtcataaaataaaacatcttctacttaaaaccaacttttggatggaatttggagacatagttatcacattactaatatgtactattctaagagaagatgatatggaaaacctgaatgtatatgttatatgcattattaagaggacatctttgctcagaattctttgtgaagttcctttaaagaaacagtaaactacctcagtaatttattcacaggttttcagtaaacaccagttataaaagtgaattgttattaaaacatgcaaacacataattaagtttctttataggcattgaagattctcaagtagttggtgttttagttttgaaaatattaaatactggttgggagaaaaagagcacaaaatatagagtttgggggtttgaaacaaaaacaatttcaatttattactagtttgatttgtatataactttttagtttggagtttagattggaagattataaaaacagatttatggtcctgtcatttttttttaaaggtattggattaattgggctcaaaatccttatgaaatatgtatttaatattaaggtactggtttaaatgataaattcttttctctttaggttgataggccaagaaaattattattgttagtcatggtgacttataaaatgattcttaaagatatatgatttatacacttgaagaaatgatttgttaacatctgagggcagaattatatctggtgaaaaggtcgagatgaagaaactatatacatttattcccagattttttttcttttttcagtgacagcacctaataatctaagtaaggattatatattttatggcacttttggattatgtaaaactttctttccatactcgactatagtgatgttgccctttgtatgtgaaaattaaatacctaaccaatattggtttgacattaacttttctgggtccacctgtacatcctcgcctcctttcccttgtaactttttgtacctatttgctagcatataaaacatccaggactcaatgagtatttacctttttagttacaactgtttgacacttcagtgttgtctgttttttctattttgtatgtgatgccctaagggatagcccaagtcaaataataaagtaaaaagatcaggtagtaataggcacccagtacctacccagtattgtgtcaagcttgaacaataaaatagagttggtccaaagtaacatctgcaggtgtaaattggaaagttttgcagccctgccatgtgattcatttcagttaatagtgcttatgagtgatttctatatatgctacattgttaaagtatcctatttatgataatcagaattcaaacctagacattactgttaacatcaaaacaaaccttatgaaaagccaatttggttttcagtaatcctattttttccgtattaaacacttgaagctatttagtaatgagcttatcccacatgaaaagcaagtgcttcaagttctgaatctgatgtttgagagatactagaattttactaatgattccgttcctcccaaattatgaaaaagaaaaagattatgtttcttataagactatctggtaaaggtagtaggagacatgtactgagttttgattcaagacaaatactggcacatcaacccaaattcctgctgctttaattttattcataaagtatctgcaaaaaaagtaagaaattttgtgagtaaaaatagaacgaaaatttaaacctaaaagtgagttttctttgcataaatgtgcttagtaaatatgaaatatattttaattcatagaagttctgttagcacactaattcagtagacaccatatatttatatttgtgataatttagtagggctttcagtaagtgctgaaagatccaaaaagtaagcaaagtttactgaataaaattaagtagaacaatgtgtaaaagattactaaacactagagtaactttgaatttgagaagtgtactaacttgctgtaaatatattttaatctgatttttgttttcatttaactattagtttaaaaaaaaaaaaaaaacacaccctctcactttactgtaccagaacataatctgttccttcctcttgattttaccagaagacccagcccaagggtgaagagatgggggagatgcacttctgaaaagcatttaatatgattataattcataccatacatgtgtaatgggcccaacgtgtgtgattctgtgacattctcgaagatgctcagtgtcctaggaggggagagaagagaccatgtgatcagggttggcaggagcaggggaagcagagtgacaaacagtcttaggtaataggagggagcatgctttaaaaatgacacaaaaataattaaacagaatttatagcagctagtggaacaataggggttttttttccagatctttttactttctcattttcaaaagaatctttttttaatggtataatgttaaatatatttgggtcactttagattttttttttttcagtttttgcagttggtgtggttagcagatactttcttagaataaaattgataactcaatttgatttttaaaaagttgttttagtgatttaaaatgttgatatggaaaaatattaaacattatatagatagtaggcaaattcatatcctaattgcaatattagcttgtagcattttaaattaaaatctaaatttcttgatatattgccacattagttgtaatgtttaataaatggtggttaaagatttatttgtaatttaatctgtgtacttagttgccatggacctctcttttagcttttcataaataaatatcctttaataccttacctcctcccttcaattgactgatgctgggatagggtgttctttggagcttatcttggtaaagaaggtcagaagtgacatataaccctattccctaggggccgagggtgctttccttacagagttgtattttaagtgagtcaactcctgagccagcatctactaagagaaccttcaaacataatcatagtgcatttaaataatttgaaaaatcaaagtccttgccattaaaaacatttatccttagtttcatttcttttataatgttttctctttttagaaaaatgtattgtttatttatgaaggggaatgttggctgtgttttttcttaggcatttatgtaatgtgggagttaccctatttttttctttctcaccaagggaagattggttgaatggtataccctgtgtcaattgcacaatgatttgtaagaaattacgactcttccttgaaacaattgggtgaaagcacaaaccagagacagttgtaccctgaagcccacagtctttctagctgtttttctgccatctcttcatttgtcccagatgtgtgaggatcctcctcttccttgtgtacagacagaagccttctttattattcatttttaaggaggatctagcattttctcaagaattttcaccaggcgctgtggctcacgcctgtaatcccagcactttgggagtccaaggcggtcagatcacctgaggtcaggagttcaagaccagcctggccaacatgatgaaccccgtctctactaaaaatacaaaaaagttagccaggtgtggtggcaggcacctgtaatcccagctactcaggaggctgaggcaggagaattgcttgaacccgagaggcggaggttgcagtgagccgagatcgcgccattgtactccagccttgggggacaagagtgagactttgtctcaaaaaaaaaaaaaaagaatttttgatgtgtcattcctggctactcaggagagagagaagctaggtctctccctgcttggtgtagttttgcttttgggtctcaccatttgatttttctcctaggcttagcattttttattttaaattacaactgtcctttctacatgagttattctctctgtcatctctatctttaacatcttctgtctctcttataagtattttcaagtatctccatttaaaacaaacaaaccacacacatgtctctttggcctctattatcttgataatagcttttcaacaaccaacctgtcattctttgctttttcttttttcccacaatcaagctgcttgaaacagtgttttactcaccatttcaaagaaaacagacacaactgtacccctctttaaatattctatgtctttgaatggcataattcatgcatgaaatcttagaattgctatcggatgccaggcattgcctactcaattgcccaagtcactaacttgagagttatccctcatccctcaaatccagtgagtgataattatttaaacaccctctgagctggatgcagtggctcttgcctgtaataccaacactctgggaggccaaggcaggaggatcagtttagcccaggagtttgagaccagcctgggcaacatagggagactccatctctataaaaaataaaataaattaggcatgatcatgtgtacccatggtcccagctacttggaaggctgcagaggatgtcaagcctgcaatgagccatgatcatgccattgtactccagcctgagtgacagagcaagaccctgtctaaaacaaagcaaaacaaaacaaaaaactatctgaaatctctttctttagttgtcttctgcttgatttagatcagtaataagcctcatctgtaaaatgaagattaattatagtacctacttcacttttagtgagtaatgcataagataatgcatgtaaaatacccagctcagaacttgacacacaaatatgcaataacaatcagttattaataccactactaataataaacattactagtactattattgctgctaccaccagtataacaattccacatgtattgccagtgatttggcccttcttctccatgcttctttttgccccctccttttaattgtatcagtttttcctttaattccaactttctctttctgtagtttggaaggcatatatactatttctgttcttttagtgattagtcttaaaattttaatatgcatatgtaaagtctgaagttgatcaatatctcttttttcttcccacgaaaagaaatttaggaacttttaacttcaatcacctacttctgtcttacgtgctgttattattcagtgtttttaattccactgtagttttaacccctaaagctgtacattattatttgatgaaggcagtgtttacttagatgtgcctaccttgtaactgacttctttgctcaccattccttcatcatatataagattttcttgaactatatccttttcttgaactatattttgaggacagtgtatctgtatataagattctagaatgacagttattttcactttgataacatttcagtcatctgccttctattattgcttttaggagaatttatctgtctacctgtctttaggtaattcctttgtttgacgggggctgcattcaaatcttctgtttgtcttgtccttctttagtggatgtgtgtctagatgtggcattgttttttgtttattctatttggaatttgttgggttttttaaatctgagaatgtatgtctcgcatcaagtctggaaaattctcagcttttcagttatcattgattattgcttattctcattctctttctttttatgtccttcaaacatgattagaaatatgttagactttattacatccgtataaatctaaatataccttttgtattttctaatgctttcttttctgttcagcatgatttgtttttcagataccttctagttcattaattctctgtttagctgtgtcttgtctgcttttatgcattcttggttttttactttatttatttatattttttgtttttgaattttttcaaatttgcccattttctggataatgtatgtttcttgctaacatttttgagttcctcttttatttctttaccattttaaacaaaactaattttatattctatatttcatagatctatcacatgaagttctgtttctattgtttttgcctgatgttcaatcatgattcctcatgtgttttgtaattttagactctgaggtcatgttggctagtacttcatttgtgggaatcctagggagcctggggtcacctagaaagattttgcttcagagaggttccacaggtgctgccattctgagagcacctgaagttgaattatgcccttggagcttcccatccagtgcaggtccagatccataatccttatctgtaatttgaaaattaaaaatgctcagaaaaccaaaattatttttgtaaatcatttcataggaaaagttgaccatatatagtctttatatactgcctatcatgatgagtcatatgttaagctataaaaatattgtcatattatggtatgctgttcagattatagtgaggtgttacttaatatatgatgtctgtaccataatacctttgtagaatctgcaaactcatgaactctgaaacatatattgccctaagggtcttagatattggagtgtggatctgtagtataaatttgaatcacagagttcatcgggggaaagctatgcttacaaatgccccagatatttttttcccttatctacccagagcctaggaagagcagaacacattttccctcgtctccttttgctgagaggtattcttttttgtttttgtttttctcttaattttactaagggagtaaccctttgaggatcctagctttatatggtggtcttagttccaactagtcaccttgcttagtctcaaaggccttgtcccctgttccccacagggctgctagaatctaagactctaagccacttagattaacacatgacttcagggcagtctcctcttcagtattactttaccatgtggttttctgcaatttctttcttttttttttttttttggccttggagattgcttttattttcttgtgagttcatctaaatgagtggaaggatgcctgtaatatttatccaggttatcaggtgtttttcccttgatagtccacctgtatgctagatgtggaaccagcctattttcctattctttgtttttgcctacacacacacacataccccacagttcattgctgaactactttgaaacattcgattcactatattctgcattacttttgggcctttgcatgtgctgtttttaagttttaatatatttttaaaatctaatttctaaaactctagttttaggctttcttttcagtgcctacatggccccctgtgcatttgtttctttcatatccctcccagagctatagtgggattctcttcagtggttgttttcttcctctagtctgtagtttctttgagactgtcttattcctcacgccaaacatagcatgatagcaggttttggtaaatatttattgaatgatttttattatgcttcatatttccctaattttatacctttgttttctcataaactttctacttaaaaattttacttttacccaataaacttcggaagagcaaggagttaaactcaattctttctctcaaaagactataaaagcaatagaagtgtaatattggaggaatacaaacaaataaacattaaattacttaatgtatataattaatgtgtatttcctgacatcctctcaacacttgcatgaccatgatctgacaacgatttaatctggggaaaatcagaaaattgatattaaaagttaaaacaatgagaaaattggtaaatttgaaaaaaatgttagattttaacaattatatccataatttttgggttgtgaatttaaagcatatgtggacttctctcagtacataccattaactgttagatattagatggttaagtattagtattagagaaaatcctttgccggcattgtgtgtgtgtgtgtgtgtgtgtgtgtgtgtgtgtgtgtgtgcagctattttctttagagttggatacagttgggcagcattgtttttcaatattcattttataatttataactacatatattatacctggttaagataattacaaaagaaaaacaatttcaaaagtgactacacactttcaatattcactgaaatgatagtattcactaagttattggtgatactattaattaacgtgataaaatttccattaacaacttgggggctttcgacaagcagtaaggaaagggggcaagattaacctaaaacttagggttcttttgcctttgtaaagaaagcaataaataacaacatatttaattttatttttaatgacctacttggaaaaattagaaattgctttcagtactgagtctttcactagcttacttagcacaatcccattattattcatttaacaaatatttggataacttccaaatgccaagaattgttccaggaaacagggataccatggtgaacaagatatgcatggcctttggcatcagagagcttgtgacttagtaggggagacagaaaattaaagaaataattacaggtgattcaaaaagaattcagttttaataaggaaggtgaagactacagcggaggcactttgcagaggaagagatgtttaagcccagacttaaagaatgaagggtacttaaagtaggtgaggtgtgaacaagaactgctgcagaatgctgtgtaggaagaggctcacagagagcaaggcacattttaggagtatgaaaaagttgaaggttgctggacgaatgaatttaggaagacagagaatgttaagaaataacaccaaggttgtagatggcctgagatctgcagggctttttaggcttaggagaatcttagaagttgatcagccttttcatttttatagatgagtgagctgagtcccaaagtggcaaaattatactttctgtatgtgttaatactgaatgattcttatctacctatcttgaataggtgccctaatatgtaattgccttgttcacctagttctgattgttacatctaaaccagtggatttcactgtaatatcgctatgcacctggttagtgtcaaagtgtagagcctacagctcttccaacttctagctaaataattcagttagacaatggcttcatgtagttttgttgtttttttctccctaaaacatctaggttgcagtgtgttcatgtttttctggcctcttcattatgtattttaacatgtaacattctggttttggctacccttgagtgagcatgactgtacccatggaagtttccataggaggctgattggagactgtgctaatgagtgggctgtgaccaactgtttaacatatgcatctcctcactgctttgtggttctttcccacccccctccccacaataattctcattattgttccaaaggagttgcttaatttttagttatattttattgcattttgtaaaggactgtgttccttggtgacataactgtgccagtggtctattctatatatatcttaatggaatagaaatttgactttggcccctattgtagattttactaatcatttcgtaggatagtgctgtgaattaagaaacaagtgttttttcagttcagctcagcattactttctcaggtggaaaaatagtatgaagcgagcactcaattgctgcaagtgtaaatgggtataaatatttgggagggtgggttggcaatattaatcaaaacccttgaatatcctttgaccagcaagttgaattctacagctttatatcaggtaaataattggaaaaatgttttgtttcccccaaatttgttgcatcaatgtatataggagaatgcaaaattgaatatacccaaatactttttttaaaatgatagtgtattcaaacaataagatactggccaaccttgaaaaatgagcttgttaaagtatatttgacatggaaaagaaaatttatgaggtgtgatcataaatccataaatcacagttttctttcttttcttttctttttctttttcttttctcttttttttttttttttttttttttgagatggagcctcactctgttacccaggctggagtgcagtggctcaatctcggttcattgcaacctctgcctcctgggttctggtgattctcctctctcagcctccctagtaggtaggattagaggctcatgccaacacacccagctaattattttattttatttttagtagagatggggtttcaccatgttggtcaggctggtctcaaattcctggcctcaagtgatccgcccacctcggcctcccaaagtattgggattgtaggcatgagccattgcacccggccccacagttttcgtttttttaaagtatgtgtacgcccataattttggaagaatatatgtcaaaatattgtctgtcagttgaaagatttttgttttctaatttatacccgtattagtcatgactgttgtgttggcaggttacaggaccatagatcaaaatagttttggcaaaaagagaagcattttggcccttgtaaccaatatgaggaaaaggcaggggtgaagcttgacctctctagtgcttgttcaggattcttcctccaccccctgtttcgcttgtttctgtttcacacattagtagtgaagtacctattccattcttgaagactttttcagtgattctgaactaaagctcccaggttcacattatcatagcctcacagagagaaatgggttctcttcctagagagagagttttccaaaatcatagggaagaattctgatttgcttagcacaggtcatggttgacccatgtatatggcacgatattatgattgtcagtctcaaccagaactacattgttgggaataccaggagctagtggcatgctacaagcttaattttttgctcgtatcatggtctgccatggatggctcctcctttctagaaattctgtcatctagagcttcagagtcctccactgtcatctatgcatctggctgacagagggagacagacaaaaaggggagtattgcaagagaagatgtaggtccaggcctaaatatcatttctacctgtattccattggcaagaaatctattaatggcctcatccaaatgcaggaaatgctggagatgaagcctagttgtgagtccaggagcagaaggaaatgggatgtgaatacacagcattcattctatcatgcccatggaaaaggaaattagattatagttttttcatctgtaacttaaaaatacttcttttatgtcagtggactcactgcatattcctccattcttggtagacattgcagattaatcctggcactcttttctgcaaagctttgattttgcctcaaaatgcatccatatacagtgctttagattgtcactgtcaatcagtgttgacacttaagatgaaatagacttgctatccctagtctaggcaatttatccatgctggatactaaagcaagctgctcactagatttacatagacccagaaatggcattcagcatggatggttccaagctgggattcatctgccagtggccttatctttataagctagtaattcagtgatttgtattgttatgccctagggagaagttcttcctctctgcttgatagcaaaaggtagttgttcttgattttacattttgcattagtggagacagttatagctattgtgagacagggaaaagacattttgaattttgcatttaatatttaaactttcttccagcatcgcgtctgatattaatcagttgccttaaaatatatctaatgcaaagcatattagtacccaagaaattttctttgagttgccacttaggtacctacatgattatagtttctttttcaatttaaaataattttttattcaattgtttgatgtatgatacattagcagtctctcattcactacaagattcaagtgaagaaaaaataaaggcgctctttagagtgaaggagaggccgatgtgtggagcacttactgtgcctggcccatgtatgtgactgattgacttcatcttcacaaagcccattagttaaatactcttattcccagtttacagaggaggaaaacaatgcccaaggaggttaaggaatttatccaaggtcccacgcctaatgaggggaggagtcaggatttcttcagcggtcctaactgcaagacttatgcttttttcttttacatagtgatttttgtttgttctctgtctctagtgtcacaggtagcaataatcaaaagcaaaaacaaaaacagttaaaacatcaggcccaatgtggtggtacacatttgtaatcccagctacagggagcctagtagtttaaaacccagcatgggcaacatagtgagaccctgtctcaaaaacaaaaaacaaaaacacaccacatgaccatatgattgttttgggaaggaaaaatggggtgagatccaaagatagctaattaactagatgggtaaagctctgtgaaggcccatctctagctagtagggaaaaaagtggaagggggtgggttcaaatgactgtccttgagccagtctcacccctcattagttatgtcttttgatgatttgctactgaagcatttattttaacatgcttgttaattaaggaccttgggggtggtggaaggtacagcagaaagggcactgatttgtgatcagagtgcttagtgtaattccaggctctgctgctttctgcctgtgatcttagctacattaatttaatttctttagacctcaatctcctcttttataaggcatcatggggttatggtaacatttaaataggtaattttttttttttgagacagagtctcgccatcttgcccaggctggagtgcaatggtgagatctcagctcactgtaacctctgcctcccaggttcaagggattcttctgcctcaacctcctgagtacctgcgattacaggtgcgctctaccacgcctagctaatttttgtatttttagtagagatggggttttgccatgttggccaggctggtcttgaactcttgacctcaagtgatctacccaccttggcctcccaaagtcctagcattacaggcgagtacatttgttaaaaatggcagtaacagcaacaacaaacttcaatctttaattactctataaattatcgttattagaggaaagagcctttcagaatctaatagttcttttcataggtatctttcaatactgtaagcagaatagatatgtacaaagagctcaccctcagctgctctgggcttatctctgacatctgcttgagagatgatagtttattctaggaagataagagtacagaatggggcaattatgccttcactgtactgtttcataatttatttgttgataaatgttgtaattatcaaaatataacttatactttattaaaatcatctcctaaaatcaaataaaaatgactttggagtgtctgttatggctttcctttattagtatagattgttgagacttgataggtttggacttagcattttttagatattactttacacttttcaaatatttaggtttttgttaacgaagattattgcttctttaagaaaataatggtggttgtccattgaagtatttcagatacatggaaagcaataaagaaaaacatatatggagtgactttattattgggcctgggttcttcgtggtcagcatcgtatactattcttaggttggagctgaagacgtaaatgccaacaaggagacactaaatatatttgcattgagcactaataaattgccattgaggaacaatttgtaaaatatttagaaaaagagttgatctagtagggaagttaattagaaaatgaccatcagtagttgtggtgaatctcgatatacattgtatatactaacagtgaaatatatttggactttgaccattttagtactaatgaaaaggcagacaagactgagtagaaccatataacagaatttagttagtaaataaggttactgatattcattgtttggattgaagatgttttgaagaactgttagtggataatttaatcattttaaattttacatttaagagtttagtccttatagctaacagtaagctatgtaattgtggttaagaatttataacatttaataaactaatttaccaggtacaatataattttagggaggttataattcatagagcttgtcaaaatcttaagtaggtcatcattaagagctatcttatttttaaacatttcatatgtgttgttatgtatttcctaaaattgctacaattagccaggctctatttaagagtgtgaaaagggcaaatgtctaccttgacttagaggtaccatttttgagttaaacttcatcagtagcaaagcattagacttgaaatgcataagaaattcaatattagcaatttctacatcatagtgtgattatgtataccaaattttgcatatcttatctaaaatggtgttatagtgtagtttaactaattttccttatattttttgaaagtccttaaaaatatgcctttcttacactaattaagtaataatttttagactgctatttagtataggagctaatctaatactgcccatctcatttttcttatatgtgaagagttaaaaattgaaaggtcctagagcatgagatatacaagcagaaattgcccattataagacttacctctctcttgtgagctaaagattcattattcctgtttcaaaatttattcctatggaaatgcatccgattttagtaggctttctctttctttagaggtacgttagtcaaaatggatataaccaaccaaacaaaacgcttgttcaatgtatctgttgctttagcagagagttgagtattttcttattaatgtgtaactgagctgcattgttttcgtagacctacaaaccttctttcaacaagtgcttcctaattttgagatctgaaagtatgttccagcatcttttgagtcatacaaccaaagtatgaggagatcacaagtcttttaaaaagttgtgctaaaggagaaatacttcagaaatatgttacatttgttttggatcacagtattatttatttctcaagaagagatttgttcatcatagtagtattagtaagtattccctgaaaaaaattcaaatattcaaattaagttattgctttcgtaaccataatcattaggaaaactctcaaatgtgatgctcacttttatcctgtgtttatacaaatttacttgagaggatttttatattcaacaaaaatgcaaacaagattttaactcattgttcagcaaaagggtcgaataggaaaaaatcaagattagtaaaaatgttttaatttataaaatgagaaaaagtaaatgatgagaaatagaaaggaaataaaaggaaaaaatgagacaattatagtaatatacttaagatgaaattttatatcttgagaaaaaggtaaagagttaaatgtcaaaatagaatgtgtaagatagaaaagaaaggaatgcaagactgctaacatgaagaaataaaatgtttggaaacaaatttttggcatggattaatagaaaattataaggatattaccatattcacaatctttgaggagtgatgtcaaaaattatttaatgaatttttttctaaatgcgtgtcctcattcttttctttactgtcttctcttttgatttttgtacttagattatggaatgaagggagcaccatcatactgaatttgaattaatttttactaggtatttttatatttatctcaaagttatttggaggttttcatttttagtgcttatcttgtgttcatttttactagtagtctaccactttttacctttttttgtatgagtaaaatatattaaatttcatttgtcatagctatattcaactaatttttactagagaccatagtatattctcctaggtgttagttttcttgcttttatgattttataatttgttatgaaaacaaaaacagaatttttaattttgagggattaattggatgacagtttgaaaactgtgctatgtagtctcatagacatgttataaagacctcagtatactcaagtataaagagatagctgacagttcacgaatcataatggctgctctgttatcaagctgttttggcctgccaccagcttccctttctttgggtggtcctaaatgtctttgtccctaatgttgcagatgggatagcagaaggtttcctaagccccactctgagccatgatgggtggcacacctgatggcgaaagatcttagagcatagacacccttgctacttctaagcaacacttaatttcactgggggttgggggtataggtaagcagagggtcttgcacgaacttaccacttagtgagatgatgtaggaaaacagaaaagacacggcagcctctagtgggagccttatagcagagacatataagcaaactaataataacatgccattataagtgctatcgtggtggtatgactgatatgttttgaaagcacagaagtggaaatggcaaattttgcctgaagatagtcaggaaaggctttttagaaatggtgatgttcactttgggaggctgaagtgggtggatcacaaggtcaagagatcaaagccatcctggccaacatggtgaaaccccgtctctaccaaaaataaaaaaatttagctgggtgtgataacatatgtctgtagtcccagctcctcaggaggctgaggcaggagaatcgcttgaacctgggatgtggcggctgcagtgagccgagactgcaccactgcactccagcctggcaacagagcaagactcaatctcaaaaaaaaaaaaaaaaaagtgatgtttggctgagtattgagggacaaataggagttttccagacaaagaagcatgactagacatggcatattttgtatacagtaaaaagaaaggaaggttggggctttgtagaaagaatcactgatgtcagccctaagttttattttattaagcagtgagaagccaatgcagagtttcaaacagtagagttccattattacttttatgttttacaaatatacactggttatgtagaagatggcttcattagagcaaaaggagactagataaaaagatattagggtgagtcaagtgagaataagagcctgaataaggaaataaccaagggaataaaatggagagactagatttgaaaggaaattctgatgcagaggctatggggtcatatatgaaatgtaagggggagagataagagaccagagaaacctatattttaatcttggcccataatggagtcaacctccatgggtttgaaaatatttttagatatctcacgctcaacacatccaggattgaacccgtgtcttccacgtccctcaacctatcttatctcagtcatccacctctcggtagataacaactgcatctattcagttgctcaagccaaaattttgaagttgcttgactcctttatttctctcctacccccatttccttcagtcagtcaggaaaattagttggctctacctgtctacaaaataaatataaatcctacaatctcctctgcccctgctagtcccagttttcatcatctcttaccaggacgactgtgatggctgcctgattctgcttctgtccttctcccgttcccaacaaagtactcttaacacagtagttggagtaatcctttcaaacatatttccagccatggcactgctatgctagtaacccccatttcactcagccaaactttcaaagggtttataatggccttcccaaatatctggataagtgaatgagtgaagtggcctctgcccgagatgagcttacactggagagggagaaaaaggaatatatgtaaaaagaaaatcatattattaattatttttaagttcttggacacaccgtgatacaagtatagtttagaaattctaaaccacttatattttagttgaatttcaggtgaatttcatcacaaacatatggcccatgtaggatattattattcttatatcctgaaggacatgaaataatttgctgccaattttttcttaaaacaatattttcattttcgccgtattaggtaagaataactaaaaccatacagtaagcataagttcatttgaagtgactgatattttaccacaaatcctcctgaacacctcactctatctatattacaagaactcatcaaacccaagtatgagattatcagcaggctaaagggttaacagctaggttgcatgaagcatagggtacctggctaactgtaatcaaataagtcatgttaagtcctgtattatgtccatttctcagtaccaaaacttaataaacttgagctttatgaaggacttacatttttatataaaaattattatccaagaaaaccaaaacctaagtagcataactttcaggcccatcaacacaaaaaggcattattgttaattagcaagagtgtacagttaacacactggtaacagtgcctctcttttttcctaataggctttatagaagttggcattcatcttgtccttcctcagttgtactctcatgggaaacagcagtaaagaaaagtttgattatggtctactaattgaaattagaattggtaaatttagtgtcatccattgaatcattctgttaatccaaatggatataatcattggcataaaagatgtttaagctgctgtgtattacacttgaaatttagctgagccacctaaagcactagataatataaaagtatgaaagtgattattttcccatatagtggcctgggcccaaattgggccctaaatttcagtaatttattagctgaattagtcaccaaagacctactagccacagtttaaagcacaaatctttataagtgctttgaacaaaagagactcttccttaatgtttaaatttgaataaaactccttacactctacccttgatttgttgttaaatacctctgtagccagtaactcttaaaaaactaagtagtgaattttattgagagttatataaatattatcagcttattcagatgagcattccatgtcaccaaaatagtgcttaactgagtaaccaactattacctgtgagggttcatctaatttcgtatgttttgcaggcccggtgcaggaagaactcaagtaaaagacaagaaaaaacaaaaaacagtgttgattgtgggatattaaggaaggctagaatttaagcaactgaggtaaaagcagagtatgttccaggttcacaacaaacatttaatcagtgtctactgtgcatctactggtctagacgcttggggtaccttaatgaaccaaacagctgaaaatgctttccttgtagagcttacatgtgaggtaaggataagagaatcaaaaagaaataaacaaaaaggtaagtcaattgggtaatatgttaaaggtgaaaaaaaaagacctatttttttaaaaagatggaagcacagatatgggaatgcattcggtagagcgttgaatgtgagataaagatgactggattttctttgtaggtgattggctattgaaattatctggagcaaaagaatgatcagctcaaagagttgttttgagaacctcagttttgtttaatgcacaaaggattggagagatgggagatctacttgatagactgtcttagaagtcccgaagcaggttctgcaaggttggtaggaggtggttatagggaaaaggttagagttgaagacatgaagaagttcataccacttagtatggtgtcaacataggaaaaggcaagggtcaaagataacagaggttcataccctagttttgccccatagaattattaaagaagaaattaaacagtgtgttatagtcttacaacctgctgaaattagtgattattcttatgttttcctaactttaattatttttaatgacaatgggatggatgttttctgacaaggaaagccgaagtatttattatttccttatttttctctcttagtctgtgccaaacaacacagcaggcattgttcctgctacttctagctttttgccagaagcaggattttttccattatggaaggaggcctggacccctgaactgtcaggtgttgctatatttatgggtggcacagagggagttttccccagccagcaattatactctgagggtgtgacctggcaactgtgttaacatggggtatattctgaccattcctttaactttcttaaagcataaatactgggactgtggtatccaatcataattcttgtcttgtttagacactgagggacaagttttgcttctttttctaacaggaacttagatccataaaggagtatgttctttaaagagaattttaacaaggtctgtgcctatattgaatattctcctcccttttttgctacttgttggttatcttctaggaaagaggcacagatcttggtgttgtaactcattttaagaataattgtcatggctttctccctccatctgttcttttgaaaaagtggagtcattgcagcatggttctagggtttcttgtaactgtgattaatgtcaatgtgatattaaatagtttctgattttttaaaaaataacagagctccaagacttggagcaactattacaggtttttaagataaggaaaaaggagcatttattatggttctctcaaaaaagacttgtttcatatccactatatttcaggaattttgctggtgaagcaaagcttgcattctagtaaagtgcacagatatgtgaataaatcttcatgatattgtgagatgagctataaaggtgtatacagagtgtgacaaaaaggactttgtttggcaaggtccaaggaagcttgcaaagaaggtattatatgagcatctaggatgaattggagcccactcatggacaggtggaagaagaaaatgccaggccaggggaatagcgtatgcaaacacatacagttgtgaaagagcatgggggttcttgtttgcaagcaggttgtgtgttgtatgtgaagaagtagcaggaagtaatggaaggtgggtggcaggaggtctgtgtcagcctttcccaacccatgttcctcatctgaaccatagaattcagagcatgatttgagtgaatattttcttaattttttcaatgatggtatttaatgccagtccagatgcatgaaagagaagttaacttcttacatataatgactgctttagggtattgggaaacccaggttgaaggggactagattgtatgaaactattcatttcatcagacataatcgcatttgtatttagaactatacttttgagagctgattaaaaatagaaggagaaaaatggcagggaaacaaaggtatgaggcaattgtgatagtgatcctcacagaagatagttcgaagattattaacacagagcagggaaactgttccagagatttgtaggaggtagtatctgtgtggtgtggtggttgactgaacgtggaaaacaagaaagaagacaaggatgatgctgagctagaaagccaaggggcctttgtggatggtggtaccattatctgagctaggcaaagtcggtttgaaaagaaggtaatgatttccatttttgtcttactgatccatcttagactatccaggtctactagaagtatgggcatggaagagattgattaatgtgttagtccattttgtgttactatcaaggaatacctgaggctggatgatttataaagaaaagaagtttatttgactcatggttctgcaggttgtacaagaagtgtggcgccagcacctgcttctggtcgggacctctggaagcatttacttgtggtagaaggcaaagggggagcaggcatgtcacatggcaagagagggagcaagagagaggaggagatgccaggctctttttaacaatcagatctcccattaactaatagagaaagaattaactcattaccgtgaggacagcaccaaaccattcacgagtgatccacccgcaaggcccaaacaccttccattaggcccgacctccaacattggagatcaaatttcaacatgatagttggagagaagaaatatcaaaactgtatcacttactaagagagtcttgactaagaacagaagaggactgaggaaatcatcttaggcacacccattatttaagagattgggggaagaaggaagggccagtaatgaaggctgagaaggaaagacagagataagaaaaaggccagaaaagggtggttttcccaaatcccaggaaatatgacttttaaaaactaggtcaggattgacacacagaatagggtggaaactggagagtgcccattggttttggcattttagaggacacagctgaccctggaggagattaggaagcatgatggggatgatggtcatatggtagaggcttccagaggctagctggttataatgatgtcccaagtcttgagtgaagaaatggagacaaagagaaggtgtgagattagggaatctagagtataatacaggcataagagagggatcttatgtttccttttcctcaaaaaaaaaggctaatttaaagggaattgaacaatgagaacacatggacacaggaaggggaacatcacactctggggactgttgtggggtgcggggagggcggagggataccattaggagatatacctaatgctaaatgacgagttaatgggtgcagcacaccagcatggcacatgtatacatatgtaactaacctgcacgttgtgcacatgtaccctaaaacttaaagtataataataataaaataaaaaaatttaaaaaaatatatacttagaagatacagtggacagggtataatagaaagaataaagaaataaagagataggccaggtgcagtggctcaagcctataatcccagcactttgggaggctgaggtaggcagattgcttgagcccaggagttcaagaccagcttgggcaacatggcgaaactccatctctacaaacaaacaaacaacaaacacacaaacaaaaacacaaaaattagctaggtgtggtggcatgtgtctgtggtcccagctactcagttggaagctaaggtcggaggatctcttgagcccaagaggttgaggcttcagtgagccatgattgtaccaccgtactccagcctgcacaacagagcgagaccctgtctcaaggaaaaaaaaaaaaaaaaaaagaattaaagaataatgacagagtagacagaagaaagcctgctgcaggaatgagagcccagaatatggtgtggccttaggaaggaggaaggactctttttttctccaggattggagagagaaaacagtggaccatcatgtcaccaaatggaagtgaggtccagagggtatcagtagaattcaaggaagctttcattaacctgtgacttaaagaaacattgctgtgtgcttattgctccccattctgttacttgataatgggtcctctgtgacccatagtttcaaatttaacctaatatggagtttaaactgtttttcagtccaggatttttgccaccatttgtcattctagaacacttgggggaatggtagaccaagattggtcatcttttatacagcttattatgtccagagttgatattgattgacagatacccctctcatctctctttctctctcaacccttgctctcatagagcactgctgctcaaagtatacatccctttagttacctatattttatagtattctgtacctccagtaaatacagttcttttctttttcttgcttgtttttcccttgatgttttctaactttttttttctgagctggctagtaatctttgtcatgttgtaaactatagatgaatcttctgtggatttttgtatatgtaccattggtctttatcttgaggatctaaacaaatgaaggaaaagagttgaagagaaatgtaggaaatagacatctttctctttggacagcagggctttagaaaagctctgaggttgtgtgtgttgttccacagggcctagagagatagaaaacctcctcagaagcagtgactgctcctggtgaaaatcaaagttcaggccaatgctatctggggaccttaggagaaggaggcagccaggataggaaagtttgataggattttgtgggaacctacaattgcttcagaaattattaggttgagttatataaaattgctgatggtgttaaccatttttgactgacaaaaaaggtaatttcatataattcaacctagtgattctaagatatacttttgaatcataaccccttcaaaagctagggactcctatgcttgattatgtgtgagagtcccttttctgtaaatctttttttggttataattgtaagcactatgcacacatattaggttcttacagactgttactcatgcagcatggtcatttggccacaaccaaaactaggtaagtattgatcacaagctgggacagtttccccggggtcctactgcagcccaacttcaatccctgagatctccaaattcttactgtaggcaaacagttctcaacagtctacaacaatgtctggacatgcttttgattgtcttggagggaagggggattctattggcatcttgtgggtggtggttagggatgctgctaaacatcctcaatacacaagacatcccctcataatgaagaattttctggcccaaaatatcagtagtgccaaggctaagaaacttgttctagactgagcactagagaactcaagaaaatacccgcaaacttgtatatcatcctttttagtggtatgcaaaatttataaagagaagggcagaactaagaagaattaagtttggagaagatataatagaataaaacagattgcctaaatatcctacagttgtgaagctgcctgtctggtgaacatgctcagagcacttagatttggatagttttaaaaaagagttgggtcatcagagagtgagttttcgatggaatgtgacagtgccaaattttttctactgcttgaatgaaaggaaatgaaaacaagaacagaagttatagaatagggtaagagggacgttgccatacagaaagtaaaaatttaaaaccttacttattccttttgaattgaataattgatgtgtctactactatggttactgagttgggtaacattttcgggtacaaatagtggtataggtatgaatgggggggaagtaatatgataaactctttaatcctaaatttttaaacttgattgagagaggtctagccttttatttggcataaattatctgggtgacccagaaggttctgtaaatatatttgactgagttgcttttagctctgagagctataaagagatattaagaggtgtccttataaagagctgttaataattgagtatatgaagcattatctgtgctatgggaaagatagctgtattttcatttaggttaactttttgaaaaaaaaatgtaagtggacatgagtagtatataattttgtgttgctgattgtgaacactgaagctttttaaatcttagaaatcactttattctagaactatattctgattaatatttaagttctccaggtagctctccaagcttgaagtgcattgaagcctagggctgaactacttgaagaaactaatcgttgttacagtgttttaaggattaaaaacataaagttctatttgggggtgtcagaaagatctttcctcgcgaccccaagctatagtggaagtaggaacttcattcatttttctacctgttggatagaagagaatggaacgggttggcctggtcaaggatctcagatgtgcagggccttgtagaaaaagaagagatagggatggggcctggggcttcaggggtagacctactgaaaaatttgcctttctgctgctgtcgacttttatttctaaatttctgcccagtcttcatttctccccacaatttacttatcagcaaatgtagtctcagcaacttctcttcagtgtttttaaagaagtgtaaaaaccattttttaaaaaactagtttcccttttctttttttcccctaggaattaaggatatttatggaggggaagcttaaattcaggtgtccctgagtatctatggtggattgattccaggactccctgtggataccaaatcccgtggaagctcaagtccctgatataaaatgtagtgtttccatataacctgtgaacattctcctgtgtgctttaagtcatccctggattacttataatacctaatacaatgggaatgctatatagatagttgttatcctatattggttttctatttgtatttttttaattgttgtattttgtgtgtgtgtgtggtggttttcttttcaaatattttccatctgagtttggttgaatctgaggatgtggaccttgtggatatagaaggccagctgtatttttttttttcatttcacttagatattatttctttctttttacttaaatcctgcagtaaagtaaaatgatgtactgagaactaaagttgtattccttggtacttccgagagaaaacagacttggatttttattggatgattcctcctaggaagtaagatgagggcgttcaagaataataacagtaaggctttggtaaggccaaagaggtgggataatgctgggagatggtgccaaggattctcaataggggaggagcaggagtggaaggtagaaggttagatccagtgctgtgataaccttggaatgaaaaatagaaaagaatttgagagacatcttagagattaggttatagatacagcaaaggagaaaagtcccaaatgcctgcagcagcagttgccatttctgaactatttatttttaggaaacataagtttcacgtgtgtgggtaggcagcttgattggaacagaaaactgatgccttgtgtctgctttttgagtcccatttatgaaacgctgttttttttatggctcgagagcactctaccaggaagtattgaatataaggagttaaataaggataaaatagctattcttttctgaggatagagtaggaagtgatgggttgtggttagagcatgagggttagatatttttaaaagatgttcagggctggtcaatcggtgttgggagatggtaagttaaccaatatggtaaattcttctctagagacacctaaaatactgttttggagataatttgaatgtaaactcctgaagtttacttttagttcaagattctttgaaaaagaaaaaaacctcaaggctgtcatgtaaataggacatgtgttaatttacctgacatacttgaagactagacatggtaattgatcattgtgtggcagtagcaggaaatcagtaacccaagctgctcatatcttctaaaatctccctagcaacaaagtcagcaaaggccatccttccagcaattactgccagcttagagaactggcttgagattctttgtggattgcccagaacaccaagatcttctgtttcagtagtctgttacaaatggtcatcttccacctctatagaatgatctgtgtttttacttatccttttaaagttctattcctgtaaatttctgattcttaaagcacagagttcttttgagaatcccatgacaatttataagaaaacactcaaaagaggataaaatataaaagcaatgtagtattacagctggcatgcatgtattatttctacctcacagaaaactgtaggataaggaaattgaattacatgcttaaggtcacattgttaatgccacaacaagctgtgcacaaaccctaaaagacaaaaatataaatttccaatttttgtctaaataattttctactaccctaaggattgacaatatttggcacacgggcagcttctctccaccatccccttctgaagtaatagtggtgcatggccctagtttcagactcatgcacatggttggaaattttgctggctctttggagctctgtgagttcatggtgttacattcatggtcattatctcctctactctaactggtcagaagaatcataatcagtaatttataatgttcattttgaagtgttgctgatgcctgtacctcagactggtctacattgagagcattttggggtatagcttgccagtgattctgaaatgactgacataactctgagggtacccccttacctgctctgtagaaagtagacatccctttggatgtgtctcaaacattgcacaaggcatggggtctcctgtggttgggaatgaagtcaaggaagagagtgacaactaggtggaagtgggtggaaagagaaacatgaactagatacaagcacggctcacctacagtgtttttctttcctttttccagagagtgtacaagaggtattttgtccagttgttcaggggctgcaagcttatcattctttgttccttttggtatctaatgtcctctttcccacatcaaatctatcagctattcctcttggctctgcctttggaatatccagaatcctaccttttgttttcctgcttctatcccattgccacactaatataagctcattaacaccactcacctgaactattaaaataacctcttttatttgtctccctgactcccctttcctcacccagtctttgctccatatagccaccatagtaattcttcaaaataaaacttgactcacaatactcccctgaccaaaaccctctagcagcttcccattacattttgaatgaaatatcaagtcccttctgtgacctataatgctataatgcacagagttgtctggaacctggtcagttctctgtccaccactccgtcccttgcttgctcttctccagtcacactggctttctggttctttcttgaatccatcaggcatgcccttgccttaggacctttgcttttgctgctttcctctgcctggaatgttccttcccaagatgactgaatcgctggctttctcactacatttagaccactttaaatttcatttccttggggaggccttttctgatcaccctatctgaagcagtatcctctatctatttctcttcttacttttttatttttcataacattatctgtgctcgacattgtatgtctagttgtctgcgtgtttcctccattagaatgtgtgctccatgaaggcagacactgtctgttttgttcactgctattatatctagatgatagatagaacagtgcctggcacatagcaggcactaaataaaaatgtgttaatgaattaatatattaatcaacaaagtatgtcacattctttttttttttttttgagatagggtcttgctctgttgcccaagttggagtgcagtgaggcaatcatagttcattgtaaccttgaattactgggctcaagtgatcttcccacctcagcctcccagcagctaggactttttgtagagatgatgatgtctagccattttgcccagtctggtctcgaactcctggcctcaagcaatcttcctgccatggccaaatcttttttgacattggcagccaaagggtgaatctaattataactctgtgtgtgtgtgtgtgtgtgtgtgtgtgtgtgttccttcaagtgtatcaggctctgtgctatatactttgcttgcattacctagtttagtaaaacagctgtcaggtaggtgctattattatctcccttacggtaataaagaaatggaggttaagagaggcaactttgctcaagttcacacagtattaaataatataaggtaattgaactaggtctcctctggctccaaaatcttaactcaataactgtgatatatgctgcgtttcctaattttgaatctgccaaaatcctattggggaacaaatagtgtaagagaatttttgtagcatatatttccacagaggactacaaaaaattacaaagtatatatatttttttcaaaatgaaagaagttactgaaatagtttagaaactagattacgttaaagttcacatgttaatgaagaaatacaagtatttattcaggtatatcaactaaagtaaataatgttactttgaagttcacatgttaatataaaaatacaagtattcagctgtatcaactaaagtaaataatgtattttaaagctcacattatctttctatttaaagcatttatttgaggaaggatatctgttgttaaattctacaaataaaatttattgtattaggcatatttataagctgctcccctttatctctataagcttagagggtgtctattcttttcttacttgccctattcatccattgtctacagttagcaattaaaggttatcacttcttattcttgttttcccctcctttgttctcatttatgcagttctcagcacctccccttcaggtatccctcccacctaaaccgtcagtaggtcgtttcatttgacaatggagagcccctctagctcagtctcgcctagacttacacagttcacccaatacctctccttagcctcccttcttctgggaagtgcatgaaatgtccaatatcctctttagattcctgttctgatgatttccctgtctttcccatgttacctcagaacttctatatgcataatttatattttataaaattgtttcacattgttaggtcttcattccgcatgggaaaaagatagcccctttctccttcccgaaatataacccattaaatatctgtaaccaactcacctgaaactgaacttagaaagggctcttatcccacaggaagacactactagaattttgaacattctttgaaagcatagaagccttgagattttgaggagcagtaagatactcagagaaacttagagctggaagatacttgagaggccataggtctggttccttttctttggtgttttgttgtagcttgtattacttagcatgcatttggttgcaagtaacagaataccccaactaaggacaaaacaataaaattatttattatctttctttttttttgagatggaatcttgctctgtcgcccgggctggagtgcagtggcactatctccactcacagcaacctctgcctccctggttcaagcaattctcctgcctcagcctcccaagtagctgggattacaggtgcccaccactgtgcctggctaacttttttgtatttttagtagagacagggtttcaccaggttggccaggctgagatcaggtttcaaactcccgacctcaagtgatccgcccgcctcggcctcgcaaagtgctgggattataggcgtgagccaccacaactggcctactgtctttcttaacaagaagttcccagcaagggtacttccagggtttgattttcagttaaaaacaaaacaaacaaacaaacaaaaaacatgattcagacccaggtgctttctataactcccatctgttatcttcaacttatagatgaagtctgtcctcctgttgagatggccatgacatcacatgcatacacaacaacattcttgatggagaagagacatgtttccatcctgtttattatattaataacaactgtttattatgaaagaaagagtcttcccaagtgactcagcagactgctgcttacatatctagctacaagggaagcctggattgcacctgtctggcattttggcctttctgatgggcagagaagggatgggggcaggattctgctggcaaagaagagggaaggaatagctgttggtgaggcaatgttaatgtctgtcatttgtgctgaacccaagaagaaaaacgtctgaatcatctgtatcactttttcgtattgtctggatagcaacaatttatttctgtttacaaatgtttgcaagtttgaactctttgattgttgttaactagaagagagggatcaaggaagggagggaggtacaatggatattagtttgcaggggctaccaaaacatcatagactagatgcttataaacaacagaaatttggttctcacagttctggagataggaagtccagcatagtcaggttttggtgaggggtctcttctgtactgcacactgctgacttctcattgtgcccttgcatggaggaaagaactagtatgctctctggggactctcttataagatactaatcccattcatgaggcctctactctcatgacataatcatctcccacagtcttcctctcctaataccattacattgggggtagatttcaacatatgaatttggctgaggggacacaaatattcagtccataacagaaagagaagaaggaaggaatgagatgtaaatttaaaagaattacaatgaataatcttgcatatatatataagcttgtccatgtggcaaatattctgagctattattatgtgacaggaatattttaaaactgcattttagtgtgaccttggactttggtctgtagtttctcatttctccttgtggaagctcaagtttacaagatgattataaaataaaagaatgaccagtttttattcccctttctgacatttgtgcaaaggaaaattgctgtactagtggggttttacagagtcatataattaaacttagggagagattttaaaatggaatagaggatactttcctaaattaggctgctgataaaagtatacataacaatgaaatagaaagtaactctttctaatttgttgattcacttatgtctagtaagagttattgagagaattggcctataatatctactattaattttagtatgaaagtattttagattcaggcatatgacaagccagttacagccatctttcatttactaagtgtcttttatacatgaagacctgtggtaggtactagggatccataaatacagatatggcccccttattacctgttagaccttgagctccagtcggggagagacctatgtagactaacaatgataattctgtgtaataaggactacagtagagtcatatagggtgataattaccacaaatgacagtgttcatcacataaaatagttaatattattcttatttctaggtgaaaaaaaaaatggagctgcagagtggtcaaattaacttgtccataagtagcagagtgagattgtgaactaggcctcttgcccccagtcccatgtcctttgccttacttgcatggaagagaaaatcaaagcctctcttctatttgaaggtaatatcagaaaagacttcgtggagaatattgtatttgagattgatcttgagagatgagctctctatagagtgaaggcagagacgttctaggcaatgagaatagcacgtaaaggtatcataattttgttggcacaatttgtagcagagaaaagattagtaaggtagctgagtcttctgatgagaggccgtatactcaaaatataaggtataaagtacatacttcagacatttatattttattaaatggacagcagtaggccccagggggttttgagcaagtgacagctatgatcagaagggcacacatgggtaattaatttttcacaaaagtatctagttgtgctggagatgactcagagaagagtttatagagcagtccaagcaacagataacaagggccctgtcataaacagctatcttttcctaggatttaagtgattgacaatctcatatagtagtgggaaaagaagtaggtgaccacaaatttgagaactatttatatttgttgctattttcttgttttagtgaacaattacttatatctcctgaaagttaaagttgtctttctgcttatacctatttccttcattctcttgtttatgaaaatctcaccttagagagatttaattaatctttctaagattaattttcaattgcttcaaactaccaaaaagagagactgatactttgtggcaagatggggtaacaagtaacagagtgagattgtctttattttcactcatgcctaagacaaccaaaacactggacaaaagcatattaaataagtgttgtcagtatattgaacaccaggcaaagtaaaactgaatttatcacaagtgacatgatcatacatgcagaaaatgtgatggattctaccaaaaagaactgataaggaagtttagcagagtttcagaatacaagatcaagatacagaaatcatttatatttctcaatattggcaagaacatttagatactgaaatgaaaaataaatatccccatatcttgaagaagtataaaacattaggaatgcatctggcaaaatatgtgtaagactgatgtactgaaaagaacaaaacattgctgagagaaattaaagaccaaaataaatagacagaccatgtacatggattgtaaaactcaatattgttaagatgccagtttaccccaaattgatctatagggtcaacataatcccattcaaaatcccagaagacttttttgttgctgttaaagttgataagctcagtctaaaactcatacggaaatacaaaggacctaaaaaagccacaaaccattttgaacaaaatataataaacttgaagggctaacactatctgattttatgaattatgataaatttatagtaatcaaagtagtgtggtattggtataaagacagacaaataggtcaacagaacagaataaagagtcctaaaagagactcaaagatttgtggtccatttatttttgacaaagatgcaaaggcaattcactggagaaagaatagttttttttcagcaaatggcattggaaaaatttgatatccatatgcagaaaaatgaaacatccatacctcatgccatttataaaaactaacaatgtattattgacctaagtgtacgtacaaccctaaaactataaaatgtgtagaagaaacgtagaaaatctttgtgaccttggattaagcaaagatttcttaaaagaaaacctccataaataggacttcatcataattaaaaatttctgttctttcaaagacactgttaagaaaatgaaaagggaagccatagatttagaggaaatatttgcaagtcacatgtatgatagaggacttgatccagaataactcaataataaaataatccaataaaaataggaaaagaatgtataccaatggcaaataaacaaatgaaaagctcgtgacataaatgtttaacaccattatagtcattagggaaatgcaaagaaaaaccaccgagagatatcacaacatacctgttataatagaaaaaaaaaaaaaaggaccatatcaagtcttagcagagatgtagagcaactagaatgctcatacactgctggtggtaatgtagcatggtagaaatgccatcaggcaagaaagtagttccctaaaattaaatatttgaacttgggaagatatatctggtatctttttggtagtttgaaaaacagctttctgaaagcagttccctaaaattaaatgtttacttaaaaatgactcaactattctacttctagaaaattacccaagagaaatgaaggcatatgtccgtataaatagatatatgtaaatgttcatagcagctttatttgtaatcaccaaaaactggaatcacccttaattgttcatcaacaggtgaatgaataaataatttttgtatgttcatctaatggaatacacctctacaataaaaaggaatgaattattgatacattcaataacatggataaatctcaaagtaattagctaactgaaagaatccagacattccctctcaagaaaaaagttttattcccttcacataaaatttagaatatgcaaactaatttatattgactgaaagcaaattggtggttgctaagggacagcaggagaagagaaagaggaatttttaaagggtatggggaaacttttggaggtgatggatatgttcattatcttatttttggttttggttttatgagtgtataggtttgtcaaaacttatcaaatagtacactttacatatgtgcaattctaatatcaactatacttcaataaagctgtttcataaactaccaaaaagataccagatatatcttcccaagttcaaataaaacttagaattctaagaaactgatacatgacctatacatagcatttagatctcacaatttttaagaattttttctgtgtgtttgtatctatactttatttttttaaattctttaaatgaaaattatctttttggtgagagagtagagaagtagaaacttatataataactacttatgagagcatttgaagcaatgactatggaaaaacacttttaagtatgtgcataccctacaacctagcaattctctttctaggtatacagatggccatgacctatgatggttcgacctctgagttttcaactttacaatggtgtgaaacaattctgtttttcacgttcagtacagtattcaataaattacatgacatattcaacactttattataaaataggctttgtgttggatgactttgcccaactataggctaatgtcagtgttctcagcacatttaaggtaggctaagctaagctatgatgtccagtaggattggtgtgttaagtgcattttcaacttaataatattttcaactcacagtgggtgtataagatgttacccacaataagtcaaggagtgtctatagatgaagaatagttgctctcaaactggtctcaagactcttttgtactcttaaattactaacgaactgaaaaagcttttgtgtatgtgagatatttactatattaaaaattactcgtcacttacattaggtacatctcctaatgctatccctcccccttcccctacaccacaacaggccccggtgtgtgatgttccccttcctgtgtccatgtgttctcattcttcaattcccacctatgagtgagaacatgtggtgtttggttttttgttcttgcgatagtttgctgagaatgatggtttccagcttcatccatgtccctacaaaggacatgaactcatcattttttatggctgcatagtattccgtggtgtatatgtgccacattttcttaatccagtctatcattgatggacattcgggttggttccatgtctttgctattgtgaatattgctgcaataaacatacgtatgcatgtgtctttatagcagcatgatttataatcctttgggtatatacccagtaatgggatggctgggtcaaatggtatttctggttccagatccttgagaaattgccacactgtcttccacaatggttgaactagtttacagtcccatcaacagtgtaaaagtgttcctatttctccacatcctctccagcacctgttgtttcctgactttttaatgatcaccattctaactggtgtgagatggtatctcatttggttttgctttgcatttctctgatggccagtaatgatgagcattttttcatgtgtctgttggctgcataaatgtcttcttttgagaagtgtctgttcatatcctttgcccacttgttgatggggttgtttgtttttttcttgtaaatttgttagagttctttgtagattctggatattagccctttgtcagatgagtagattgcaaaaattttctcccattctgtaggttgcctgtccactctgatggtagtttcttttgctgtgcagaagctctttagtttaattagatcccatttgtcaattttggcttttgttgccgttgcttttggtgttttagacatgaagtccttgcccatgcatatacctaatgtacatgacgagttaatgggtgcagcacaccaacatggcacatatatacgtatgtaacaaacctgcacgttgtacacatgtaccctagaacttaaagtataataaaaaaatataaaaatcaaaataaaaattacaactgggacagttttttaaaattcacttttaaataataataaatctgttaacatgttacatataaacatgttaatacaaataatacttttaggggaaatgatagttctcaaaaaaaagcagtgaaaagaatattatcattttatatttttataaatctttttaatttcttactcaataaaagaccagcatttatatctgtttctgtaatcaacctgtttgcatatattattttagttagagtgtgtgaagaaaatctggcctcataaagatactcagttagaaaaatgagaactgttttaataaccttttcagaaaattgtgaatattctttgatactacactacaattctccaagttgtagtttcttaagtttaaattgcaaccttgactctgaaactgtatcagtgaactgtttatcttctgttacgtttaaatgcattggtctatatggtactttgaatgcatttttttacccatgcgttattttgtaatgttatgcgctagtcatttggaaaatattggttcactgagttatttacaccttccaatgttgactcatttgattattttagctaaagtatgtcttttatacattttgctcaataaatattgtacacagtgctctgcaaagtgttgtatgtgaaacagacattactgcttttaaggagctgtgatatggtagaaattatgacaaatatacatctattctgaacacccagcaggaacaaagtacctcacgttttaaagcacaggaaggccacatgggactgcatttgaaaggggccaggaaagacttcctgaaggatgagtaaaagtccaataaaggaaaatattgagagaagggtgttgatgggaaggggatgatgacagaaatttaaaatcagtataaattaagaaataagcctgccttgatccacttataattccgaacagttattgatatcctttagtctaaggagtttagatatttttcagtggtagaatatcaatttttaaaaacatttattgtgaagagaaatgcaatgcataaaatgtatagtttaatgattactgagtgtggatttggagtaagaagaatacatgtgcatgtttgttgcaagcgcatgtttgttgcatgggattgcctaggaactgggtatcacatgcaggtctctgcaagataagtgtggactgtaacagaagtcatgcagtgtctgctgtcctgaagaggtcatcctgtactgttggaagtacttaagtctgtactgtcccactgtggcttagcttctgttccttagcacatgatctttggttgtcccagctaactctttgacagcattaactgcttttctgaatgctgggcactccctgttggccagtagataatttttttaaaaaatacacctggactcatactaatagatgtgaacagtgaatgtattataaaggtttactctcttacaaactcaggttaaattatagtaatttaatgcatgcatgttgttctacaaaagcttacatgtgtacaaaattcttttctcttttaatatttgacctcatcctgccactcatatgacaagtgtatttactagcacctttcaaagttcaaatgcaaatgagatatgcttttagctgttaagtttgaagagtacatttatgttattgccttcaaatggcatatagaataagtgcccacatttgagacattgtgcttatagcagtaacaaagaagattaaatacatgaggcttagccttcctggagtttataattttaaaaatggcataagtaccagcaaacaggtaaattcagaagagagtacagaagaaaattaagtagcaaaatatactcaagaataaataaatatattgggtaaataatatatgtacatgtccatgggtaaaatattacagtttaattttttaaattttgttatcagctattatcaaagtacttttaaggtcatatattagtaaacaggcttatatgttccaagtttgaaatgaatttttgcatgtaattgttaatatcattgattaatatcttctattttcatagatttgatccaggctaccaacgagaccaatgttaatattcctcagatggccgacactctctttgagcgggcaacaaacagtagctgggtggttgtgtttaaggctttagtgacaacacatcatctcatggtgcatggaaatgaggtaaactaagtaaacttttctttttttgatggaggaaggaggcttttaggaagagcatggtgatgatttaaggctctttgaattttcactaattaggagaaaaagaaaaggaaatacacagttccggatcatctagaatacaagtttaatcttctccttagctagttaacaaaaaataaactttaagttagacattgtcttagagatatgaggaataggtacacctcagagatattgcaggtttgattccagaccactgcaaaaaaaagctaatattgcaataagcgagtcacacaaatgttttggtttcccagtgcatgtaaaagttacatttacatttatactgtactctattaagtgtgcaatagtattatgtctaaaaaaagtacatatcttaatttaaaaatcctttattgctaaaaaattattatcaaatgatcatctgagtcttcagtgagttgtaatctttgctggtagaaggtcttgccctgatattgatggctgctgactgattaggatggtggttgctgaaggttgaagtaattgcagaagtctcttaaaataagacaacagtgaagtttgccacatcaattgactcttccttttacaaaagatttctctgtagcattcaatgctctttgacagcattttatctacagcagaacttctttgaaaattggagtcaatcctctcaaaccttgctattgctttatcagctgtttatgtaatttctatatcctttgttgttatttcaacaatgttcacagtatctttaccagaagtagattttatctcaagaaactactttctttctcgtccataagaagcaactcctcatccattcaaattttatcatgagattatagcaattcagtcccatcttcaggctccatgtccaattctagttcccttgctattttcccacacatctgcagttacttcctctactggtcttgaatccctcaaagtcatccataggggctgaaatgctcttcttccagattcctgctaatgttgctatctgtatgtcctcccatgaatcacaaatgtttttaatggcatctagaatggtcaatcttttctagaaggttttcaatttactttgcccacatccatcagaggaatcactatctgtggtagctatagccttacaaaatgtatttcttaaataacaagacttgaaagtaaaaattactccttgatccatgggctgcacaatgaatgttgtgttagcagtcatgaaaacaacgtgcatctctttgtgcatctccatcagagctcttatggtgacaaggtgcatgtcaatgagcagtaatattttgaaaggaatctttttttctgagcagtaagtctcaacagtgggcttcaaatattcagtaaaccatactataaacagagtgtgctatcatccgggctttgttgttccatttatagagcacaggcagagtaggtttagtgtaattcttaagggccctagattttcagaatggtaaatgagcattgactttcacttcatgtcatcagctgcattagcccctaacaagagagtcaggctgtcctttgaagttttgaagtcaggtactgtattctcctttctagataagaaagttctagatggcatcttcttccaattgaaggctgctttatctacattgaaaatctgtttcatgtagccaccttcatgaattatctcagctagatcttctggataacttgctgcagcttcttcatcagcacttcctgcttcaccttgtacttttatattgtggagatggcttctttccttaaacctcatgaactaacctctgctagcatcaaacttttattctgcagtttcctcacctctctcagccctcctagaattgaaaaaaagttgaggccttgctctgaattaggctttggcttgagggaatgttgtagctggtttgatcttttatccagaccactcaaacattctccatatcagcaagaaagctatttcactttcttatcatttgtgtgttcattaaagtagcactttcaattttcttcaagacttttcctttatatttacaacttggctaactggcacaagagagctagcttttggcctttctcagctttcgacatgccactctcattaagcttaatcacttctagctcttgacttaaagtgagagatgtgtgactcttcctttcatttgaatatctagaggtcattgtagggttattagttggcttaattgcaatatttttgtgtctcagggaataaggaggcctgaggaaagggagaaagtcaggggaacaaccagcggtggtgcagtcagaacatatgccacatttactgattaagtttgccatcatttatgggcacagttcatggcaactcagaacaattacattagtaacatcaaagatcactgatgacagatcaccaaaacagatataataataatgaaaaagtttgaactattgtgagaattaccaaaatgtgacacaaagtgagcactgatagactggctcatccctgagttgccacaaatcttcaatttgcaaaaagtgcaataaaaaagaagctcaataaaatgagatatgcctgtgttaaaattataggttcaaaaaatggatataccatgtaaacctatttttaagcaaaaatgttaggagaaggaacaataaaattatttttcccataggaaagatttctttgaatctttgagtgaaaattgcattcgtaagatatttattttggaaaatactgataaaattaaaattaccaattttatgtaggatgcctactgaatcctaataaattgtagtatttccattatgtgtagaaatgaaagatcgtacaatttaattctaattcacaaagctttttttcccctcagagaaattcagcattctaggaaactttataactgagtaaaagagatcccaatgagaatttgttaaaaaaaaaaatcgctttagtgtcagaaattgtttaaaagtatgattttaaaatgtgtgtttaattctaatttttgtttttcagagatttattcaatatttggcttctagaaatacactattcaatctcagcaattttttggacaaaagtggatcccatggtgagaatatttgtattttataattttttgccaatgctttgatttttgaagtgaggctattaatccaaaatcattgcaactgatagcttcattgaatatttaagaatgtaaaaataattatatttaaatatagctttaaaatatttaattatagacaactcagcatataaaatatatattaagtttattttgggcgtttttaccacgtttaccttaaaaagtaacagtgggtgtgctagacccacagttgttttttatgaaggtacaggagacaatgaaataaaagatgtcttctcaattaaaaaaagtgattcgagtcttaaagaaatgttttgtgtggattaatagggtttgaactgcattcatttgttcatttatcatattcactgtttatctgttgtgtgtaaagcaagcacatcaagcaaatggaacattatcagatggctgcatgaattaagtctgaaactggccattatttgaaaaatgaacaaaagttcaaggaaaatttaaaaacatattctgtactggaatggtggaataagtaattgaagaatcctggaatgcctcatggcaaaagtatttttgcctagaagcaggattttaaatgagatctatctgatacagttattgaccctatcctaggactatcaccatttagagagttaaaaaaaaatagtactatgcaaagcacagttgaaggtattttattaattagttttatttcttctttccactctcccaggttatgatatgtctaccttcataaggcgctatagtagatatttgaatgaaaaggctttttcttacagacagatggcctttgattttgccagggtgaagaaagggtatgtttttgtctttcttatatttattagaggagaataagtctttgaggcatacttgatttattttaactaagcttaaatgccagctaattttcttgaaggcccagtttacaataacctaaaaaaaggaactcaataatattgtagaagttagccttgaagttgcaatatgcattattttgtttatatcttcatgcagaaaaatctgatttgcttctcagtttatatgctataaaatttttttcttctctctaatcccaggacaaattatataacattttatttgttaaaaactcaaaatttttaaacatgtatatacctttaaataatttaagaaggagggaattaagacaagattcacttaaaagtatagtggctgtagatgacaatagctatttggcctggcacagtgatacctgtaatcccagtactttgggaggccaaactgggaggatcatttgagctcaggagttaaagaacagcctgggcaacgtaggagttaaagaccagcctgggcaatgcagtgagactttctctctactaaaaattaaacaaattagtcaggcgtggtggtgtgtgcctgtagtcccagctgcttgggaggctaaggcaggaggattgcttgatcctaggagactgaggctacagtgagctatgttcatgcccctgcactccagcctgggcaaccctgtctctaagaccctgtgtcaaaaaaaaaaaagatggaaaatagccaatagctatataaatattttttttttaattgaggtgaatctgaactttgatctggttttgagagacgtatcattctagaaaacacatatataaacacacaccataatcaaactaattgttaatactaccaattaagaaaacctcattgaaacagaaacacttgaattttatctataattaccatttatttccctctaaatagatgcataaatctagtcagaggcattcagccacacatttgtgcatatcttatatctgttcctcatttgaaataatggcaaggtactatagcagctttaatattttagtctcaagaatccacacaaaaagatgtaactttatttttgcaatggctaacctgaccttagtttggggctactttttttaccatggtggtgaaaaacatcaacttgcctattcaaaataatttattgtagatgaatactttataaaagtaggtgttttccttcaccctcttctcacgagagatgattctagttcatatgccttcctctaacttcttacatggcaccatgcaaccattgctgatgttcccagctgcattgtgacctctgcagtaggtccatggccttcctagaaacttctgcacccctgtatgaacacatatggacacttcaggttgctttctccactgttggtctgggagagaccctgaaagttgccatgatcagcatgtccacatcatctgggtattttcttcagctattacaatactgctgctcctcaaccatcaccatcactggatacaagggcttcctaagagacctgaaggtggagacaaggtgcagtgcaccctccgacatcagcattaaccttcagtctcatcttctgtagctaaactcttacctttgtttgggaaaagtgttcttatcagcatgcatttttcttcccttgatggttaatagcataaaccttgtactccaagtcatacaggttttataaacttccaagacatgttttctctttctcaaaaaaaaagaaaaaaaaactggcttttttgaaagcttatattttgattgggcaaagtggctcatggctatagtctcagcactttggtagatcatggagggaggactctgtgaggtcaggagtttaagaccagcctgggcaacatagtgagactcccatccctaccaaaacaaattttttaaaaattaaccgggtgtggtggcatgcacctgtagttccagctactcatgaggctgaggcaggagaatcacttgtgcccaggagtttgagattacagtgagctatgatcatgccattgcactccagtttgggtgacagagtgagactgtctcaaaaaaaaaaaaaaaaaaagaagaaaacatacttttcaacactattacctttattatagatttagaaaaatccattcataaattcagcttgcctcttttatccagacccgattgctttcttcctaagggcagtacacatagaaaacaaacaagcattgcctgtgcaatggaggaataagaatagataatagatagaggggggaaatgactacaaccttgtaatacctcaaattgatcccacaggattaataaggaaatggggtggtgtgggggaacagcttagaacaattcatatggtcttgaattgtccatatccaatgaaattgtaccttttttttttttttaattgtagggccgatggtgtaatgaggacaatggctcccgaaaagctgctaaagagtatgccaatactacagggacaaattgatgcactgcttgaatttgatgtatgtatctcactagaaaatgtttcatacacaatcaatgttgtctttcatttgaagatgggctacaggtaaatccaaagatttcctcgggaagcagctatagatcttcatttagatgaatacttagttcaggctgttaagctcggtaaagattatttaggttcccctgatttttctaagcagtttaccaggtgtttacataagtcatggaaaaatatgaatggtacattcttggaacttcatgttctgagcaggatagtgacttcctattgtacttgacaggatgaagtatctgcaagatgtgccttcaggcagttaaataacttgacctgctgttagaaatcttttttattttttattttattttattttgttttatttatttatttttttgagacggagtctcactctgtcacccaggctggagtgcagtggcgcgatctccgctcacaagctctgcctcctgggttcacgccattctcctacctcagcctcctgagcagctgggactgcaggcgcccgccaccatgcccggccaattttctgcattttcagtagagatggcatctcaccatgctagccaggatggtctcgatctccttacctcatgatctgcctacctcggcctcccaaaattctgggattacaggcatgagccaccacgcctggcctagaaaccattttatgcagattgcttaaatgacactatccaccaaagaattgtgtttaatcttagataaattagtgaattgtttcattgtcaatatcctggttgtgatattgtactatagttttataggatgttaccattaggataaactgggtaaatggtatatgggagctttctgtattccttcttacacctgcatgtaaatttagagttatcttaaaataaaaaaattaattttgaagaatcttgaggctgggcatggctcacgcctgtaatcccaaactttgggaggccaaagcaggcagatcacttgacaaggtcaggagtttgagaccagcatggccaacatggtgaaactctgtctctactaaaaataccaaaaaaaaaaaaaaaaaaaagcaaggtgtggtggtgcatgcctgtaatcctagctacttgggaggctgaggtgggaggatcgcttgaacctgggaggcagaggtagcagtgagctgagatcatgccactgcactccagtctagacgacagagtgagactctgtctcaaaaaaaaaaaaaatctgaaatctgattcatgaaagtaaaatattttgacatgtagagacattattaactcatattgttcagcctttttgtattttggtagttgcctacaacaaagattttcctcaaattttagtaacttagcatctctgttaagattgtatggtttagtctataattaggtgctaatcacaacacctaactcctgtgaaatttcataaaagcagcaaaccatcttattttttaacagattttatgataaggacttcactaagtatctgtcgaattgccttttagcttttattttctttttaattcgtttatttttctttactttccttgaccttagtaagggttctgtcttaaaagagaaagtcataaagggaaaaagaaaaggattgaggagtggggagaaattatgtgcctttgtgttgatgattagagtagtttggaataggtgaacagttatgagtctctagagttattttagaggtagctgactaaggtattccccatgctgttcttccacactgagtcattgcaggcccctggagcctgaatcctttcacagaaactattagataggagaagtggaagaaatgtaacataacagtaaaagtaacaaaacaccagattttcaaaagttaaatttgaataatctatggattaatctatataaacacatatatatataatgcatatatctgtcttttaatcgataagactaacctcattgacttaaattgaagcaaaaacatatgtagtccatcttttgatattggtagggttactaaatgaattaccaatgtttgtagaatattcatgaatttcttagtagtcatttgagacattttaatgtgattcaagaaaaattaagacttaatgatatgccgctaatattaaatttttctgtttttctaggtgcatccaaatgaactaacaaatggtgtcataaatgcagcatttatgcttcttttcaaagatcttatcaaactttttgcttgctacaatgatggtgttattaacttactcggtaggtggaacaaccgaaacatgtctgggctgatgggatacacagtaagattgatgaattctgtggggtgagtctgttgtctcacttggtgggcaatattgtgtggaatatcatgatagtgagtaagtccacagatggtggtactggcagaacgatatgggcagagatggtaaatccatatctagggtaactgggtgctaatcatagtgtagacagattgctgctaaccacccctagtaaaaggaattaatcctcaacctgttacttggtggatggctggtgtccctggcctatcgtgttatgatgaaagctcagtgttgatccagggtgttggccaactgaggactcagcagtgatgataggcatataagccttggcgatgggaagcctatgctgtttagcctattcataacctccatttctgatatatacccacttcctatagagttctcttagccgccctctgattagaaagagcctttttgtgggatatgccctttggtttttattcaaatgggatgaatatagtctcatgctctctatccattatgagaggtccatccatcaccttttctccagaactccttgtcaccaatcctccagttttatttttttcaagtaccttatcatccaggccaacagttagttgctacacataatttggtgtagttcaatgtttcttaccatttttcctttaccataaagtggaaaattagatagatatattactggaaatttgactcactgtgaagatttctttctttgtcaaggccatccctttgtggggatattattcagcttttcacttccaggtggtgccaacatgaggaaccatctctaaaccaaatttgaatgttttcttcctcagtcagctggtgatagggaactcccccagagtccatgggtataatttgagggagaaatgggaaagaaaaagagtagatgcactgggaatatgaaccatctgttcatacaatctacctgcttattcacaacctgcttgaggcttatctcttatagactgcttcttttgataatggagtatgattgcacttgttcaactttattatttggtacattagataacacccactttaggtctgatgatcacttgatgttctttggtcaaaatttaagtctctaaaagtaaaaggtaggtaaaaataaaccaaggtaaactgaggtaaaagtaaaccaagagcattttttccaaaggagattagctaatgtgtgaagaagacatagccctactccaaagcactggaggcctgtattggagtgtaccagaggtactctacagcatttgaatctgctgtacacactttaagtacctttagatctgctgaaacagagccccacgtggcatcagtttggagaagttgcagagtcttcccttaatctgagcctgactcatatgtgacactataccagatgctttgcttagagcagcacatacacatgtcctctatgttgccaccaaagcagcttagcagacttctgcctctttttagttacaaagagtgcaaggtacaaaatttctcttttacacggcaaggatttctctgaaatgcacagtctttggggcccttagaaacttcattgaggtgactggtctctgaattttcatggattctcccatactttgacatgcatgtgacttatcaaggcagctaagataccgtcagttcttgcccactaaatacattcagccttatgtcatcaaaatgatatcctatgggagtatgacagccaaagaggttgatatccctgaaataagacagtgaggctttaatggcatctctgctagatgacagaaaactacttctgatggtttctgtttattgaggtagagataaatcattacctagttctgtagctgcctatgaggtaccaggagctacattgattttcttctggtaaatgaggatatatctggaaacctgcacattagcagttatcatctgattaagtttataatctactgttaacctctcaaatacatacatcttttcataaaacaaatatgcgagtatactgagaatgtgatggaatttctacccccgtatctttgcagaagtcagaaaaacagtgtggattctgctagttttgaagtatatctactcaaactatgcattcagaaaactgaggatataaccacagatagtcttgtgcattcactggatctaatttccttttgtaacttaatccccataaagcctccactcagatagctaaaacatatagtgacattttgggtccccaaggagtagaatgagcttagagtcagtgtccttgaaaagtctgggtaggtaaatctgacttccggtttccagttccacatggaaggagcttagaagtcaccaatatgtcctaaaaataagtacaaagctgaacagactgaaaaatcaacagctcttctgggatccacaagagaggggaggacatagggcaaacctctgcccccaagattggagagacagacaaatacaaggagtcatggattactggaacagagactcacgagtggaagctgccataggaactactgttgaagtaggaagatctgaactgtgattaatgaattgttggatgctcagtgtggccaagtctgagaattaaaaactccaagggaacccagtcatagagagcaccacacttttgttttacctccaggagctcaactaggctcctatagtaaatattagggaaaaatctccttgtgcttccaggacggggaggagaaaaggaaccattttgaaatatgccagagcactcttgtccttaagaaggagcaactacttaaccagagctttacctgatgtgctgagattttatcagagcctaactggactggggcaagagaaatacccaactccagcccactacatctattttgtccaagaggaaaaaccaagaagcatttgtgaagttcacagtccagaggcatagactcactaaaaagtgagacctaaacacaggactatggaacacttcccctctccgcaccttaacactacattaataaagacctatttacagcagttccttttacctggtacatcatgtacagctatcaagaaaaaattacaagtcatactaaatgacagaaaaacattcaaaaagacagagcaagcatcagaacccgacatggcagggatgaaggaatgatcagactggggatttaaagcaattatgattaataggctaagggctccaatggataaaataggcagcatgcaagaacagataggcaatgtaagcagagagatggaaatcctaaaaaagaactaaaaagaagtactagagggcaaaaccactttgggattattagcaaacaggacatggctgaggaaacaatctttaagcttacagatatatcaatagaaacctccaaaactacaaagcaaagagaacaaagactaaaaacaagacaaaaacggcagaacagaataagactgtgggacaacacaaacaactaaaaacaaaacaaacatcagaacagaataagactgtgggacagcaacaaaaggtgtcatatatgtataatggaataccagaaggaaaagagagaaagggacaaaatatttgaaataataacgacagagaattttcccaaattaatgtcagacatcaaaccacatatccaggaagctcagagaacaccaagtaggaaatgcccccgaaactaccttaaggcatataattttcaaactattgaaaatcaaagatgaataaataaatcatgaaaaagccagagggagaaaacaccttgtctgtggaggagcaaaaataagaattttgtatgacttcacttcacaaaccatgcaaacaagaagtgaatggagtgaaatgtttagtgctgagacaacccacttaacctagaattctttaccctgtgaaatagtcctttaaaagtgaaagagaagactttctcagtcaaacacaactggaaagaatttattgccagtagatctgcatttgcgaaaaatgctaaaagaagttttgtagggagaaggaaaattatatgggtcataaacttgggtttacataaagaaaggaagaatatcaaaagaagagtgagtgaaggtaaaataaaaacttttatttccctgattcttagttgatctgacagacaacagtttgttcaaaataatgatagcaataatatatgtttatgtatttataaagcatatacctatatgcttatatataggtgaaatgaatgacagcagtaatacaagggatagtagggaggaattcagatgttttgttgttatactcacactatcaatgaagcattatggtgttatttgaaagtggccttggattagttgtaaatgtacatagcaaactctatgggaaccactaaaaaagtaaaaaagaagtgtaattgatatgctaagaaaggagagaaaatggaatcttataaagtgctcatttaaaaccacaaagggtagaaaagagtggaagacaaaaataggaacaaagaacaaaggcaataaatagaaaatagtaacaaatatggtagatactaatccagctataccaaaaatcactttaacctcaatggtctaaatgcatcaattaagacagagattaccagagtagatctaaaaacaagacccaactatatgttgtctataggaaatctactttaaatataaagacacacataaattaagagtagagagatggagaaaaatacaccatgctaacactaatcaaaataaagcaagagtagttatattaatttccagacatggcagatgataaaggggtcaattttttcaaacagatgcaacagtccttaatgcatatgcacctaacagcagacaatcaacaaatatgtgtggcaaaaactgctagaactgcaaggagaaatagatgagtctactggtagatttggatcttcaacctcctctatcagtaatggacagattcaggaggcagaaaatcagtacagatgaagttgaactcaacaacaccatcaactagatataatggacatatatctatatagactacttgacctaaaaagagcagaatgcacattcttctcaagcttgcatagaacattcaccagtagagaccacaatctgaaccataaaacacatcttgacaaatttaaaataataggaatcatacaaccatctgctctcagaccacaatggaattaaactaaaaataataacaaaagtaactggaaaatctcagaataggtggagattaaacacacttctaaataacacatgggtcaaagaagaaagctcaagagaaatgtaagaatattttgaactaaatgatgctgaaaatacaccttatcaaaatgtataggatgcattgaaagcagtgcttatacggaaatttgtagtatcaaatgcatatactagaaaagaagaaagatctaaaatcagtcacctaagcttccaccttgggaaacaagaaaaagaaaattattcaaagtaaatggaagaaaataaataataagaattagagcgtaaatcaatgaaattgaaaacaggaaatcaatagaaaaaaatgatgaaaccaaaagctggttctttgaaaagatcaataaaatcaataagtctctagccagacaaagaaaaaaaagaggacacaaattactgataacagaaattaaagaggggagaccactacagatcttatggatgttaaaaagataagagaatattatgaacagctgtatgcccacaaatttgataatcaaatgaaatggaccaactccttgaaagatacagtctatctaaactcatacaagaagaaatagacaacctggataggcctctatctattaaagatacttagtcaataattaataacctttgaaaacaaaaaccatcaggcccacatgggtttactggtgaattctaccaagcatttaagtgagaaattataccaattctttacaatctcttccagaagatagaaatagagaagattcttcttaactccttttatgaggccagcattaccttaacctcaaaaccaaagacattacaagaaaaggaaagtggccaggcgcaatggctcatgcctgtaatcccagcactttgggatgccaagggggatggatcacttgaagtcaggggttcgagaccagcctggccaagatggtgaaaccccatctctactaaaaatacaaaaattagctgggtgtggtggtgggcacctgtaatcccagctactcaggaggctgaggcaagagaattgcttgaaccaggaggtggaggttgcagtgagctgagattgtgccactgcactccagcctgggcaacagagtgagactccatctcaaaaaaaattaatttgactattagattaccaagccaggctattaaatagctaatattctcagatctgcctgtatcttgtattatgtcctgaaccattcattcagtctcctagccttctgcttcaatattcataaaacaactgaggtaaattagctaatgtcttagatgtcttccaacattaatgtccgaagattttattaactattgcaattgcaaattgaaaatgcaaactacagaaagtacattattagaattaataccatgatttgaatttttcatttatgtatttttaataaccttttgctgtaggcttgacttaaaaaattcagtttgcttttgaaatataaccatgaataatattcatctggaaaagaaagtagaactcgtaatgccagctatggggtaaaaaaaaaaaatcttcaacaaattatagtagaacaactggatatccacatgggaaagaaatgaactttgaactttatctcaattagttgttcaaaatatacctacaaattctttgatactcatcccctaaaaaggtatgaattggctgggcgtggtggctcacgcctgtaatcccaacactttgggaggccaaggtgggcagatcacttgaggtcaggaattcaagaccagcctggccaacctggtgaaaccccatctctactaaaaataacgaaaaaaaaaaaaaagccaggcatggtggctcatgtctatagtcccagctactagggaggctaaggcaggagaatcacttgagctgggaggcagaggttgcagtgagccaagattatactgctgcactccagcctgggcaacaaagggagatttcacctcaaaaacaaacaaacaaacaaacaaaaaaggtatgaactaactcctatcaccttcaatgtgagatggacttagagacacttctaatgaatagaatgaagctgaagcaatggtgtgaagctttgacactaagttgtaagagacaccttgatttcttcctcactagttcttgcttagatcatttgctctagggaaagccagcagtaaagttgtgaggacactcagacagcctgtagagagttccatacaacaagaaactgagaccttctgtcaacaggtatgtgagtgagccaccctgcaagcagaacctttggccccagaccactgagggctacaggcatggccagcagtttgactataacttcatgaggtcctgagccagaatcatccagctaagccacttccaaattcatgacttataagctgtgtgagaccagaaatttatttgttgctttaactgctaaattttggagtaatttgttattcagtagtaaataatatgcctcacagcaggcctagaagtgaaatcaaaagaattattggcctaaatataaaagttaaaactaaaaagcttctagaagaaaacaaggactaggcaaagatttcttaattaaaatacagaaaacatgaactataaaagagaaagttaacaaattggacttcatcaaaattactcatgctcctcaaaagacatcattaagaatgaaaatacaagtcacagaggaggagaaagtatatgtatttatgttttagggatgcctatcaagaacaaataaaagaactcagtaatgaagacaactcgatttttataatgtacaaaagatttgaacagacactacaaaagaagatataaaatggctaataagcatataaaaattatcaatgtcatcagttactgaggaaatgtaaactaaaatcacagtgagatacctcttggacctactagactcaactaaaattaaaactactgatggtatcaagtattagtgaagatgtacagtaactggaactcctatacacatctgatagaaatgtaaaatggtaaaacgtcaaatgattttaccattttacatttactgttttccttaaaaagaaacatacacctaacttatgacccactaggatcatatcctggatgcttacccaagagaaataagaaccagtatccatacaaggactagcacatgaatgttcaaaaatgttcataatagaaaaaaaaaaccataaagaaactaaatattcattaataggtacatagataaacaaaagatgtattcatattatacaatgctattcaacaataaaaaggaattaactgttacatttatgtaataacataaatgaatttcaaaatcattaggttcaaagaagccaaagaaaagagagtgtgtaatgtatggctatttacataaaattttagaaaatgcaaactaacttacagtgacagaaaagagactagtggttacccatggttcagagtggaggaaggaatgaactgcaaagggacacaagaaattttttgagagtaataaaaatgttctgtactgctgtggttttaatgctccctccaaaactcatattggaatttaattggcattgtgatagtattaagaggtgaaacttttaagaggtgacttttgtcaggcatgcactctctcaccacgtgataccttctgacatgttatgatgcagcaagaaggcccttattagatacagccccttgatcttggacttccagccacaagaactgtgagccaaatacatctttctttacaagttatctggtgtgtggtattccatgatagcagcagaaaatggactgacatgtaccttgcttgtgacagtaattgatgttgcatataactgtcaagacacataaaatctacaccttaaatgaatgtaatatattatatataaataacatctcagtagattttatttaaaattaaaaaagaaaaggaaattacagaccaatatctctcatgaacatagttgaaaaatcctcgatgaaatattagcaaattaaatccaacaatgtataaaaagaattataaaccatgaccaaggggatttacccaggtatgcaaagctggttcaacatttgaaaatcaattaatgtaatctgccacatcaataagctaaaagagaaaaatcatatcagtagataaaagaaaaacatttgatgaaatccaacacccattcatgacaaaaattatcagtgaactaagaatagatggggaacttcatcaacttgatgaagaatatgtacaaaaaacttaatagctaacatcatatttaatggtgaaaaagctagaagctttcccagtaagatcaggaggaaggcaaagtgtctcctctcactactgcttttcaccatcctactggaagttctagctaatgcagtaagacaagaaacggagatgaaaggtatacagatttgggatggagcaataagacttctttgttcccagattatatgaccatctattgtagaaaatccaaaagaatcgacaaaaaaaaaaaactcctggaactaataagcaattatagcaaggttgcaagaaaaaatggttaatgtacaaaagtcagtggctttctgatatactagcaatgaacaagcagaatttgaaattaaaaacacaatgccattaacatcagcactccctaaaatgaaatacttaggtataaacttaacaaaatgtctctaagatctatatgaggaaaactataaaactcttatgaaagaaatcaaacaactaataaatggagagatgttccatgttcatggataagaaggttcaatactgtgaatatgtcagttctttccaacatgatctatagattcattgcaatagtattcagtatttcagcaagtaactgtggatattgacaaactgattctaatcaggtaaaagacccagaatagccaacacaatattgttgaagaagaacaaagttgaaggactgacctatcccactttaaaacctactgtaatactacagtaatcaagatattgtggtattggcaaaagaatagacaaatagatcagtggaacagaatagagagcccagaaatcaatccacattaatataacctgatctataataaaggagcaaagataatcttttgaacaaatggtgctggaacaactggacgtgcatacaccaaaaaaattaatctggacacagaccttataccctttacaaatattaactcaaaatggatcacagacctaaatgtaaaatgcaaaactataaacatcctggaaggtaacataggagaaaacctaaatgaccttggatatgatggtgactttttagatacaacatcagaggtgtgatccatggaagaaataattgaagagctggactttattaaaattaaaaacttctgctccatgaaagacagtgtcaagaaaaagagtaagatgtgccacacactggaagacaatatttgcaaaaaccacatctgataaaggactgttgtccaaaatatacaaagaactcttagaactaaaaaataataaaacaacccaattaaaaatgggctaaaaactttgatacctcaccaacaaagatatgcagatattattccgtgctaaaaggaaatgcaatatcaatccatgaaaaggcgtgaaggaatcttaaatgcatattactaagtgaaaccagtctgaaaaggcatgttttcagctctctgacattctacaaaaggcaaagctatgaagacagtaaaaaagatcattggtgtttagtggaggtcttattctgtctcccagactggagtgcagtggcacgaacacagctcactgcagccttgacctcctgggctcaagtgatcctcctgcctcagcctcccgagtagctgggattacagacacgcaccaccactcctggctaatttttgaattttttttttgtagacataggggcttgctatgttgcccaagctggtctcaaactcctgggttcaagcagtcttcccacctcagcctcccacagtactgggattataagcatgagccaccatacctggccagatttttaggacagtgaaaatactccgtatgatactaaaatggtggattcatgtcattatacatttgtccaaacccatagaatgtacaacaccaagagtgaacagtaatgtatgctatggacttggggtgataatgatgttcaatgtaggttcatcacttggaactaatatggcactcttttcagaggtgttgataataggggaggctgtgcgtgtttaggatcagggataatatgggaaatctctgtaacttctgtttaattttgttgtgaacctaaaactactctttaaaaaagtatttttctaaaaaaaaaaaagtcaggatatatccctttaccctgtgcatagtcactatggtaaaggtccatttgcagaagacaaggaaaaagtactttaagcagtgttcaaggactttcctcaagaatatctggagaacttgttaaagctcaggttgctgaacctgttacccagagtttctaattagtaagtctgaggtggggcttgagaatttgcgttcctaataagggccaaagtcatgctgttcctggtggtttggggactttagtttgggaatcattgtattagaaccactcccagatgctcagactagcattttgaatttacatattttggcgtattcacctaatttgataaattttgaggcaggtgtatttttcatttgtttacctgatagtgctaggagttaaccttatgaatatgttgtgggttaattttagtcaaggatttcgtgaccaatactttacacctaatgttggaatcaatattggtgctataaatcttcacaaatgctttattgctataatgaaactctgacttgtaagtaagctgtctccctgactaatggtcattagtaacagcttatgtagaaactctcagtttgtctctcagagatgataatttttttcatttggtttctttcctaggacaattatccttcaaaagttaatactagtatgacaagggtaatttatcacagctttacaaaggttcatgtcacaaacatgaaatttgatcatttcaaatattgaaagttaacatatgttacctttactgtgaaagaaaggtagaggctcatttttggatgaccaatcccctctttaaaagtgccagtttttttaggccctgcactggtctggacaggggagtctcattagctgtgcctgtgtcagtgaaatagaacatgttgcctttctgtgtcaatgctactattatagaaacaattatgagattatgacctaaatccacaatgatcgagtgctttttattgctgagtcctaaattatcatgaaggatacaaacaattttaaaagtatccagaggagacagaaaaaaaaattggttaaaattttggtcactggttctaaaaggaaattgagatattcagcttgatttttctttttgtattattgctgaagatcagatgcaaagatataaactcagattatactaaagagaagtaatttggatatttgaaagaagttttttatatgaagattgttgtagaaagagagaacaaaaagtatgttttgccagaataaatccttattttcaaatttcttaacaagaaaagactttcgtcttatagcaccgtgagtttatccattgcattagaaaacaggacagagtggataaagaaagtatccttagatttggtcattttttaaaagactgtcttttctctaaactcctagcaagtaggaaacagtatgtgtctgttttcttgatctttttgcttcccttaaataccctacaggggaggtccatgtaaaaagttaaaattacccaaagactgtcaacagaaggtaatgaagtgtaactgctcttgataattagttctttgtgtaattatatattactaaacttcccttaagaaaattaaaaatacttctgaggtagtaaaattacatgctgaatgaaataactctcaagtatgagacaatattaaaatagcatatgtaaccaaaacaacatggtaccggtatcaaaacagagatatagaccaatggaacagaacagagccctcagaaataataccacacatctacaactatctgatctttgacaaacctgacaaaaacaagaaatgggaaaaggattccctgtataacaaatggtgctaggaaaactggctagccatatgtagaaagctgaaactggaacccttccttacaccttatacaaaaattaattcaagatggattaaagacttaaatgttagacctaaaaccataaacaccctagaagaaaacctaggcaataccattcaggacataggcatgggcaaggacttcatgtgtaaaacaccaaaagcaatggcaacaaaagccaaaattgacaaatgggatctaattaaactaaagagcttctgcacagcaaaagaaactaccatcagagtgaataggcaacctacaaaatgggagaaaatttttgcaacctactcatctgacaaagggctaatatccagaatctacaaagaactcaaacaaatttacaagaaaaaaacaaaaacaccatcaaaaagtgggaaaaggatatgaacagacacttctcaaaagaagacgtttatgcagccaacagacacatgaaaaaatgctcatcatcactggccatcaaagaaatgcaaatcaaaaccacaatgagataccatcttacaccagttagaatggcgatcgttaaaaagtcaggaaacaacaggtgctggagaggatgtggagaaataggaacacttttacactgttgatgggactgtaaactagttcaaccattgtggaagacagtgtggcaattcctcagggatctagaactagaaataccatttgactcagccatcccattactgggtatatacccaaaggattataaatcatgctgctataaaagcacatgcacacgtatgtttatggtggcactgttcacagtagcaaagacttggaaccaacccaaatgtccaacaatgatagactggattaagaaaatgtggcacatatacactgtggaatactatgcagtgataaaaaatgatgagttcatgtcctttgtagggacatggatgaagctggaaaccatcattctcagcaaactattgcaacgacagaaaaccaaacactgcatgttctcactcataggtgggaatcgaacaatgagaacacttggacacaggaaggggaacatcacacaccagggcctgttgtggggtgaggggaggtgggagggatagcattaggagatatacctaatgtaaatgatgagttaatgggtgcagcacaccaacatggcacatgtatacatatgtaacaaacctgcacgttgtgcatatgcaccctagaacttaaaatataataaatatatatataaattaaaaaaagaatactgaaaaaatagcatattttaaaccatgtgcaaatataaaataatgaacttataaagaagatgctaggccatcaggtataaaccagagttgcctgggaactactgtaggcagacatggcctgctgtgtctccatctgcagtgtcaataattattgactgaatgatcaatgaataactgattaaaacactgatgaagtactggttttcttcaaagcatgtatggaaaaattatactctcatattgcaagggtaatggagctgtagttccctaatgacagcattctagtcttgagagtgtgaaagagaacagcaaaataagcttctgtttttctgtctagaaagctaaaggttgagaaagagagcataaatagactagaaagtcatgaagaatatagtaaaacaaattttttcacaaaagtctactgttttataaataaaagccacatcatgatgtttgaaagaaataatttatgaccaataaaagcaagtatcaacttagtgtagaaaacttaaagaattctttaattcaggaaggtttattgattattgtcttataatttatagattattagtttattgcgagctaataagaaaataaggattctgtagaatgcagtcataaattttgagattatccttaggaagaatttgctgctgttttccaagacaggatattggatatggaacatgaatttagccagttgtggcaattcatatattcttctactttagttctgttttcattatttaaattgttttatttgagacagatgattatcttggaacataacacttttcttaatctattcaggttccctttgtttaggtgccttaatacctcatataagttttactgccaagtgttttgattcaaacattaattaagttttgagtagtaatcttaacataagcttagaaaaaaatagaacataatactcttttcaaattgcttatctctttatcttctctagaaaagttttttgaaatgaagaaaggacaatgtaaagatgctctagaaatttacaaacgatttctaactagaatgacacgagtgtctgaatttctcaaggttgcagaggtaagtaatattaagttttcttgggaatataattttttaaatatttgctcatgtatctggagtatatataatagaaggtgtaagagagtcacagtatattagggttggaagtgcctcggagtcacagtatattaaggttggaagtgactttggaagtcgtgtcatccaacttctcactcagagctgtactctgtactcctgcatcctaatcagatgatcattctgcattcaaataaaagtttcatggataataagctcatttgctgctttgcaaggtggtccattcctccattccacctaatagctatctttaattgttagaaaatcctttattttcattgaaccttaggtttgcctttagaaaagcctgtttattattcttagcatgtaaatgataaatcataaattcttacctttcttactttggcaatgatttatacacaatgaaaaataagacagaaagcataatttgttttataaagtttataaattctttcttcagaatgtgtctttatacttgattagaatacctgtgtaactatgcagttggtgttcctgaaattatttgtgaattggtattttctcttataaaatccaattaatgattcatgctgatattggaaattataacattgttattatagtcctttggaagaatgacaagtgtatttttatcttacatgtcaattaactgattactaggaactgattggaatgttgtatgaaagaggttctaaggctcagcagcaaaccatacaatgctgtggatgtgggacattcatgccatgtttttgctgtttttgtcattttgagaatatactgcataaacaagcattttatacacacgatttaagaagtactctagtccatgcattgtgtttaaaatcttttattcatagaagtaataattgtcacatgaaaattctgggaccaaaataatatcacaaaatgctgattcttgaactttcacccatacaacatgtagttagaataaaaatcttttttaaatataagggaaacaaaagataaagattagcttatgtaaattgtatatacattaaagcacattcacgtttctttcctcatgggtttatcagtgttggtagtctttaagaaatgatagaattgcttaaaattttttcttttgctgctatacaggtgttttttgtatttggtatgattttgccatggtttaaccgtaattatcagcctaatctagtaaaatttgcctaatttctttctgtgaaaagataaattatgcctgagtacggagaacagattattttgtttcattaaatcttggtgtacattcatcccagtttctcatttgttattgtatgtaagtaaggagctggcatgtggcagtctggggtatacacttctctaatcagcattacaaggctgggctcatgattcccatgagaaaagttctacttatgtgtcaattccttctgttttaacatgtaaaattttactttttgtctgttgatacctcatgttagcacaagcccacctgaggccattaagaaagagatctgcaaaaatcagatatcattgtaagagtctgtctttaaataactggataataaatttaaaaattatttttatttgaacattatgattaagactttttcatagaatgaatactaatttacaaaattatttttaatagagtaaacattaaatcacaatgggacaaccataaccatttgtgttttctttcacatttaaatcacattgttcataatttggacacacaatgtttgaataccagtgttgagtggttttgttatgattggttaatatagaaatttttcaaccaatgtacaaatctctctctactgtatagtactcatgtggtcgatgtatggattcatactcaatagctatcccatagttagtaacatttacctgaagagtctcaggaagacttctagaatatgattttcaaaatacaactttatatattggttatttgggaaatagtaacagtaagttgctcattgtattaaagaaaaggtaaagtagttgaacaagttctatggaactattcaaatttcttaaattgcttgaagtacagaaaacttactatgccttatattcttatctgaagtctcctatggcagacaagtaaaacttggtaaaataatttttactggtaagatatatttctgctaaatactcttctctttcatagaaccaagttattcttagttttctattctaaggtagatatcggaatcgtaggagctacatctcccagaatatttgcagacagaaagtgatgagatttctgtaacacactttaatcctctaatgatattgtggttcagaagttcagagcaataaaaatagcaatgttgaggaagaattcctaaattgtctctttgaacacaattatccatttaatggaaatacatcaccttttcctgaactgatttcagtattagggatccataatatttttattttaaaaaatgcctctttcagtgccttcttatcacagtaggcagcgagtcagtctcataaaaatgcctcttttgttcatattaatatttttaaatggatcatctaaagtggtgttaaaacatacaaataaacaatgcagttgctttaactgataatttccctaatttgtaataatataagtggctttagggaagcatcagtggctaaactgttcctaaagccaaagttcagtcattagaaggataattccagagagggaaggaagacagccaactagacaaagctagcaaatgcctctcccaccaagaggaaccaaaatatcgagtgaatcatcatgctgatgatcaacagatcttttgagagaaaatactgaaaatcaatagagaggcaacacagttgccttcaacatagttgaagagggaggaagccgggaaacctgctcggagccaccacatgccagctgcagtaaaacatgaccataggtgcccatcccccaaggcgctccatcttgctctgcagttcctgttctctactggccaggaccattgctgcaggaccaggatgaatgccccctcacctgctggcccctcccaagatttcctgcctggccactcccacaggaggatatccacagcgcagcccccgcgcttccctacctgagtgttttgctggtggcctggaagcagtctggcacccccagcacagccagtgcttaaccccgaggggccagaagacaaatctgcaggcctggtttcaactccctgggactcaagcacactgcccacgagtatcgtgctgagatctatggcctgagctcaagtggaggaagagctcccagtgtcagaacaaaaagaagattgtgacttaggttcttatgctggtgcaggttcttgtacaaatgtaggagctgggtgtccctcccttcacaagacccatctgagaagggtgccgcctgaaagccacatcttctttcccagggagccctgcagcccacatcatctggaacagctcagtgatctgagagcagaaggcttggaacaagtctagccagtcaaaatgctcctggggcagacactggaggaagacctgttgggtcagaggagcacaagctgagtgggccccacagctgtctgccaggctggaaaccctgggccacaggcacttttccacttgcgtatacatgataccattgccctgcccagggattcttcaccccaacccactgcaacaccagaccgctagtagtcatatcccacaacctgctctgactctcacaagcacagtgggccccccaagagttagagatctcctgatgatctctcagctgggaccatccctaaagggagagggtagcacagcctgccaaagcccccttttgagcaaagaaaacatgggtgcagcaccagtacttgaaggggacagcaccaaggcccaaggcctggaaacaaacttggactgagacttatctcttggcccctgcctcccctccccagagcactgccacatacgcactgaaaaataagaggtgtctggctgagtaagagtatatctgctggccctgatgtcactgtgaagagctgtctacgagactgcaacctgaatggcaccaccaaacaaaaatacattgtttcaccgtgcaacacctctgaaatgcaccacaggagcccatctataacctcagaacctagaacagagccttgaccctctgaaagcgctcagaaacgaaaccgatcaactatatacaacattcaccacagtcaacccttacgggaaaaaagaatgtaaaaacaaaaagccctatccaaatgaaagcaaattgacaaagaaaaagaaaagccagctccctcagacgagaaggaatcagctcaagaacttaggcaatgcaaaaagtcagaatgttttgtttacctctaaaggatggcattagctccctagcaatgaatcctaaccacattgaaatgtctgaaattatagacacagaattcagaatctggatggcaaggaagctcaataagatccaagagaaatttgaaatccaatacaaggaagccaggaaaatgatccaagatatgaaagatgagatagctatatttaaaaagaactaaactgaacttctacaattgaaaagttcactacaggaatttgaaaatgtagttggaagccttaatgacagactagatcacacagaggagagaatttcagagcttgaagacgagtcctttgaatcaacccagacagacaaaaataaagaaaaaaggaattttacaaaatgaacaaaacctccaagaaatatggtgttaagtaaagcaaccaaacctacaattcattggcatttctgagagagaagagagagtgagcaacttggagaacatatttgaggatataatccacaaaaatttacccagtcttgctggagagattgacatgtgaatacaagaaattcagagaacccctacaagatactatacaagatgaccatcccaaggcacagagtcatcaagctttccaagatcaacacaagaaaaaatcttaatggcagctagagaaaaggaacaaatcacctataaaaggaacctcatcaggctaacgacagacttctcaaaagaaactttacaagctagagatttgtagcctatttttagtattcttaaagagaagaatttccaactaagaatttcataacctaccaaactaagcttcataagtgaaagtgaaataaaatctttcccagacaagcaattgctaagggaatgtgttaccaatcaactggccttaaaagacgtgcttaagggagttctaaacttggaaacaaaagaaacctgctaccacagaaacacatataagtacatagtccataattcctacaaagcaacttcacagctgagactataaagcaaccaactaacaatatgatgacaggaatgaaacctcacatatgaatactaaccttgatgtaaatggtacaaacacctgactgaaaagacacagagtggcaagttggattaaaaaaaaagatgtactgtcttcagtacatccatctcatgtaatgacacgcatagcctcaaagtaaagggatgaaaaaagatccaccatcccaatagaaaacaaaaaaggacagaggttgttgctcttgtatcagataaaataaactgaaaaccaacaacagtaaaaaaagaaaaagtacaaagaaggacattacataatgataaatggttcaattcaacaagaagacttaattttcagccagagatgagagattaggggggaaaaagacttaactatcctaaatatatacacacccaacattggagcacctagatttataagagaagtacttcttgacctaataaaagacagacagccacacaacaataatgagggagttcatcaccccactgaaagcattagacagatcattgaggcagaaaactaacaaagaaattatgaacttaaatttgacactagaccaattggacctaatagacatctacagactactccacccaacaaccgcagaatgtatgttcttgtcacctctacagggtacatactctaagatccaccacatgctcagccataaagcaaatctcaataaatcaaaaaaatcaaatcataacaagtatattcttagaccacagtagaataaaaatagaaatcaataccaagaggaactctgaaaaccacacaattacatggaaactgaacaacttgttcctgaatgactattgggtaaacaacaaaattaaggcagaaatcaaaacattctttgaaacaaatgaaaacagacacaacataccaaaatatctgggaggcagcaaaggcagttttaagaggaaagtttatagcactaaacacctacatcaagaagttagaaagatctcaaattaataacctaacatcacacataaaggaactagaaaaacaagaacaaactaatcccaaagctagcagaagaaaacaaatagccaaagtcagagcagaactaaatgtaatcaacgagaagtggggatcgtggtgactgggaggcaggactagattgcagctccaacttgaaccaacagagcagcatatggaggctcgcattgtgaatttttgctccagaatgactgcaggaataaatcaggaaacctgagatgacccacagactccctgaagaaagcagattgctcctaccagacccagaagacaccccaaatactatgagtgcccaaactgtggaggcaggaaagggagatcctctgcccctgaacacacaccccgcactggggaaaccgtaggcctagataacaggagaagattttgaccttacctggaactgagtcaatttagagagccaagcaaaatacagggatagaagaagcagtgaaaaaaatccctgtgggcttactgggtcccctagcaagccgtttttgcctggccttacaggggtccttcaggacggtggccagaggcactgggaaaaggccacagggagaaagaaatctccagctgaactttgtaacaatttttttttaattttattattattatactataagttttagggtacatgtgcacaacgtgcaggtttgttacatatgtatacatgtgccatgttggtgtgctgcacccattaactcgtcatttagcattaggtatatctcctagtggtatccctccgccctccccccacccacaacagttcccagtgtgtgatgttccccttcctgtgtccatgctgattgagaagcctcttggccagaactcgggggagggtgtgaatctgtgtgcagacaccacaggcaggggaagaagaaaagctgtatttgccttcgcagctgggagttgggtagcctggggcagattctgagatgtgcttgcccactgcctggaaacacattcagtgctgttgctggggggcacagtgggaatgagactggtcctttggattgcatgggagctgagtgaggcctgtgactgtcggctttcccccacttccctgacaacctgcatgacacagtagagacagtcataatcctcctaggaacataactccattgacctgggaacctcacccccaacccccacagcagccgcagcaagacccgcccaaggaaagtctgaactcaaacatgcctagccctgcccttgcccagtggtccttccctacctaccctggtaactgaagacaaggggcatatactcttgggagttctagggccctgcctcccacctcttcctccccatactaccacagctgacactgtctagaaagtgccacctcctggcaggaggccaaccagcacaaaaatagcgccttaaaccaccaaagctaaaaaccctcacagagttcatttctgccacctctaccagaacaggtgctggtatacatggctgagagacccacagacagttcacatcacaggactctgtgagacaaccccccagtaccagcctggagcctgatagacttgctgggtggctagatccagaagagagataacaatcactacagcttggctcacaggaagccacatccataggaaaagggggagagtactacatcaagggaagaccccatgggacaaaagaatctgaacaacagccttcagccctagactttctgtctgacagagcctacccaaatgagaaggaaccagaaaaccaactctgataatatgacaaaataaggttctttaaatcctccaaaaaaatcacactagctcaccagcaatggacccaaaccaacaaatccctgatttacctgataaagaattcaggaggttagttattaagctaattagggaggcaccagagaaaggcgaagcccagtataaggaaatccaaaaaatgatacaagaagtgaagggagaaatattcaaggaactagatagcataaataaaaacaatcaaaacttcaggaaacaatggacacacttatagaaatgcaaaatgctctggaaagtctcagcaatagaattgaacatgtagaagaaagaaacccatagctcaaagacaaggtcttcaaattaacccaatctagcaaagaaaaaagaataagaaaatacgaacaaagcctccaggaagtctgggattttgtttaacaaccaaacctaagaataattggtgttcctgaggaacaagagaattctaaaactttggaaaatatatttgggggaataattgaggaaaatttccccagccttgctagagacctagacgtacaaatacaagaagcacaaagaacatcagggaaattcatcacaaaaagaacattacctagacacattgtcatcaggttgtctaatgttaggatgaaggaaagaatcttaagagctgtgagacagaagcatcaggtaacctataaaggaaaacgtttatagttatacctttaaaggtataactatacctttaaattatacattagcagcagatttctcagcagaaaccctacaagctagaagggattgaggccctatcttcagcctcctcaaataaaacaattatcagccaagaattttgtatccagtgaaactaagcttcatatataaaggaaagatacagtctttttcagacaaatgaatgctgagagaattcaccactaccaagccaccactacaagaactgctaaaaggagctctaaatcttgaaacaaattctggaaacacatcaaaagagaacctctgtaaagcataaatctcataggacctataaaaaatatataattttaaaaacaaaaacaaaaaaccaaggtatacaggcaacaaatagcacaatgaatggaatggtacctcacatctcaatactaacattgaatgtaaatggcctaaatgccccacttaaaagatacagaattgcagaatggataagaattcaccagccaactacctgctgccttcgagagactcacctaacacataaagactcacacaaacttaaggtaaaggggtggaaaaagacatttcagaaaaatgggcacaaaaagtgagcaggaagagctattcttatatcagacaatacaaactttaacagcagttaaaaaagacaaaaaaaggacattatataatgataaaagtctcgtccaacaggaaaatattacaatcctaaacatatatgtacctaacactggagctcccaagtttgtaaaaacgattactaatagacctaagaaatgagatagcaacacaataatagtgggggacttcaatactccactgacagcactagacaggtcatcaagacagaaagtcaacaaagaaacaatgaatttaaacagtaccctggaacaaatggacttaacagatgtatatagaacattccatccatcaaccacagaatatacattcttttcaatagcacatggaactttcttcaagatagaccatatgagaggccacaaaatgaccctcaataaatttaagaaaattgaaattatatgaagcactctctcagaccacagtggaataaaactggaaatcaactccaaaaggaacctccaaaaccatgcaaatacatggaaattaaataacctgcccctgaatgagcattgggtcaaaaacgaaatcaaaatgaaaatcaaaaaattcttcgaactgaatgacagtagtgacacaacctatcaaaacctctgggacacagtaaaggcagtggtaagaggaaaggtcatagccctaaatgcctacatcaaaaaatttgaaagaacacaaacagacagtctaaggtcacacctcaaggatcaagagaaacaagaatgaaccaaacccaaaccccgcagaagaaaggaaataaccaagatccagagcaaaactaaatgaagttgaaacaaaaaacaatacagaagataaatgaaacaaaaagctgttttttttttttaagataaaattgatagaccattagcaagactaaccaagaaaggaagagagaaaatccaaataagctcagtaagaaatgaaatgggagacagtacaactgacaccacagaaatacaaaaaatcattcaaggctactatgaacacctttacacacataaactagaaaacctagaagagttggattaatttctggaaagatacaatcctcctagcttaaatcaggaagaattagataccctgaacagacaagcagtgagattgaaatggtaatttttaaattaccaacaaaaaaatgcccaggactagacagattcacagcagaattctaccagacattgaaagaagagttggtatcaatcctattgacactattccgcaagatagagaaagaggaaaccctccctaaatcattctgttagcccagtatcaccctaatacccaaaccagaaaaggacataaccaaaaaagaaaactacagaccaatatttctgattaacatagatgctaaaatccttaacaaaatactggctaactaatccaacaacatatcaaaaagataatccaccatgatcaagggtttcataccagggatgcagggaaggtttaacatatgcaagtcaataaatgtgatacaccacataatcagaattaaaaataaaaatcacgtgatcatctcaatagatgcagaaaaagcatttgacaaattccagcatccgtttatgattaaaacgcttagcaaaactggcatacaagggacgtacatcaatataataaaagccatctatgacaaacccacaaccagcataatactgaatggggaaaagttgatagcatttcctctgagaactggaacaagacaagaatgcctactctcaccactcctcttcaacatagtaccggaagtcctagccagagcaatcaaacaagagtacgaaatggcatccaaattggtaaagaggaggtcaagctgttgctgcttgctgatgatatgattgcttacctaaaaaaccctaaagactcctccagaaagctcttagacctgataaaagagtgcaacaaattttctggatacaaaattaatgtgcacaaatcagtagctcttcgatacaccaacattgaccaagcagagaatcaaatcaagatctcaaccccttttacaataactgcaaaaaaataaaatacttaggaatataccgaaccgaggaggtgaaagacctctacaaggaaaactacaaaacaccgctgaaagaaatcatagacaacacaaatgaaaacacatcctgtgttcatggatgggtagaatccgtattgagaaaatgaccatactgccaaaagcaatctacacattcaatgcaattcccatcaaaattcactattcttcacagaattagaaaaaaacaattctaaaattcatgtggaaccaaaaaagagcccacatagccaaagcaagactaagcaaaaagaacaaatctggaggcatcacattacctgatttcaagctacactataaggccatagtcactaaaacaacatggtacttgtgtaaaaataggcacatagaccaatggaacagaacagataacccagaagtaaacccaaatacttacagcttactgatcttcaacaaagccaacaaaaacaaagtgggggaaggacaaccttttcaataaatggtgctgggataattgactagctacatgtaggagaataaaactggatcctcacctctcaccttattcaaaaatcaactcaagatggattaaggacttaaatctaagatctgaaactgtaaaaattctagaagataacattggaaaaacccttctagacattggcgtaggcaaggatttcatgaccaggaacctaaaagcaaacgcaataaaaacaaagataaatttctgggacttaattaaactaaagaatttttgcaaggcaaaaaggaatagtcagcagagtaaacagacaacccacagaatgggaaagaatcttcacaatctatacatctgataaaggactaatatccagaatctacaatgaactcaaatcagcaagaaaaaaaaatcccatcaaaaagtgggctaaggacataaatagacagttctcaaaagaagatacacaaatggccaacagacataagaaaaaatgcttaacatcactaacgatcagggaaatgcaaatcaaaactgcaatgcgataccaccttactcctgcaagaatggccataatcaaaaaattaaaaaataaaaaaaaaaacagtagatgttggcatggatgtggtgatcagggaacacttctacactgctggtgggaatgtaaactagtacagccactatggaaaacaatgtggagattccttaaagaactaaaagtagaactaccatttgatccagcaatcccactagtgggtatctacccaggggaaaagaagtcatacttgcacacacatgtttatagcagcacaattcacaattgcaaaatcgtggaaccaaccaaaatgcctacctatcaatgaatggataaataaactgtgatatatatatatatatatatatatgtaaaatggaatattacttagctataaaaaggaatgagttagtggcatttgcagtgacctggattagattggagactgttattctaagtgaagtaactcaggaatggaaaaccaaacattatatgttctcacttataagtgggagctaagctatgaggatgcaaaggcataagaatgacacaatgggctttgaggaaatcagggggaaagggtgggaagagggtgagggataaagactccaaatacaggtgcagtgtacactactatggtgatgggtgctccagaatctcacagatcactactaaaggacttactcatgtaaccaaacgccacctcacctgttccccaataacctatggaaattaaataaataaataaatgaaattgacacccccaaaacatacaaagaatcaatgaaataaaaattggttcttcgaaaggataaacaagattgatcgaccactagctagattaacaatgaaaaaaagagaagatccaaataaatacaatcagacagacaaaggtgacattacaattgatcccacaaaaatagaaaaaatcctctagactactacgaaaacctctatgaacacaaagtagaaatctagaggaaatggataaatttctggaaacacacaacctttcaatattggaccaggaagaagttgaaactccgttattggtctttcaagttctgcaactgacttcagtagtaaaaaaacctactaagaaataaaagccttggaccaaatagattcacagctaaattctatcagatgtaaaaagaagaactggaagcaattctactgaaactatttcaatgaattgagaaggagggatccctccctaactcattctgtgaaaccagtgtcatcctgatactaaaatctggcaaaggcacaacaaaaaaaagaaaactacaagccaatatccctgacaaacatagatgcagaaatcctcaacaaaataatagcaaatcaaatctagcagcacatcaaaaagttaattcaccacaatcaagtgggctttattcctaggatgcaaggttggttcaacatatgcaaaacaataaatgtaattcaccacataaacagaattaaaaaccatgtaattatctcaatagatgcagcaaaagctttctgtaaaatccaacctcccttcatgatacaaaccctcaacaaattaggcattgaaggaacgtacttcaaaataataagaaccgtctatgacaaacccacagccaacatcacactgaatgagcaaaaggtggaagcattccctttaagaactagaacaagaaaatgatgcccactttcaccactactattcagcataatactggaagtcctacagagcagtcaggatagagaaagaaaaggaatccaaataggaaaagaggaagtcaaactatctctctttgctaaggatatgattctacacctagaaaatcctcaagattccatcaaaaaactcctagacctgataaacaacttcagtaaagtttcaggacaaaatctacctacaaacatcaaaatcaatagcatctctatgcactaataacttccaatctgagaaccagatgaagaatgcaatcccatttacaatagccacaaaaaattgaaaacctaggagtacctctaaccaaggagataaaagatctctacaaggaggactacaaaacaccaatggaagaagtcagagatgacacaaacaaatggaaaaacatttcatgctcatggattggaagaataaatattgttaaaatggctctactgcccaaagcaatccgtagattcaatgctatgtctatcaaattatcaacatcattttccacagaactagaagaaattattctaaatttatatgaagccaaaaaagaggtggaatagccaaagcaatcttaagcaaaaagaacgaagccagaagcatcacattaccagacttcaaactatactacaagggtgcagtaaccaaaacagcatgatactgttacaaaaacagacacatagaacagtggaacagaatagagaacccagaaataaagcagcgtacctacaaaccactgatctttgataagttggcaaaaataagcataacaaggggaaaggactccttattcaaaaatggtgctgggaaaactggctagccatatgcaaaagaatgagactggatcccccacctaacaccacatataaaaatttactaaagatggataaaagacctcaaactataaaaatgctagaaggaaacttagaaaatgcccttctggatgttggccttggcaaagaatttatgaccaagtcctcaaaagcaattgcaacaaaaattaaaattgacaactaagacttatttaaagagctgcacagcaaaagaaactattaacagagtaaacagacaacctacagaatgagagaaaatattcttcacctttgtttctgaccagtgactaatgtccagaatctataaggaacttaaataaatcaccaagaaaaacaaccccattaaaaagtgggccaaggacatgaacagacacttctcaaaagaagacatttaaatggccaacaaacatgaaaaaatgcttagcatcactaatcatcagagaaatgcgaatcaaaaccacagtgagatactatcttacacccagtcagaatagatattattaaaaggccgaaaaacaacatgttggcaaggctgcagagaaaagggaactcatatatactgttggtgggaatgtagttcagccactgtggaaagcagtttggagatttctcaaagaactaacaatagaacttctgtttgactgagtagtcccattactgagtgtatacccaaagggaaataaattgttctaccaaaaagacacaggcactcatatgttcattgcagcactattcaaatagcaaagacatggaatcaacctaggtgcccatcagtggtggaccagttaaagaaaatgtggtacatatgcaccatggaatactatgcagccataaaaaagaatgaaatcatgcccttagcagcaacatgaatgtagctgggggccattatcgtaagtgaactaatgcagaaacagaaaaccaaataccacatgttctcacttattagtgagagctaaatcttgggtacacacatgcagatgagaacagtagacactggggcctccaaaagcaggtacaaagggaggaagtcaaggtctgaaaaccttcctgttaggtactgtgttcactatctgggtaacagcattagtagaagcccaaacctcagcatcatacaatgtacccttgtaacaaatctgcacttgtacccctgaatctgaaataaaaatggaaaatttttaaaaagaaataataatatttggtagttgcagaaaaagtaaagtctggaattctggattcaaacattatttgatccagagagattaaggcaagtgctctacgtcagtggtctcaacagcaagtgactttgcttccctcccctcctcaaaggatagcatttagagatgtttttttgttatcacactggagagggtgtctactagcatcctgtgggtagaggccagggatgctgctaaacatcctacagtgcacaagacaccccccaacaagaattatcttccccaaatgccaatagtgccaagactgagaaaccctgctctagacacagagaagaaagaggaaagaaggtagttcagcatttgacacacaaatggattttctgatctccagtttgctttattgtctttgtagcagcccagcacttttgcttcatgtgtttacttctacatttccatcagtataatcaaagctcttcatttctcaaggagatacactttggcttaacccactttgtttctttgaacctcaatttcattatttatataaaaatgatacgattgaacttgtgatttgtgtttttccccaacttttcactttgaataattttcaaacctacaaaagaatttatgtataatgaataaatatggtctcttcattgatttacctttattaatattttttcatatttgcttttcctcccttctctctttctctgcccctatccccatgctaacaaaattaacaatatgcatatacttttatctggtaattccacttctacaagtatatcatacagatatatacattacacatgcaaaatggtgtgtgcagcactgtttgcaatggcaagagatcaaaagcaactttagtgtccattaataagttactaattaaatataggacaaggaagttctatgcagctgtttattaaatgaggatattctgtgtgttgatatggatatatgtctaagatatattttttagtgaaacataagttcattatatataatatgttattatttgtgttgtaatggggaaataagtatatatttgtataatttcatatttccttgaatatacataaagaaactctgaaaggatacataagaaactaacaaagttaggtctgtgggagaaagagtggaaattataccctgaatgagttttagaactaaatgagcattccctatccagaagctgggcataattaactactaaatttagtctaagcagtgttttacattttgagcttctgttaactaaggataccattacattttatgcttcaatttgttgtcatttgtttttggattctagtagaattctatacatttgttatgtctaactatattaatgaaattactgctctattatattgagtgaaaaactgcataaaaagcatatgttccaagtgagagtgatacataaaataattcatttacaccaatattgagctgtttaaactaattgtgtaggtgatcttccattaaatgaaaaaaattaattttaaaagttctactaatttctaattttttaaatccacagcaagttggtattgataaaggtgacattcctgacctcacacaggtaagcaactctcccagtggaagattcagtatgcatgagattattacaacatatattgccacaaatgggcatagtcttgtaagcatttcatgcattttgaacttaggccaaccaactttcttggaaattattctaccttatttattgtttctagccattgaatatatttctggaggtaataggaagattttcttgttcttatgatatagtttcttctttaaacgcaactgaatttagtaaatgaactcatcttttcattttaaacttgatcaaaaggaaaccttgaataatgttaatagaaatgctttggctatgaaaagtcactatttctaggcctgataatcagaatattagaacttttcctcctgcttgtcttcctagtttccaacatgtcccagatatgaaggagacccatgaatagggaaaactctgatgtcacagttgaactacttgtctcccctatgaaatggagaaatgtccatgtataaaataagctaataaaatagtagtggtagatgagcaatttttctggagcccatctagtaaatgacaacaatagaggggcttctgtatcaatcattttatctgtgaagagggtactgtgtatggatcctaatatatagattcaaggtcattcatgggtatagtataacctttctcataattggcaggaactgtttttacttaagcactctgttatggtacagttatatcccaaacatgttatttaactagcaatgatgttattgtagagatgataggagaaaacacagagctgctatcttatttaccagtaatgaatatatgaactttctgtccttgtaaatatagtcattataatagaaaaaattgtcataatgaaagatacctacttgttaataatatcaaagtgcatttagtaatttgctgtccttattatgccttgaaatgtttccatctttaaaataatattaatccttaagtttttattaaaaattagggaaactcaaagaaatgttatttgtattattaaaatgccaattaaatatcaagaattctttatgaataaaattcacagagcaatccagaacatgatggcattgtattttttagtgaaaagttgagaagcagttctttttcatagacagaatattggtataaaatatttctgctactatgagaaaacagtgttttttgacgaggcacatacctgaataagatattggtatcattttggatatggccaaaaaattaagtgtgcataaagtgccactaaaaatctctttattagatatagatttatctttgtaacactataattaaaagcaaagaaaataagtgtgttttcatttaaactaatcatttttagtaaaatttatagtacattttaaaaaataatccacataagtaatacatgttaacttttaagacattaaaatatttagctctgatatttagaagctaatgaatagcttctagaagtggcaaatcatctttatttcacatctatggacacccttactgtagaataaaagagaaagtaggctctcagttaagaatataggtcctcatctatcatacttagtttgggcagtctgaaaggaaacaaggaaatattcaaatgactacttaaatctgtttttgcttttaacattagacaatgagagcatgtcattgaaagtacatcattgaaatcatatacttggattaaatttttaatgatactattatagtcattataatatttataatctccccctcaagaagcccagaaacattatattttactgaatgatttaagatgtgtgttttcataatttagggaacagagactcctccctcaaagaaagtaaaatcttgccctgggtctgttagaaagctattctatggtagaaattcattagaatctattagcactctattctcttcttttgttatgaccttaagcgccacataaatttcaatattaacatttatttttatgtgatacatatacaccatgggatactatacaaccattaaaaagaaaagatcatgtactttgcagagacatggatggagcttgaggccaatatcccaagtaaactgatgcagaaacagaaaaccaaatactgcatgttctcacttataagtgggagctaaacattgagtatatatgacacacagaagtgaacaacaaacaccgaggcctactggagggtagaaggtggtacccctgtgacatgcaatttacctatatgacaaacctgcgccaagtatccccaaccctaaaagattttttaaatggggaaaaatatttatttttaaattacctgttcaggctgggcgcggtggctcacgcctgtaatcccagcactttgggaggctgaggcaggcgaatcatgagttcaggagatcgagaccacggtgaaaccccgtctcaactaaaaaaaaatacaaaaaattagccgggcgcggtggtgggtgcctgtagtcccggctacttgggaggctgaggcaggagaatggcgtgaacccgggaggtggagcttacagtgagccgagatcgcgccactgtactccagcctgggcgacagagcgagactcagactcaaaaacaaacagaaaaaaaaaaaacctgttcatagaaaaattcctctagttcaatacaagaatatgatatgcttctgaaatttcttaatactgtggtttcttttggggttgtgagtgacatagagctaaacacccttcttcattcctgtgtagagcccctcggcaggtctaatggaagtctctaattgacctgaggatttagacctctgacagttatgatcaggtctgggctagcatgtgaattgttctggggttagtcctttagagagctgtttcatctttaaaaccaggattaatctgcagatgggtccgaagtaccaggttatatggattcggttctactcttctaagattagattctgctttctaccaggcttgtctgcggccaccatggccattcaatctagccaggtaatgaacaaaaatacctgtcagaagagagtgttaaagaagagatggagatcagaagggcttcctactgggagtaggaatagaatgctcataacttaaaaaatgattagaattcctctttcagcaaaatggaatggaggaatttcatagatatctttatgaatttaatggatatcttttaggttagagactgtacattaaacatgaatgcaatcatctgtaaccctttttaacttgtacacataatatcataattattacatttaaattattcaccaatatcaatgaaatttttaaggacattcaaaaataactgttttgggtaagaactgaatatatcagaactgaaatatttctcctcagcactttcaaattgtttcttagatctaatgataagaatttgaatgatcttatgattgctttttttaaatttggttttaatgatgctttataagctatagcatctaaatcgtagatggatgctttcttttggagcctgggctcacaatcagctatgaatttgttccgagaaaagaattttttaatattatttcctgtttgtggcatgtgtacattccaaatgtaaatatcttcatttatgaaaaaaatcttatgtttttgatgtcaggaattctggttgatacgaaaactactggtaaagaagggtctccttttaaagaccatacaactgatgaatcggtaaccatatgttgctgttatcagctttcacaggctgactcttgttctttggattggtgttcccatctgattggtctattgactttgacatttttaaaaacaagcaactaaagagcctgctcattatattttgttatattaaattccttttacaacagcagaggcattctcaaagtttttgctccttggaaatttaagaggtggttttcatttattgtctactgcatgcccggatgtcctcactgccatagatgcagttgagaaaaggtagacattcctgcacgcctggatattactatcaaagtactttttttcctccaaagacatttgaggaatttatttctgtttgattttacatgtttttataagaaatataaatgatgaagcactttcaaacttctaggatggaatgctccaaactttatttccctttaagacaaaagtcagtttgatagtcttgtattccttgatcaaatttctctttcagctattgtgattttttttttgtgacttctacttattttttcaattttctcacttagaaagaaactttacaaaacgaataaaatggggacctctcttcctgggttttttgttttgtttttttgttttgttttgttttgttttaggtaactaagaaacttaataggagaaaatattacctatttttggttatcccgtatttgttgctattttgtgactaaaaatagcatttttcttagaccatgttttaaacttaggtttagccaaaaaaatcaccctttctttacattacattaacattcaaagtatcttaagttttctaactggaaagaagttctatggcttattttttttccttactgcgatcccaatgaaaaaatataaatatgaaaagtttatatgcccagacctcctaaattccatcatcgtcatcatcattatcatcatcactggcaattagtatgacaattttgaagttatcagatgtgaattcatctaaaaattttgaagccatttatttttttatttttaatgttactatgtacattctttattcaatgagcatttctttatagtttataatctggtatctataacaaaattttctgtatctcttaaaattcattttttaaacttagaaatattgtcttagttgtgttttattagaatttattaagtccattttcatctgagttgtattttaaaatcctaatttttgtaattttctaaacttattagatgccgataatcttttttttttaactctatagttcaaagcttttaaaataatgccgacagggctgttcctttctatcttaccttcatcattttgatcaaattaatattttggttcacttagtaatttttatatatctaaatttacatgttttagttcacttggtaatttacacttataataatcacataattacaaatataataatcacatgaatgttaagacagttttaagagtctattagtgaaatgaaaaatgaatattaaataaatgtcctgaattttcaaaattaaagatttttagtaagaatttcattctgtcattaaaggtacagtgtaaaagatacagttatatgaatgtctgtgaattctgtgagttcctttatcagttaccatagttacttcaatgtccttcaaaattaatttcacattaatttaaagaagaattgtcagaattaaatatacctataagggtagttatatatttcatttaagaaatgctattctttgaatgcctatgctgctgttaaggtctaatttgtattacaactatttgagaaagatgaaatgaaatctctaatgcttaaggaatagattgggtgaaaaatttgcgtgaacctattatttctccttaagtatacagtgaaatgtcatcactttatattgcctaaaatattatttataaaaggaaacattcaagtatttcttaataagagttgaaacttattaaatttgccaatacacagtgctctgatattatatttgctaaaagttactttattatacatataaatatatttttatatataaataggtcaataataaaatcttaattgttattgattattagaattatattcttttccccacaactctcactcaccacctttttaaaatatatttaaatggtttttcctaatatttcagacaaacatagataagtgagattttactgtattttcaaatttctgtaaatttgtatttgggcactcatatttttgacttgaatacaaacacttattcatttttactatggtcttatgagaaggaggtggtgaacttgatttgagtttactgcatataagtaatgtattagtaaaagtctatccaatgtaatctctacactgaaaccacactgtaatgctatttgttatgcagtggagttaagtctatttaagatgggtctgtctgaaagtctatggaatttaaatatttaaatactaaaagaacctgcaattaaattatctcacatatatatcggggtccatccacagacttccaccatacagttacagtgacattacagtgtgtttacattgaaagtaaacaatgcagacatttatttttactttcttattgtaggctcccagcagtcttatggagacgcttgaacagcatctaaatacattagaaggaaagaaacctggaaacaagtacgcattagttgtatattctaaataagatgaaaaatactacagtcgttcttctaagaatgagatttatcatggtacaacttatattgctctagttttagggtatgctttgttataattttctgggctccctcagaacccctactcttcctattaacttatgacagtgggtatagacaatctctctgcaggctaatgcagcaaattagtagattgtacctacattaactgaacctaatgatttgaacatttgcctttagaaggaattcacaatatatggaaaaatagttactcctgtttaaaaatcaaagctgttatcattggacatgagtgaaaacaagcacaatttcacaagcagccttgagcactctattatcgttatcaaccccactgtgaaaaaagaaaagccctcaagtatagttttttggactccagtatctccctacttgaactattaggcatggcatactactgacattttattcatagatccttttatatagagaatagcaatcaagcaatgataagtacagttttactagattttcatacctctgtgtttgagtacttatatttttgactatttttcctcactacatgcacgaaatgtccaggttcctttttttttctttttccatctctccagcaggtctgaaacttgtctattcacaaggcctggtgttttccaatctttgtgcctttttcagactataattctgcaagtcttaggatgcccatcctccttgtcctgctttgtaaatcttatgcatcctgggaaggccatctctagtcctaccttctcatgaagcctttctttatcttgaactgctcagtattgtggctatttctttttttacatgtatgatttaagtagattttctgaatctaaaggttagggactattttatacttcattatgtccatttaaacacttaatgtatgtcctctacagggagagcttggaatctgtctctgttgatgataccagctttctgtttattccattttggttgacagcaggagttagtagagacaacccgtaaaatgatcatttcagggctgtaggctgatcacagattttacctatgacagagctatcaaaatgcaactattttctgactttgttgcctctggacattctcccagaatctaggcttgtgtcttgatgttactttttttttctggttatttcattagctgtgttatttctataatattttttcaagttagtgtagaaattattgcgtgttttaaatttgcagtgataagcaacagtataagagtattacagacaattatggcagagctatttggaatgatggatagtaggagctctcaggggctctttcaaggttgtttccacagtccaggctctgcctccaatctcagcgtggccggggatgatcagacttgacatgagagtacattagatcacaataagagatgccctagttcagttatttctaggcccaccctctattagggtatctgggaagccaaatgagttgcctaggatttaagcaaatggagacaggaagctgagaaatgtttctgttcctgtgacagaaggacctctttagctaaggaaatatgtacatccgctaaagttaaaatctctgtcttgtgcagtgctggatgcacactgtaagtcagcttctctgcactcttccactcagggtcccccaaaccccatatagggccacacccttcccttgttttttgttaaatctatcagtgctgcagtcacagagaagcctccttgggtagctagaatgggtctcattagccctgacttcaaatctaaattcgcccccttgtggtcaccacaagctatttttggaaaaaaaaatagctatggacatttagttacatttctagagaagtgaaatttaaaattcaatagtcctccatttcaaattacttttttcttagaataatttttctttttcctttaaaatcattttatgcttgtcatatttctcttctgaattggctaaaaccacatttgaacttgtcttttgcttattccctattttttaaaataaatgaactataatagttaactattctcttctttgtatgtttgtgcttaccttggaacttaagtgaagggtgagtactgtatggagtgagttttttgcatttggtaattactaaaaatgcaaaaaacactcttaagattccacatttggtatttagaagatttaaaactgatttctgtcccttttacacatctgtgttttttcattatgctttatttttgtctcccaagttgactagcataaatggttttactttctttcggtcttcttggatatagactaacagtctctcttagatgtatatatgtatttatattaatatattcctcagattttagaaatgaaatattttttatttgtttagtaaacaaaagacttccccatggcttatagcataaatgcgaaaagacaaatttataaagaaaattaattacttaaaattgttttatttgtcttctggtcacagtataaaactattctaacctccaaaccaagtatatacataaattgaagcatttgcaaatgtctgctatgaagaatatgtatgccctttatatttagtaccttgtgtccactgctgtttatttctgtaattttatgcaatactctgtgatatacctttatatattgtctgtttctataattccacaggacaaaagagagaaatttattttattatttatgtgggtttactaagtgttgaggttacaggaaatttaagataaatcttttgtaattcaagttatttgaaggatgtagatagatctttcacatctgtatttttttctggctagcacttatactcaaaattatgtagggattattgttatgactcatataaaacttaacaaaatattctatttgacagcttcctgttaacatcttggaaagaaatatggacatttgctgtgttcatagtgaaacccatgagtttgtagtaattttacagaatttagagtagattacttatatgggtcattcattttcttctaaaattaccttaatgccttgtttttccaacatggttcattatctactagatttttctaggtgaaattattaatagaagtattggtctttttaacaaatattgtctatatgtaaatgatgtagtatcttctttcctaaagggcaatgactaacattagggtggaaaatcaagtgagaaacacataagaagagcaatttatatgttgtgtaagagagaagcaaatgtgccaagtttatctgtgttttgggggttggaatgtggactgagcataggctctgaggggcatatagacttggactagagtctggaatccaccgttaaagcatgatgagacatgggaaagttattaacctctccgagcctgggaaccttcagagtttaatcagtgattaatggtgcttttgaaagctatggccccattggagcacctctggttctcaaccttttaattaaatcatggcagaagccaactctggttagaaaacagaggtcacgcatcctgacagttttgtttcacagaaaataactttttaaagacgtctggttaatttattgattatagaatgaatacctgaacatattctaatataaaaattcaaataatacagaaaatgtcagatgatatgtaaagtgctagggatataaaacaatgggatgagttccttcctttcaaaaaacttagtatctagtgaagaagatagagaattaaacaggcaactaagatgtaatgtggtaagtgggatatctcaacagagacagtaggagggttttgtttgtttgcataattcatgggataactgcaagtatcatttactaatattgtttatgtggaagcttggcaaaatgattcttgtaccaattatgatttttcatacttaagtatgatactcttttttatagcaggtagaacaattctatcatttttattatatcttcattcttgctgtggggtagaagatgttatagaagaagttataatattttaggtattagtttggaaatgtatttctaaagctgttgatattttttttttttttttttgagactgagtctcgctctgtctcctagactggagggagtgcggtggtgcgatctcggctcgctgcaacctccacccaccaggttcaagcgattctcctgcctcagcctcctgagtagctgggattacaggcgcgtgccaccacacccagctaatttttattttttatttttttgtatttttagtagagacagggtttcgccatattggccaggctggtgtcgaactcctgacctcaagtgatctgcctgcctttacctcccaaagtgctgggattacaggcgtgagccaccgcacctggcctcttctcttttctttattagtatttataattgtatcaataccactaagaattggtttatgaaaattgcttgagagagaaacaaattaatttaaattaattcattcttagaaagtgaccataccaaaggcttctatgttttctttgtagaattcatgctactattttcttgaatttttatttagatttaactcccttccttttccatacgtaaagggaaaaaatagtggaagtggagaaattattagccaaaactcactaggacatttcccaccgtatgctgtactagatttttaggttcttaaggaatttactgtagatatttcagtagaccctttgacacggacagtatagataaaggtatatcctttccctcatagactatattactcttaagataacatttagccaaactacatgtaaccaagttgttacccttatgcttgttatatagcagaaatctctgtgcccttgctacctgttgtttatattcattttaagtagaaattaaattcaaacaggaaatggcaggcatgtatttgcaaatgaagttgaacttaaaagatattaacttgggcctggcgcggtggctcatgcctgtaattccagcactttgggaggccgaggcaggcggatcatgaggtcaggagatcgagaccatcctggctaagacagtgaaaccccgtctctactaaaaatccaaaaaaaaaaaaaaaaaaaaaaaaaaaaaaattagccgggcgtggtggcaggcgcctgtagtcccagctacttgggagactgaggcaggagaatggcgtgaacccgggaggcggagcttgcagtgagctgagattgcgccactgcactccagcctgggtgacagagtgagactccgtctcaaaaaaaaaaaagaaagatattaacttggcatataatactgttaaatttgctatatccaataagacaaaaattcataatattgtacaaaattctacttactaaatttctgctgtaattttgttttgctgctgctatgtgtgtgatattttctctgtagatgagtaaaaagtcatccctgccatgcagtaaggcggtgaatataggctgcttattgaaatgtatttagtcttcatcttgttttgttattcatttttcactaactgaagttagtaaaatgtgagctgttctggcagttatttctgaagcactttcctagaagtgatctgcaatagtcaatgctaccagtaatataacttaaaattcacgccttcctaattttccctcattttcttagaaaaaagcatcgaagttgctgtttttttcctagctcccactaattataacaggatgatgggaatatttttcctagaatattcttgctagagtttttattacagccatggggggggaaaacagacttcaagagtatgaatatggaagccgagacatatttcagcacagggcctgtagggatcttcacagtgtactttaacctaagtgatttaaaccactgggtgttggggtttgtcataattctgcaaagcatggttttttccaagccttctgaaaatggttttaaattcccatttagacagtttgttttttatggacataggcaataatgtttgactcaaagaatttgagttgcgagagatatggaaaataatgttgaatttaagtatttctagtactggaaattaagtagatggaaaacagtggaagggggtgtcattattaagtaaaagattaaaagttttttaaaaatagcctgtccattattttaaaagtctgtatataaaacaagttagtgcttgaccaagtgaaatccaacttaaatgcttctacaaatatattcacatatatatttatatatatatatatatatatatatatatatatatattcagttttaatttttttttatgttgccttttagatctggtgctccctctccattaagtaaggtaagtttggttttttgtttgggggtttttgttttttgttttttaccattttaccatcataaagtgtacagttcagtggcattatataccttaacattgttgtacaaccatcctctctatccatttccggaacttttttttttatctttcaaaactgtaactataccattaaacaataactccccacctccctctctccccgatcccctggcaaccaccattctactttctgtctctatgaatttgattaccctaggaacctcatatatgtgagcgcatatagaatctgtcttttagtgactggtttatttcacttagcatatcttcaaggttcagccatgttgtaccatgtgcctgaatttcctcccttttgaaggccgaattatattccattatatgtatataccacactttattcatgcattcatccatcagtagatatttggttgcttgtatcatttgggtttatgaataatgcttctgtgaacatgggtgtacaaatatctatttaagtccctggttttgattctttgggggtatatacccagaagtggaattgctgggtcatatggtaattctaatttaaattgtttgaggaaaggtaagttatgtttttatgtatcctcctttgtatttgtttctaagtccaatgtagtatagtatatgtaatttagtcctttgtttggactaaatatttttaaagttggagagattttcacgtatttatattgcaacagaaaacaaatgttatcagtagaatgttttaatagttgtaaaacatttttacatattctaaatcagagtcgtatgaggtaggtaatgtgatattgtgcatgtttcaaaggtagagaaatccattgtaattgggtgtctttccacaaatatgccttttagacagttgactataataactttaataactcgtttacctccttgtctcttttttaccatgtgaaaggacaggattagggttattagtgacaagagtatttacttctataggtctgtagttcacatttaccattgtattcttcagacaaaaatgtaatagatgtgttttttcctctttgacaaatttccattatataattgctgtcattacagatattcaaggatatcattatggctgcactggtgatttccagacaccatgtactatgccagtgatgggttggctggctgcctaagatcccctcagggaccttgaacaatcagtcagataaaacaaacaagtgaaaagctccatttattctgatataaggccaggtttaaaaccattatgtctatgtgaaaaactccaatatatgactgctgagtagagtgtcgtaaaattgtggcatcctttgggttggtctgtttctacattttggccaaattgaatttttttttttctttttcggccaaattgaattttactgactttttctttttgtaataacagattatttgggttctgttttcctagctcttacatctcctcagagcttgttgttacaaggcattttttaatgggcttctgtagagtttcattttttgcatttatgttgataatatttattgctgtcaataagttctcagtgtttcatcaatatcattttttctaaacttatttacatgcattggcttttaaaaaccttttcttagaggatttctcagtgttcccaatggatgacatacaattagctttaactagtcctttctcttccattgatcatgttttgtattccatttggaagatttgaatttttgttgaagagagagttctgagttgatattttctgattaacaacatccacactgctcatgtgtccacctttcttgaagtgctaaatgcttggcacttgcataactattgaattttgacttttggattagtatattcttggacaaacataatatttaagtctgtaaatttctgtaaatttctgatctcctcagttttttttttcctcaaattattctttttaaaacttcctttatgtttggtctctttgaagtcagatgcccagttaggggagtatctgatagccctggcttggtcttggtcttcatgaatcttcctgctgttatgtctcatctccactaacagaactaagtatcaatacattgttttgaaatgttccattaatctttctcttgtgaatgaatggagaattaaatataccagacaaaattgtttagttacagtaactaaataaaaatcttgtaatatattaattgactattaatacctcttcttgaaaaataaatactagattttatttttacctttttagttttatctatgtcatcttagtgatgggctatagtcatgatatcttcaaaacatcagtgacttgaatcttgcttgtgaatcgttctcttccaactgtgaactattttgcaagttagatttctggatttgaaggtcatctgagaggacctcacatgaaatctttttaggatgacaagaaaaaataatgacattggtttttttagcaattattacaattgataatttttgaaattttttgcagctagtaagatctttcctaataattttatgttcaggaaatacatttagcttttattttaattaatgaatggaagtcattgcaatgttaagccaaatattttatcattttatataaattacatttaaaatttgtaacatgttttagccaatattgattatttattacaatccttgatttcaaattttattgagtttttttttcctccacaaagaattacaaaaaaaaaattgctgggcatgtcatggttatacaaagaaaagtcctgctgccctgtgtcctgtagattcatatttgactcaagtgtgttgtgcatcttcactttcagtcttctccagccacaactgttacgtctcctaattctacaccagctaaaactattgacacatccccaccggttgatttatttgcaactgcatctgcggctgtcccagtcaggttggtaaataaatatgcagttaactgtttattaatattttattagagtttggttttatttttatgtgctgtacccaaatgatttcaccaaaggaaatctaatcctagtaatgttgaagtttttactacacaaagtacattgttttactcctgtgcctcttaaatcattagaaagacctaagctatagaaatcaccttgttgtcacaaactgagaaaggaaatggaagaatgatacacacaatttattctgaaattggctgatatggaaagtgttttctaaaattagtttcttcttgtgggagattcaaaaggtattttaaaatgctttaaaacacacacacacacacacacacacacacacacacacaacccaacttggaattgtttgaccaattagctagtgcgtatgaggaactcacactctggtggtaggaggaggcctttggggtattcctaatcagtttttatagaacctacagatcagaacagtagtgagaaatctggggatgactgtgcgttctttgaaatctctagcctcctaaaatcaatccccagctcataggtgtgtcctcaaataataaatttaggtcaattccttagttcatttgccttaagaggattctaatatcattttgtagtatctttgactctgattatgaatgccctatgtttggagacttgaactttgaactgagcaagaaatccaagtattgtacccatgttaactgtgtgctttactctctacttgcttagttctgcattttataatagcaaatttggcataaccaactcctttctattactgttctaattaaattgcttcttacaaaagctttaagatattaataataaatatgtattcctttcctggtatttagtccagttgtatttatgaaatggacatcaaaactagcaatggtttcagtggttttgaaactttttttaaaaagcagcagaatcctttcttcaaaagaatattacttggaaatctaatatgtaaaaaaagataaagatgaaactgctgtttatgaaggcaggtggggaacctgggaccctgatggcttggcacctggcctggtaacttttaagccagtgctcctcaaatctgaaggtacatgtgaattgctttggcatcttattaaaatgaagattctgaggtggtagatacagggtatgcctgagattttgcatttataaaaacatcccaggatgctgctagtttgaggcctatactttgaatagtaaggctgctccttggagattctacagacagagaagctttgaaaagcacagcctcaactgagtaaaaataaaaaatgcagtagtcgttttaggtaagtcctcttacaggcaaacttgatatattatagtctaacgtaggaaaaagataaattagtggttaataattccctttagtgttctttggtttataaataaattcttctcaagacatgaattttttttctatacaaaagattttaggaaatagagaaaagataacctcaaggttatgattttgatttccctgtagaatgctgcacatagatcaactccagcccactctctgtttttgtaaataaagttttatttgaacaaagacatgttgatttgtttgtgtattgtctatgtcttaatttcattctacattagcagagtcaagtaatgatagagaccaactggccctcaaagtctaaaatacttaccatcttgcccttgacaaaagtagtttgccaactcttggtatatgctatagctctatactttccaaagtattattcttttattggatttaaaatacctaaaatctttgatgatttctgcatgtctttattcaaaaacacctttatgttataaaatttcaaaatctgattttaatgttttattttcctttcagcacttctaaaccatctagtgatctcctggacctccagccagacttttcctctggaggggcagcagcagccgcagcaccagcaccaccaccacctgctggaggagccactgcatggggaggtgagtaaaaccagacaaccttgccatttctctattcattttatttcattgtttttacttaggctataattgttaacatttaccttttgattatctaaaatggtattagaaacttggagggaaaatgttaagaatggcatttattgattgaaatatatattgagagagagagacagagaaagtgcctgtaatacagtgagaatgttcaaatagtcatatagtttttattttaacagttggaacaaggaagttttgtgggttttttgttgttcttttttattactactctaaaattctgattatttttagtaattgttctctagagactcaggccttgaggattgagtattccccttaatttatggttactcaaaggtaacatttccaatttggtttggtcaggtgtagcctcgttcctggattcttttaggcctgaattgattttattcacattgtatttgacttcatacagttgaaatctttttacagattcttatttgtaccagaaaaatccatactttaaactgattgactgagaggaatcacatctaagcacttgattcccactttatttatggatctcaggaaaaaaatcagccttttataaatatttgatttaaaacatttaatattaatataaaaattaaagtaattgcttcataatgctcaaagctgcaaagagttggttttaaataccatgccttcctgtaccaaactatcagaataaaattttcaaaaagtttaagacatgccttgtacaactataggagcaacagaaataaaagacttagtaactcactaatgaggaaaccagcaagatgataaagctgtctcaaagaacattttgaggaactgagtatttataggtattttaaaaggaatgttagaataagatggctaggttagatagaaagctgttaatgacctatagggtaataaaaatcatagccttgaggttatcttttctcccatacagagattatttgcatcactagcagacaagatctgtaacaacataacattggagaatcagagcctttagtgcacaataataactaagtcaaatgaagttatatttctctaaataattgaatgtcctttggtggtcttgttaaacagtgtgtcagtataacatcaaaagtcctatctgtaatctcttgatctcatttccaagttattttggtaacaaaaataagagaaagataaccagttctgaaataatgttgctaactataaataagaacatttaaaatgttggcacgtttccattttaaatatgtaaaccttatcctatattgaaatgttcaactcctaaggctacagctatcaatttttaaaataaaattgttctctcagctttatttaactttattaaatttctattggtaaaggaaaatattgctaaagagattttataagggcattcttttttactcatgtttttattctgagcttcatcactgattattttaatttgctaataatttattttcattaccatattgtctttgttagaactttaatgaataaacagtgaaactgtaaactagtcccttttccatattccctggcatgaaactgaagataaattttatctttttttaaaaaattttggcactaaaagaatgccaaataaaaggaaaaaataaaaggtgaaattttgttgaattgcaatataacatttttattcattttcatctctaaatactttttgctaagacacataatattgtaaggaattgattgtaataaccaattttattagaatacattttagcctttaaagttagaaatatgtaactattgatgattgaaacattaacataccattggacataaaaagacaaagcagagcagtatggttttagccagggctgtactatacagacaatgtagatcatgcattgctcaaaggcagggcaagggggctgaaatccagccagaactctatagtcacgctgtgagcctttctcattatccttgagaaagagatgctttactttttctaatctgtctcactacagggagtaccttttttttttcttctttttaagatattatagcttttattttagaatatagcttttattttattttcaaattttagccataagacagtaaaacgaactcactgatttaccaaagacagttggattaaaaaaactgagtgcagtggctcatgcatgtagcttctgaggaggctgagatgagaatctcacttaagcccagtagttaagagtccagcctgagcaacatagtgagatcctttctcaaaaataaagaaaaaaaaatcacaaaaaggcagttggatccaaattatatttctgacaaaatggggcttgttcacatggctaaacatcagttgtcccaataggtaagctaatgggccaaaatttggggtaaagcagtttccatagtagtttgattttaaaagcatatttttatgcttttttcagttattttaaatgactataaggttaaagtttttttgataaacacataagattaattttacaataaaaactaagatagctctcaagttacaatgaaagctaatattgattgagtgctcctgtgacaagtactatgctggtcatcactacacttacccaagaaaggtactatctttaacctgtttaaaatgataaatatgtgaaaaccatgtaaactttcttatttctttcttttttaactttaagttctgggatacacatgcagaatgtttgttacataggtatacatgtgccatggtggtttgctgcacctatcaaccagttatctaggttttaagccccgcatgcattatgcatttgtcctaatgctgtccttctccttgccccagggagtacgtttttataattagtacaaaggcaccttatagggcctgatgttcaccttttgatgattagacagcacttttgccgcaacaaaacatctacaactgcaacatttcatagcaatagaaaagtcagctttggggggaaatgctaataaagaaattctctaatttctaagcaaaatagtaaaaattataagactttaagaaattgaaataaacttctacaatttgcccggtggatacccagtcatggttgaaggtgatgctaaattgtaacagatatgtgtttgtttatttgactaagcaaaaaaataaaattgttttctcaatcttgtttgataagatcaagccacttctattattgaagcatatttgaattctgtataactaggcagtaaattataaactgtaaaactctgtaagcctaattggatggtctcatttccaaggaccatagccacttcaaatgtctctaaatttttcttgggggttataggtaccaacacacatttttatttcaggggacacattgtaatgatagcattttttttcctgttggtgtaaagcaaccaaattttagcaaatttattttagtaaatttaatttaaattgtgcatgtaagatttggcatttctacaggctggtgatgaacccaatcggctgaaagaatacagaggattttttaaatcctcatctttggctccctaatagagtgttttttattttcttcatagtaaattcatgttgcagaagcacaaataagtgtgtgttgtgtgtctgtatattttagacatgggaaaacagtttctttttatacatgcttaaagtgaaatttctactttttttgagaaacatgggattactgccagaatttattagaattaaaattatctaccaacatgtatttgaaagctaatcaatattatgtgatcatatgactctgatatcttcatgtataaggttagctacagcacaagtagttttgtgacccatttgcttgttaataaaatctgaagtacatgtctaaaggtgaaacttggtctagaggatctctaggtcccttctagcttaaaagttccatgataataggtagtacatttattttttaattgcaaatggtgtagaagacacataaagctaaggtttttttagttagtgccttatctggcttggacattggtatggttgcatgtttcaactttagctcttatttattcttatgctgccatgtaatggacatcggtagaccttttgggagagggtgagtaaagctttgtttttaaacttccattttgacagacttctgtatgtaacaactgtccttattttgatcatttggagtctggtatatcttttgtcctttgcttttcttctctccgtttgctctctgtctctggtgaaatatagattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggaggttagttagtctcgctgctactttcattttttcaggattgctaaaattacttgggagttaaggtctttaaaattttttccgttatgtaacagcatgtcagagtgtttaagtactttttcaatgtttattcatgtatatttatcttcactaaattcatcaactttctcttcacttaattttagtaattttatagcagagattgcaatgcatcaggcccatttgattttcacgttttttaacattagaattcatgttgctaccttcagaactcctgcctttaggttcctgctctccagtgtctgtataaaagtggtaccagagctctctgtcacctttaggtttatttagcttttcggccagattagaactagcccagagaatatttggggaatgtaggaggagcaacacaggcctaagttgtttcttaatgtttagggcaaaaaataatctaagagtaattcaggtttggaagcctttgaagagagttaagggatgtgcctgtttttacagctttaagtttgttctgtccaaataaaaacttggatcatctttggttttggaactctgagaaaacatctgaagcagcacttgaaaggctgattgaaaacagatttaagtcagtctttgaaatgattgtctaaaaatatgctttccatggaaatgtaaattctgacccactataatatgcctggacctgatgagccatgtgaagccagtttattcatatatgtatccccatctgtgtggtaccaatgtccacacctaaagaagttctcatatcaaacacatacgtcaagtgatgttatagtcattatagttttgtgtatcttcattaccatataacatctttcctagggcattttgagaatatggtaaagaaattggaggaagaaaatggtgaaagcaagagagatttggcaggctttggtgtaatcaatatgtacccctgggaacatacatttaacacactgtcacctaccactctgctacatgccatgctccagtctctaaggttggccaacatcatccaagacaaggagcactccactagacacagctttgttgccactgctgcacaaaagacattttctgctgccttgctgtccattcctatggaacaggagaaacctgtttgtaaaagagtaggagaaaaaggattgcagacccttgaataaagagtcacccatggtctggcgcagtggctcacatctgtaatactagtactttgggaggccaagatggagaattgcttgagctcaggagtttgagaccagcctgggcaatatagtgagaccttgtctctgcaaaataattaaaagctagccagttgtggtggcaagcacctgtagtccaagctacttgggaggctgaggcaggaggattgcttgagcccaggaagtggaggttacagtgagcctgatcacgccactgcactttagcctaggtgaagagcaaggccctgtctcaaaaataaaattaaattaaaaagagccacccactatagagggttaggttttcatttatgcccctatatcctttgaaaccaaaaatttaaattttagcttacatttataaaatcaacttcctcttccttccacaaatctaaatcaggtggtaaatagagtttgtcaaagttgtttaggcctgactaaaggtaagcctcttgacctcctttggcctcagttctcccatctatacaattggaaacttggtctagaagatctctaaagtccttctagcttgaaagttccataataataataggtaatacacttagtaaatgttttaatttaaaatctatccttcccccaccctctgttattgatgtagctatgggtagtttctcataggcttgtgttaacagaaaaaaagtaaggaaaatatggacaggatgcataataattttgtgctgaaacatttctacgccttagctgtttagattttttgtttccagtccacttataaggagttgattacctcaaagaaatcaatcaactctatcttacttcctgcatagccctctagaataataaagactaagatatttctttgaaatattcttcatgccattatgctgtttttgtttgtcatttatttctgttttgactatattcatcaagtggaaaaatctgtatgtttagaaaattttcatgatggcattctttgtagctttaaatataagcttaaaggatgagtactgcagagaatcatgcaacttaatgtcaaagaatgagactgttcttgtgattttatcaatatcctttccagtcatctggctgagaaatgagtgtacaatgacaattacatctgaaaatcacatcataattattttattgatctgtttagttctataaattgtctcctggcttctgatagctatacaatttccatcctttatgttcaggagtctatatatgtcattatctgttttgtgattttcagtgattttctgtaatttctttcatgccttcattggtttttaagaaattattcagagatttaatttttaataaaaacctaagctaaaatctctttggccattttgtgtggccattttttaaatattttgtctctctacaatgggtaagtggtagaactctagaataatcagaaaaccagttatgttttgtttaacacagcataactttacaactttaaaacatgcctttttgaggtcctatgcaatatgtacagcaactaagtagatttctttagaaataaagcttaatggattttaatttcagaaggatggctatttaatttcatccctatcaaatattaaaactgttaatgtattttagtactatatttaaattacacattttaaaaatagtaaatttttgtgatttttaacagaaatattcttattgatacacaagtaatgttttagtcctttcaatgtaggtagttcatgtaagtcattaaaaaatttttgtcagctacatttattaaatgcttcattttttaaagtgaacttttaagaaatgagatcttctttttatgatcatgcagaacaggattgcaagggcagtgttacgcctttaaaatttagtaaaatttataaatattgacaaaaataaaaggcaaaatccttaaaaataacctatttttatactgatgcaaattttactgacaatagcacattgatttgaacaacacagggtttttctaaatactagaatgctaaattgatgctaattcctctgcacaccaacaaggataccctttcaatcaaatgtgtcaatttgtgagcaaaccttcataaggttagtagtctgcaaacattaaaccaaagtgactggaaaaccaaagaacttacctcacaagcctgatcacattgggtacatgttggtcaaaaaactaagttaaccaaccttccttaaaaccaataattaaacactttcaactagatttcatgttagagccttataacctgggacctttggagacaaagaggaaccagaatgtgacatttgggctgttgagaacaattggaacctttgtgctgagtgtgtgatttaagatggcttatgtggccaaagtagatggggagagagaataggtcaggctgagggaaacaacagctcttagatttgagagaggtagtcatatgataaaaagtttgagaggaaaattctgtcttagagtgctggaaggggaaaaaagactagtctgcagcagtcagctcagtttatggattaaggcctagactgagtccataattgaagaacagcaggagcacgcatttctaggaaatagagctggttgaaaaactgacagaatgtagaaattaactgcaaatgggtaacatgaaaaggagagctgaactggaaataactttagtttgcaatactggaaagataatgctgccatttataatgaaaaaaactagatatttaaaaaagttttgtttattttttaacaaattcaaattttatctctcacagttctggtggctgactgagctcagctgggcagttctcactcaaggtctcttttgtggctgcagtcagacagtgattgggcctggtaccatctggacactcattcatgtctccttcggggctaggaagattcaaacagctgggggtgggagcagctgcagctcctacctttaagaaaatttctgacaggtgtagatgagttaagttgataatatttagtttcaagtaacaagagaagaattaaaaggagatatcttgctgacaaggggattttttaaaaccctcttctaaggatgtagctataacaatatgggctttatctccttacacataagtgataacctaaaggggtcagcccataaatatctatttgatccctggcactaatgtaactgatgtttattcaattataaagaagggagtaatataatagaatgaggcatatttcataaaaaatgcagtacagtggctaaacacataaagctcagacagctctgagccaaatcctaactctgccattttcttgctgtgtaactttagtcatcagactttttaaaaaaaaaatctttaattgaaaaagtatatacatatatatataatgtacaacatgatgttttgaagtgtgtatacattgtggaatggctaattgagctaatcaacatagatgcattacctcacttattgtttgtgatgagaacacacacgctttaagctttggttgtgttatctacagactggagacagtagaacctaaatcacaagattgttacagataaatttaataatggcaatatatatgactgctatgtgtttctactctttgcaatattattggcctcagttccaaattttataggaaccaaaaaaaaataaaacaactgacctgactcatggcaaaatatttacagccctcccaacatcttttcatacttctcttacattcttctgccctgcttgtagagggtgtgttgctctaagtcctgaagtatagtatctttaacatggcatttagaaagtaggcctactctatcccttgatgtattcttcattctttagttttatttatttggcctctcagctgacctgacactcaaaacctatattcctggctgggcatagtgctgtaggcctgtaatcccagtccgtgaggaggctgaggccagaggctcacttgagaccagtagttcaaagctatagtgagctatgatattgccactgcactccagcctgggcaacagagcaagactctgtctctaataataaataaattgaacatatatttcctcagtataacaaagaggaacaatcagatcagattaatccataagatatgaataactgatgtcctgttgtcccttctaagggatatttgtgatttggtaaagggccttttaacccaagtaagtatctagtttaatgtttgttattccacataaaactagaactctgcattactaaagagtgtttcatactcagtttgggacatgccaggtcaaactgagaaacaagtatcttgacagtagcatgtcctagagcctaatatactaagtaaatcaccaaggaagagcatgtactgtgtagcccttcccaagtatatatgacatgttattttcatgactgaaggaacagtgttccaggaaacatgagtagatattgcggaagacagtatttggggatggaaagtctagcaggtaagtgacaggttctaggtgggtgctggtctccactctccagggttttcttctcctaagcctgtcatgtttatcatggcttgattccttctgtacttttgaaactatagcatctctatgcaagctcaaagacttcttaccttaactaacattgttggtagaaacacactgggaagcatctgtacacatcagccatttgtaaaatgggcatttataaactgtggctgctcgtatgttaatgatattctataaataataatacacttatagtcttaaaatgtgaaaatattgttttaacctgttgaaaatagattattttccaaataactagaaaaatataattgcattatggtatcataccctatttttatctctttatgtctttaaaataacttattggttatgtttgaaaatgcttttcaaggatagtgaagacttaacacttaggaatgcttagtaaacttagtaagagtgtttcatactctcatacttagtaaaccttagtaaacttaacacttaggaatgcttagtaaaccttagtaaaattattggttatgtttgaaaatgcttttcagggatagtgaagacttaacacttaggaatgcttagtaaacctttcatgttaacactgtaattttgcctgtactagattataaaaaatcttaaaactagaattatttacattgccattgtatatttaattttattggcattaaagaagatattatgtttgctagaaactatgagacagggacattttaataacagtgaatcagtgttacctggacatgaaagtttaatgtcttaaattacataataaaaatattttttgttttaatttttacatccattaatttctaatgatacataaaacatgcttctcagagcccttatacaatgagaatctcattaccttttggatcctattaggcctcagcagtatcaacattgtatcacttgcatgttaactaacatgaaggtgtgcaaagaataattgttttgtgaccaccgacagcgcatgggccataaaaatgcatttttaaaaattcatgttgtataagggagccttcttcacaatttaacttggttcttttactgtattttcttctctttttattcttttaatttctgctgttttaaaaaccgcacccaagatgcctttgcagcttctcctggggaggcccctgcagcatccgaaggggccgccgcaccagctaccccaacccctgtagcagcagcacttgatgcatgttcaggaaatggtgggtttaaagtcattagccagtctgttattcttctgtcctaatgtaaaacccccgtagttagaagaggccatatgtttttctaattttactttcttctgagtgtaaagtatcattcatcataactaaataaataatgccagcatttaaaacattaagacaatgaagtacatacttatcaaaattgacaatttcttaagattgacaatttttgtcagtgcaagtatgctgtcttaatgtttttttttctaatgctatattgtactcttttgtaacattgagttcaaatatattggcatgttttaatgaattttcaaagctaccagattgaccaaataaagtgaagatttgaaggatagcaatctctgatcctagactgtaggttaatcttacggcactttgcaaaatgctttagtttgctaacttgtggtacctactaagttttcctttttctttagaaaaacatcctaatcactaacccctgccagtaggatagtagttaaatccaaggagcctcacacctagctagtgtgtaaatatctgtataaggtgtctcttgccatagttatgatgctgtctcttgtctctttccttactgatgctgtgtgtgtctccactttcctttccaaaagacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtggtaattttttgttattgttgtcgacctctttccgtctagtggattgaattctgatccttgagatgtactgcatgaagactgtgtaattaaatggttctctagaaaccatttgctgcttaattcagagttcttcaaagtgctaattaaggactgggaagtgatgctgtgtcaggcttattgttcaagttgagtaaaggcatgtgtgttcttggtcttagatttatttgagtccactcctgaagttgctgcagcgcctaagccagatgctgctcctagcatagacctgtttagtacaggtaaaaccaaagcaacccttttttttcactttagtttcttagatgttttcctgattaagctctttgtactcacctgtgataatgcatttgttagatttttgactttgatttcagctttctactacttacctctgcttggttttggtttgtttcacttttggaagatgctttctcctctccaccacaaggggcctctcctgtgcctgagagttctctcactgctgacctcttatctggtgagtgctttgccaaggtcaggacttcagagatgtcttgtggaagtaatgcatagagagaaggatataacatgtgggtttttcttgagttcttttaaatttaaaatgtacttcaaaagaaaaactcactcttgggaccatcatcaaccgttgagggttaatatttcaaatttaaggctagtgaaaatttttttcacactgaaacctctgacctcaaggagtcaattttattttgttctggagagcgtgtattttaaaacccgtttgcttttccttaactgttaagattgtctacagtctttctgcctggagtgaaccatgaaatcccaagatgccatttgtcaaggctcatggttttcttttcccttgggtgacatgcactttttcctgtctgtgcttcactgcagtggatgcatttgcagcaccatctcctgcaaccactgcctcgccagcaaaggtggattcttcaggtgtcatagacctttttgggggtgcgtatttctcctccatcaacacttaaggaatctttttttcttcagaataatttttaaatctattttattatatttcatcattttttctttaggctatataaaattctgtctcttaaatgtaaacttaagtttttaagatcattttcatttcttcgtcatcatcatcttcatcctcatcatttcatcataactttcagtgcatgacctaacaaaacacataatttttcacttggtgttttcaactttttgttcttcatcctaatgtagaattacctgactggaatttccttcaactgttcttccttggtgatcctgatctgttggctaaatcaacatctctaagttcttaaaagccaaataaacatgacctattaatagataatttagaaatgaaaacaagccagttaaaactgaaagcataagtctagatgttgtacattattctgtaggtttatttataatgttttgctatccttacaaagagttagaaggattggaaaatgtgttgctgatttaaatatatttccctcttcctttatgtgttatctgagggcaggaagatgtactgaattagctcttgagcttaaatactatccttagaaagcttaacccacattgagtacctcctgtacattgaagcatcatggacattccatgatgcgtacatgaggaatacaaagatgttgcagtgtctgacatttaggggctcaagacttgtgtcagataaacactaaaccttgacatgtaggtacaaatcatattgctgctccttgaattaagtttattaattttttaaacatttaatagaattctaaatggaaaaattctgttttattacctttaggtaaaaagtttaaaaccttgcttctgttttgacagatgacaaggtttagtccaaaaattttattcttagaaaaaaaaaagaattcccttaatcttacaaagaggtattacttgttaatattttagaactctttttgagagaataaaccggtcagagcataattcaattcatgtgatcatttcacacacccacaaaagacaagctcactgtacactgtcatgtctctgcatttctctacataatacttaaattacttactgtacttactttttacactttcttacttttccgctgcacaatggataacggatagatgcatttggaagtagtgcttctgaaccccaacctgcatctcaggctgcttctagttcatcagcatcggcagacctactagctggtaattaaattaaaatggtattttgtagaagttaaatttggatatatttttataagtaacaattataaaaattacataaattgcagggtgcatgttttctttttctttcaagacataaaattgagggaggggacaagtattgaaaaactgactgttgggtactatgcttattacttgggtgacaggatcaatcataccccaaacttcagcatctcatagtacacccatgtaacaaatctgtacttgcccccccaaatctaaaacaaaattgaaattgtttttaaaaaataattttaaaagacatgaaattgaaaattcagtcattgtacgatagaagtttgattatttctcagggtcttaaagttgcagctgtatacaagccacctttgtggcttcttgtatgctccaaatctgccttattttcagccaacatgtttcctttaaattatttaaagggtaatgtgcttatgtaacaatttttgtcttgtaatgtctatgcccatctttttttaaaggaagttgtggggaaatgtaccatgatgtttgaaaatagatttcgtaatatatgaatcactccaagagaaactgttacagactcctaccattgggtcaaaactgctattacatagaccactgtttttgttttttgtttttttttttaacaagctgatcatttttctatgtgaaaactcatggggtgatctcagctcaacagggtcatagtgtgaaatagattggtacagtttgccttggattactgcttgtggcccaagtagtatatatagaataaaaggaaacagttcaaggactcaaaaatagtaaaagccaagtattggtcttccttgggagcaagacaaagtgtgtgcttagtgatagccttgacctagaaattattattttcataagcaaagcattatgaaagaccagttgcaagaccacagtagtaagtttaagttcagattattagtcaaactcacaagacattgttggcttaccttactctgattttacttagacaggtacataacaggaagcacaacagtagtttcacagaggactcagtcactcagatgcagcttctgaggcccctccacagtcaccacaagggttgaattttggtcctaaggttgacaaggggctgacgagagcatgggtcacatcaccactgggaagctgccatgcatgtctgaagtcttgcatcttaaataccgtgctagtgctagccatgtagaccttgataaagcatatgaatagttcccttttttagtgtggatatagcccataaaattacaagttatacaataaacaatcctggcaccaggtacagcaagctgaggaacatttattcttggattagtggtgagtaatggcagatgctaaaagaccctcatcagccttcagagttgtagggagtttgagttgaggtcaaatctttcctcaggaagctaaagcaggtagtcgtagcccagctgttaacctttccttccatcagtaattcagactggctatttaacagtctttcccaggggcaatagttctctagtgtctttcccatcctttcctgactactatgatcaaacataacagtcttgcatgctgaaaccactcataccagtgactaccactaggtattttcctcagcactgaagaaccagggccccaccatgatattgctgagaacttatgctgagaagctagcataagaaattttaacttacttttaatttccgtagggcttaattttgggggctaatttttcatacttccctgttttgttatagaaaaatatttctcacccttgttcaagtatcaaaacataaggaaatcatattctcactaaagaacatcatggaatatttggaagttgcagagatgataagaggcagtacacttaacacaaaccacagctggttacttggagaaataaactgctagtttgcctggcttttatccaggcctagatattcttatatcagcttccaattggctacagaaactttcaaactcttactaaaccaataaacttcatacacattttgggggttcagcaataagattttaacatgccacagaaatagcatagttttaatggctatttgagggatcatgaccttgttaactttaaaatgagattagtgattacaaacattttgctttgaagttataattaagattaaaacggcccataaaatcaaatattctggcctttcacagaagcctatgaattctttctttctctcctgggtatcccatcccctgccacagatctcaaatgggaatttgaagcctaccagacagtagcctggcagagcggtcagccactgttgaccacctccagtgctacacagccacattgtctactccaggatcctcctccattgtggcctctctgtgtcctccaaggctagaacctgagatattgtgtttctcaaagagcccagaacactagaaactggagctgaaaggccttttcctgtgggaaaagggagtgttcccatccaattccaagttagaagtcagtaacagagccaagagatttgaccctgggggatgcaataagaatctaaaaacacatctagaacaagcctgaaggggtttgtcacctgctgccaggtgtaactgcacatacctgtgccacagctgcacagcttggtatatggacaggtccagcaggggaagtctacaaaaaaagtatgttagttcactttacaaaaaataaaattattcaattgtgttgtctattctgaaatcttattaaaatggggtagaaaagaggagaaaatcatcaatgaaagtacccaatgtcatctacataggtctcatttactacacactttccatttcttctactgcatcttcttgtgactctttcagtgataggcaaagttatatattgtgtacactttcttatttctctcttttctatttaaataaattaatattcaatgtaaatcagtatagatgagtttaatgtctcatttgctttcaaaacagttcttgtaatttaatgtatacatatgtcagtgcctgatttatttggcacaatgtgaaatattatttcaccttatatcctgatataaggggttggatgcagtgtcccacaatcataatcccaccactttgggaggcccagatgggcaggatcacttgaagtcaggagtttgagccagcctggccaacatggtgaaaccctaatctctactgaaaacaaaaaacaaaaataagctagcataagaaattttaacttttaatttccatagggcttaattttgggggctaatttttcatacttccctgttttcttatagaaaaatatttctcacgcttgttcaagtatcaaagcataaggaagtcatattctcactaaagaacatcatggaatattaatataattctatcctgtgaactaggagcaactttcctagccaaaaacaaaaaaataaaaaatgaaaaaaattctgctaataaacgcaatataaaaccacagtcacatttatatttgtaacctagctgacaattggctgtttctgagttttcacaattctcgtacatttttatttaatgcatattaagtaggacaaatatttggggcactgtgtgtagtaatttgcagtgaagcttagcatttgtattatagttgtgtctgtgtttatttgggggagggatcagctaagtccacagtctattgaaactaagaagatttttaaaaaaaaataaataaatgagcctagtcatacatagcaagcccacaaatatgatcagaatcaaagagagagaagagagaaaaagattctctagaatcctgtgattgcctttagtaataaaactgttttgagaaagaatgaaaaagaaaaataatatgcagacactgtcatgggaggtttagactgttcaaagggaaccttggtcactggactaaggactcttaccccatgcctaagattagatttttttgagtgaatacatttacatgtgaatcataaagataaggcaataaatatatgatataattaaattttaaaatgattttagagattttaaactaaacattaagaaccattttaaaattgaggcgaaagctttgttaaaaattggtatcattttgaaacttgaaaacaaagactaactagatagtcttgaaaatgaacctatctatcataaaaactattcttctttattcaaattcagttttagaactgtcagataataccaattccagaattaaacagcacttgaaatattgccttagtcgtcttctaccccttgagtaaaaattttaaggtgtttggtgcatgcagtatagtgaaatgataaaaaattctggagaggacaacttccaaagaggccagactagaaaaatcattatcaaaataatgaagaaaggaaggaataatgggggtggggggaagcagaggggagaatccataacaacaatgagtaattctttccaagccattgagattactggtaggatacagatattatccatatctcaggtaacatctgaatgaaaacttgaaagttaagtttttaaataataaaagtaaatatttcatacagtgaagagtaaagctgtcaaactctgctcaaaatataccaactgaaaatacagatgtttgaaagctagaggcagactactggatgacaaaggtaaaaatggactgttaaggaagttaggtgtgttgaggaatatgcctaacatctgaggttggcatcgagcaggacaaccatgtttttccatcatagacacaattttagggtgactgcactataaatctgtactagtataagagaatttcacatcctatctttaattgcaaagacaagggactatatggtccagcctatgaggccctttgtagttttgcatttgttctcttaaccacattaattgcttaaaatgagccacagaagtccttgaactgaatttaaaatacaaacatgcccagtgtggcattaaaaagtaacaatttcctataaaaggtaaaagtctacagaggatcaattctatcatcctgtgtggaagtgtctttagcagtagttttaaaattgcactcttgtggccgggcacggtggctcatgcctatataatcccagcactttgtgaggccgaggcgggcagatcacaaggtcaggagatcgagaccatcctggccaacatggtgaaaccccatctctactaaaaatacaaaaattagctgggtgtagtgacacacgctgtaatcccagctacttgggaggctgaggcaggagaatggcttgaacccaggaggcagagattgcagtgagccaagatggcgccattgcactccagcctggtgacagagcgagactccatctcaaaaaaaaaaaaaaaagaaagaaaaaaaaattgtactcctgcaactgaaacaatatgatgtgttagatagactatgtagactatgacagtcagacttgatatatctgaatcaatagaacttcattaagagtgtgggctactcccctttagaataacacattcataagactaatcatctgtgattaaaaagcagtgtatcaacagatggttgagtacctgaaaacagttggctcttcagttatagtgtaggacagttcaaatatgattacaggatgcacaaaagccttactctgtttccaattccattccatagagcacctttcttttttttttttttttaagcaacaaggtcaccctctgttgcataggctggagggcattggtgtgaacatagctcactgcagccttgaactgatgagctaaagcaatcctcccacttcagcctcctgagcagctgggactgcaggcacatgccatcatgccccctggctaatttatatatattgatatatatagatagatatataaaaatgaggtctcgctatattgaccaagctggtctcaaactcctggcttcaagtgatccttctgccacagcctccccaaatgctgagattactggcatgaaccaccatacccagctaaacgtctttcttaatgtaaattagaaccacatagaaagattagttgtttaggttttcctattaactctattccagggccctaaaacttttcagttagttaccaggaggaattcctcaaatgcctcatgaatgactgtaatgttcctgtttagttcttcattatagcaattatttttttgagataatcagttggtccttttatatcacttaatagctgtttaattattctaggcttgtgagggcacttacttcataagaaccgagtataatgggaaaaagtcatcctgccagatctcgacaattttataaatgtatgggaaggttaccactacagcattttttctggatgtgagaaagaggctgtgtggtacagtggcaaagaatccagactctggagaattcctgtttggaatcctggatctgccatttgctttcatatgaccttagacaaattatctaacatctctgacctcagctttctcatctttgaacctcatggggttgttataaggattagataagctaatgtgtgttttagattgaaccatttaaaactgctgattttctaggatcaaaacagtcaaatatcagccattcgtgtcgttcatagggttcaccctaaaaaaggaaacctagaacagtgcctggcacttggtgagccctgggccaatgttggcttacctttaattttcttagagaaggcactatttttttttttcagtgaacagctttatttattcacctatagatgtgatcttagcataaagtagaaatagcactaagcagagtgtcctaggtaaatgcactctttttcctctttttactgaatcttaccagtgtgttaacttctctttgagtcatttcttctagccatgagatgacaggaaggaatcagatgatcctgaggccctttccatcactaatatgctgtgattctaaaataaattgtcctttccatggccaagttttaagaagtcaagagtcaagttttctccacattcacctatagaaagagaatcacaacatagaacagttgcctaaatttaccagacaaattccaacttgaggtacggggtaatgttttttaaaaatcaacattaatacagccaccaatcttcctaaaatcaaaatggtcacattcacaaaaataattacttttaacctaccttggctgggataagctcttactgatttagagaacgtcttcttcagtaaagaaagttatatgatacttatgccattcaaatactaaaatcacttaaagtagccatcatgaactgtaaagatcatctaataaaaaacttttttccaaattaaaattttttcatacacatatgaggaaagcctaaacccacatcactgtcaatttctaggaataacataactcaaacagcattgccacctgctttagaaaatagtagataattttagtggaaatcactttcaaaattataaatcgattctatggaacgtaaacttaaggatgttttttgaaacattgtttttgcaagcagtttgtgaagaagagacaatgtggctggatttgaaaggaatatatacttaaactttatgtaggaatgacttctggtagtaataaattcttttataatagaatatcatccagtgtcttgttaagaaatcacttccttcagaggctgtatatttttgttcagtagcaatgcagagtgatctctgcttctgtttctgtctgttgattgagagaaatgttttgcttccagccgtcaaaggataaatacttaatctgaggttggattactttacagtagtctttgatttgtcctcaccttttatattcaaaagtgtccttcatttaataaacattaattcagtgttttaggcactgtgcaggatattagtggaaaaaacatgaaaagaagacacagttcctggcctcaaaaagccatctggggttggagtcggggcagtggggatagatacatgtaatgagagtagcagggggccatgtaccaggtgctgaggatactcggcatgtatatggggatgtgggtggggtgcagctggtagtgggtagcagtgtgagggcaaggaagtcctcccagagcaggcatctgacactgcgagtggcggatcacagctgcagcctgctttgctgcaggggccagtgagtagagacagaaggacctgatcactacacgaaggaattcaaattatatgaactgaaaaatgatgggaagctgatagaagattttggagaagtaactttgtcaacattttccacttggaaagatcattctggctgcactgtgaagactagattggaggagatctagactagagacaggatgccatcccactccgtgactgttcatgaatccagagagcagggttgcgggggcctgcactggtggtaacagcagtggggctagaacatgtatgatagatgttaaagatttgatatgtatttttatgatttgttttgcattttattataatttgcagtaaacattttctagaaaccggatattatgatttgaagaaacataaaatttcaatgtaatgagactgtctgaattgtaaacctagtgataccttatttgtttatatactccattgtaataatagatttgcttgccatagtttctcttaataaggttatacttgtgtgttatcttatttctaattaaattaaatctctcattaatgcatgtcagatttcaaaatattatgcttgaacaacttttcagaaatgagcttctctgtttcactgactgctaatcaacatgcaattaattccttttcagttttctataactttttaaattcagtttttatggcctttacccacctttatgttatttctgcttgtttttttggaactttttttcaggatttgggggttctttcatggcgccttccccatctccagtgactccagctcagaataacctgctacagcccaattttgaggcagcttttgggacaacgccttcaacttccagcagcagctcctttgatccatcaggtgaggcagtgactttcaaacattcttttcatgtgtcctggtaataaaaaaaagtactacctaaggttagtatgctatcaggaaatttacaacaagcaaatattgagtgataatttggtttataaaacgttaataaatctctcatttagtaacttaaattaaaatttatagtacacattggtatccataagaataacctgcaatcctttctctgtttctgtttatttttagcagaaatctaacttaacctgcacaccatctatttgcatgagcttacatgcacatggtttagagatggttaaagaaaaacagatactttgtactaaatctttgtacagtgtttgaatatgtgaacactcccactgctgttgcttacatcctctgaagcctgcatggccctcagttttatgaagttgagacacaaatagtattctttgcctgcctttaacctttcatcactgctgtcattttgtttgtattctcttccattctactcttcccatgctgggtccttactacaaattttcacttggtgagtttttggcaattaaatgtgtttcagaaacaccctaaataaatcctctgcctgacaatttggttgcttctattgccagtgcctagttgaatgctgtcatttttcactttaaaattattgtatagtagttgttatggtagatatgcatagttttttgataaaattttacaactacaaagtttttgacatagataacatattagcaacatcttatgcaaatgctatgtgtctgcattttgaatggactttctgtattctaggaactgaacaattagtaacttatttggtgatcaggagccatcaatgatgcatttgatccctaatacttaaaatagtatttaatttacttatgcccttagagttacaaccagaaatgattgctctaatgagtgagaaaaaaatcaaaattattacttttgaaatgtgatcaactttttcaggtacctattactagatgctgactgttatatcagatgttattttgtttcctaatttcgtaggaaaccaagagatgcattattttctcatttaagaattatttttaaggtaaacattttaggttttcagagtaaattatttagatttcaccataaagcacattagaagtcttttcactattttcttgaataagagcaacaatggcaatattgaatgcctgtataaagcaagcattataataaacccatgacatgtatcacctaatttaatgtttacaacaaagccatgtattggtcatactctccccatttacagatgagaaaactaaaaagctcagagagtaactttcttaaagtcatgtagccagtgagtcatgcagctgaattgaagcccagttcattcctgtacattatacagatttttttccatccttgttcatgttcattagtattttcatactttatgagtagacatatgtcgacatgttcttcttggtgttacagtcatgaaaagtgtgaattacttgccttcttttataagattttatattcacttgtttccatagtatcaaaagagagttttactttaatttcgcatatgatctttttttgttttcaattattctgaacctagtctatttgatttccagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcagtgagtaatctagttttttttttttttctttaactgaagcatatgtgaattgttttttgtttctctctctctctctctctcatctcatatgttttgtttctggactctcttatgggtgagtatggcagggagggaatagaaatacttagtgctttacccagtgcaggtccttggaaggcaaacagttcctatgccattggctcacgagcaatacccatgtcattttagtctaaattattaaaggtataatcagggagcatatacaagtatgaaaccaagtgtattatgtgtaaaaagcacttaactttccatttcatttggaaataagaacatagggtaacttacatgaagtatagtatctttataaattgagtatccaactgagtttcagtcatttgttcaacaaatatttattgaataccaagcattcttccaggctctagagataaaccagtgagcaaaacagataaaaatgtctgtacttatggcacttaggaagggcagacacaaactttaaaataaataaattctatagtgtgatagatcataagttccatggagaaaaaacagaacagacaaaggagagctgggagtgctacagggtaggagttagagtaagcctcaacaagaaggtaaaatttgagcaaagattttgaagggaaaggggtaaactacgtgatgatctaaagaaggacatctgcaggaaaatgaaatagtgcaaaggctttgaggcagaagtttgcctggcagattcaagggacatccaggagatgagtggctagagctgagtgggtaaaggagagagtcctagggaggagggcagctattacaaagatcgacctttgctcttaattctgaattttgtattcatgtgaatgggtttaccactgtagatacgtaatattattcaaggtagtatcaaaagtttagcaaatcacgatacagacttctttacctgtgaatttgcctgtggacatacattttgttttccattccttccctgtgatttgagcaaccatgaaaatacttttatgacacccggggagaggttatttgaatatttcctcctatactaaaatttcatctcacaaagtgactgctttctctgcatactataatgtatcccctttcagaaataaaggacttatgcctccagctgctgagagtgccaccaacacacagccctcagctgtcaaccacctttgagaatgatcccagctgaaagaagctaacccgctagagcaatacccaaacaatcttgaaaaagaaaaaatttgaagcaatcgtgtttccaatttcaaaacttctacaaagctacaataatcaggacaaatggtactggaataaggatagacatagagaccaaaggtatagaataaagatcccagaaataaacccacgtatatagtcaaatgatttttgacaaggataccaagaccattcagtgagggaaaagacattcttttcaggagaaaaaaattggggaaagactaaataacttcatgaaaaagaatgaaattttaccctttacttaaacaaaaaaaaattaattcaaagtaagtcgtacaaccaaatgtaagagctaaatctacgcaacttttagaagaaaacataggagtaaatctttatgacctgagattaggttatgtttggtttcttagatatgacaccagaagtacaagaaacaaaagaaaaaatagataaatagaaatatatcaaaatgtaatacttttgtgcagtagacaataccattaagaaagtgaaaggacaaaccatagaatgggagaaaatatttgcaaatcatttatcagataagagacttgtactcagaataaagaactctaacaattcaataatgaaaacacaaataatgcaatttttaaaatggcaaataatttatttgaatagaccttttgacccaagcaccctatattctccaaagaatatatacagatggccaatatgcacatgaaaagatgctcaccattattcatcagtgaaatgcaaatcaaaaccaaataagatatcactttatacccaataggatggagataactaaaaagacatataaccagtattgatgaggatatggaaaacttgaaacccacagacattgctggtaaaaatgtaacatggtttagctgctatagaaagaagtctgatagttactcaaaatgttaaacatagattatcgtatgactcagcatttccactcctaggtgtatggagtggaaatgaaaatgtgtatgcacacaaaaacttgtacatgaatgtttatagtattgttattcataataaccaaaaagtagaccaccctaatgttcatcacttgatgaatggataaaaaaaaatgatatatctacataatgaaatattctttggcaataaaaagaaatgaagtactgatacatgctacaactggatttactgtgaaaacatgccaagtgaaagaagtcggtcgcaaaagactatgtgttttcatatatgattccatttatatgaaatgtccagaatagacaaatgcatacagacaggaagtagattggggcttcaaggggctgagggaagtggagaggaagaggagtgactgccagttggtacagggtttctttttgtggtgacaaaaaagttctatgttagcactgtgaataaactaaaaccattgaattacgtactttaaaagagtgaattttatggtatgtgaattatatctcaagaaaaatgtttttataaaacatttttcagtgttagctgacgcttctattgagactgcattgcagtcttgcccaatcacagtttcctctcttccctttcaaaataaatctcctgcatgctaatctccatcccagagccttcttcccaggacacctagcttgcaacagaggcccaggccctcaggtaactcattcccgtctgccatgaaatttgacaagggattcatgtatacatatgtaaggtacacttctgctttcttttgctttttcacatgaacaggcataaatacttggtttagctttttaatcatttaatatacatatatttagttttatagtctaattgaaaaataaattttaaaataaattttgtcttttaaaaaaactaaaattatgggtaatcatttttatatttggtgttcagttaatatataccttattctgttttgtaatgccaagatttggtaagaaataaatattaacttcatcctctaatacattgattatgcacctgattagggctgttgtcctggctgttccctctgcctagaaagctctcacccagactctgctcagctttgcccaagtctcacttctatgaatccttccccaagcaccctgtataatattctctggccccatgtttatcctaccccttcaaccccacttactttgcccttccttttcatttttccataagctttccttatcgccttctagcagcctgtataatttactttttaattgttttgtcatctgtctgacaccatcggaatgcaagttcctccaggataggactctctgactgttttctttactaatatgttccgggtgcctaaaacagtgcctggcatatgtagatgctcacaaaatattttctgaagtaataaatgaattgatattagagcagattgattaagccgactatgtcaagggattcacagagccactagaaggacacatgggactcagcacatcgttgtactcacagctgagatttattacggaagcagaggaaggatatatggctgatgataaggggaaaagacaagcagagtctagaagagtccacatgcagacttccttaagctatgtctctcccttgaggagaagaacacactcttcacccagcaacaaaaatgcagcagcatgtgtgaggtgtttatgcctaaagaagacctttagagactccacacccagagtatttattgggcagtgatcatgtaggcatttctgcttggcatgtgccaaaatttcagacttgcagaatgaaagtggatattcaacataaaccatatcatgtgtacaaatagtagtgtaggcacagtgatccacttttatcatttagggcaagttttatcctagtatagagaacaatttactaaccaagttcccagatagcagcctttctaaaatagcagcatcaaacctgctatgtttgctcttttctggacaccagttgacattaaaatggatccttaagtctaacatgaagtaaaagaaaatctttaatttatgaaaatatttcctaatatagtttcttttctgtataactgaatgcagtcattcctaggcaaaataaggacttttttatagacttctgattatttgatcttttaaatgtcatatcatataaactgagtgtagagatttacattcttttttcttttatccatttatagatcttggaatttctggtaccacaacaaaaaagtaagtgtttggaaattatgtgatttccttttgatggtatatttgtattcatttgagactatcaaccattttactcattggagtaattattcattctcatgctagataatttcagataatttcacaattggtgtttatttcatcccagatttttgttgttattctactggaagctccaaactgttgctttgcaatgaaaaggaataatctatttcaatctccgagattgtcactaagttatatctagaaatatttgggaattgtggcttgaatattttaatagcattacattctagattcattaccatagttctagctaacatgaattttaaaaagtctttcatggagtattaattgtaaggaaagatagtaaaaatggtaaacaatatattcttttttagatgtatattttgtcgttgaaattgagacatatctttcagtggatggtgtcttacgatcactgtaaggcaggttgcagtcatgatacagttgtgtgaaacattctgctgaaccctctaagatccagaaagtgccatcatcagtgcatcttaaattcaacaaaatcgaagtgtacagtatatatgatatatttatttgcatttttaataacaaatgaatccagttggatttttctgacatacttttctttatagaggataggaaattcctatacttattgaggtccaaactctaaatgattttttttcaaatgcttttaagctttcttagttacagcatggcaagattcctctgtaagttttaactgctgttcttattactataccacttgactaaataaactgcttttaaacccaaataaaataatctaaggagccacacaccatttttttctgatttgtgattttttgtttgtttgcttgttttgcatggttaattttaggggagatcttcagtggaatgctggagagaaaaagttgactggtggagccaactggcagcctaaagtagctccagcaacctggtcagcaggcgttccaccaagtgcacctttggtatgtagcaatcagagcccagggcagcgcaggcagtttgccagtttccaagtgtgtaaagtagcgtgcattttgctaactttgctgccgacggtgtacttattcctctgcattgaagaaatataagcaagtagcactccagcccagggggctgccctccattcttaggtatgaaaacatttgatagcctctgttttgctgcgggaagtgggagagagagtaaataagcaagatgaaaaaactaagcaagatgcagaagttaccaaaatgcagattccaatgactttatatttaataatgattatgaccttttaaaaattttaaatattttaattaatatttatacttccatatttgtaaaattatgaaaatgatttatcaaaagcacttaatgtcattgatcattttatctatcttatcatatttcttgcccaaattttctgattgtcttagtaagtaataactttttttcctaccagaaagattgggcagttttttattgtgtaagttcattttaaaatcctattacttttgctcaccattttaaaaattgaaactactcacaccatcttttctataaggtttaaatagatttcatgtctgtattttaaatttctattaatatattaatactgccattcactctgggaaagaacacatgactggaaataaagactaactattgctttgtgaaatttgctgacacaaaaagaacgtgttttcagagtagcaaactgtataatttttctatatgcactctgtgtttagcaaaactaagctaatcactgtttcccaaacttactggcagttttccacctttgcttaccacctccacctatctaaatcaaacccatctctaaggctttcttgatgttatcctttccttgttacctgaaataattcttaatcatcattcatcaccgccagccaaacaaacatgcaagaagtaaattaatataaattctaattaaaaattttctcccattctgtaggttgcctgttcactctgatggtagtttcttttgctgtgcagaagctctttagtttaattagatcccattggtcaattttggcttctgttgccattgcttttggtgttttagacatgaagtccttgcccatgcctatgtcctgaatggtattgcctaggttttcttctaggatttttatggttttaggtctaacatttaagtctttaatccatcttgaattaatttttgtataaggtgtaaggaagggatccagtttcagctttctgcatatggctagccagttttcccagcatcatttattaaataaggattcctttccccatttcttgtttttgtcaggtttgtcaaagatcagatagttgtagatatgtggcattagttctgagggctctgttctgttccattggtctatatctctgttttggtaccagtaccatgctgttttggttactgtagccttgtagtatagtttgaagttaggtagtgtgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatgaccattttcacgatattgattattcctatccatgagcatggaatgttcttccatttgtttgtgtcctctttcatttcgttgagcagtggtttgtagttctccttgaagaggtccttcacatcccttgtaagttggattcctaggtattttattctctttgaagcaattgtgaatgggaattcactcatgatttggctctctgtttgtctgttattggtgtggctctctttacctatcaatacaaaaatctaaggcccctcagcccacatttggaattacccacaacttgtttgctacaagtctttagtcccactttcccactactttcttagaaaaactctcttgtgcaagtagcactccagcccagggagctgccctccattcttaggtatgaaacatttgatagcctctattttgctgtgggaaggaggagagagagtaaataaatctgaataaaattcccaaaggaagaaaaaagcttttttagaactgatttggtgagtctgttaatactacataatgacattaaatctcacaatgtaatctatattatcattatcaaagtaaaggaattaattttcctattcccttctgtgcagaattagaaaggccttatttgttgttctaaggaatttatactttcgtgatgttgcccttatcaccaggataaaacttttgttttttaacaagttagtttcagaacaatcactggtagtagcacagtctaaagtgagttaggggtattggaaggcaaggtggtgagaacattagtatctggcagacaggctgtaggttaaaaaaaggaaaaaaaaagttggctgggcacggtggctcatgcctgtaatcccagcactttgtgaggccaaggcaggcggatcacttgaggtcaggagttcaagaccagccatagccaacatggtgaaaccccatctctaccaaaaaaaaatgcaaaactttgcaagccatggtggcatgtgcctgtattctcagctactcaggaggctgaggtgggagaatcacttgaacccaggaggaggaggttgcagtgagccgagattgtgctactacactccagccgtgggcgacagtgagtccctgtctcaaaaaaaacaaaaggaaaaaacgtttagagcctgagttagggtagaaaggaagagaagaagacaaattttcagttagaatccacacaagtggggatttttatggatgaggcaactaagacagtggttgcccagtgtattattccgttttcacactgctgataaagacatacccgagactgggcaatttacaagaaaaagaggtttaatggactcatggctggggaggcctcacaatcatggcggaagacaaggaggagcaagtcatatcttacatggatagcagcaggcaaaggaagagcttgtgcagggaaactcccccttattaaaccatcagatctcatgagacttactcactatcaccagaacagcacaggaaagacctgcccctatgattcagttacctcccattgcatccttcccacaacacatgggaattcaagataagatttgggtggtgacacagccaaaccatatcattctgctcccggcccctcccaaatctcatatcttcacatttcaaaaccagtcatgccttcccaacagtccaccaaagtcttaactcattttaacattaactcaaaaatccacagtccagagtctcatctgagacaaggcaagtctctttcacctatgagcctgtaaaatcaaaagcaagttagttacttcctagatacaatgggggtacaggctttgggtaaataccgccattccaaatgggagaaattggccaaaacaaaggggctgtaggccccatgcaagtccaaaatccagtgggagagtcaaattttaaagctccaaaatgatctcctttgacgccaagtcttatatccaggtcacacatgatgcaagaggtgggctcccgggccaggcatggtggctaacacctgtaatcccagcattttgggaggccgaggcaggcagatcacaaggtcaaaagatcgagaccatcctggccaacatggtgaaaccccatctctactaaaaatacaaaaattagctgctcatggtggcacatgcctgtagtcccagcttcttgggaggctaaggcaggagaattgcttgaacctgggaggcgcaggttgcagtgagccgagattgtgccactgcactccagccttgtgacagagcgagactccacctgaaaaaaaaaaaaagaggtgggcgcccatggtcctcgggcagctccatccctgtagctttgcagggtatagccctcctcctgggtgctttcacaggctggtgttgagtgtctgtggcttttccaggaccatggtgtaagctgtcagtggagctaccactctggggtctggaggacagtggccttcttctcatagctccacttggtggtgccccagtagggactctgtgtgggggcccccatcccacatttccctctgcactgccctaacagaggttctccatgagagccctgcccctgcagcaaacttctgcctgagcatccaggtgtttccatacatcttctgaaatctatgtggaggttcccaaacctcaattcttagcttctgtggctcaacaccacatgtaagctgccaaggtttgggactaccaccctctgaagcaacagcccaagctgtcccttggcccctttgagtcacagctggagcagccgggacactgggcaccaggtccctagactgcacacagcacagggaccctgggcccagcccatgaaaccacttccccccccgccaccccgtaaacctccaggtctgtgatgagaggggctgctacaaagttctctgacgtgtcctggagacattttccccattgtgttggtgataaacattcggctctttgttacttatgcaaatttatgcagctggcttgaatttctcctcagaaaatgggattttcttttctgtcacattgtcaggctgcaaattttccaaacttttatgctctgtttctgttttaaaactgattggctttaacagcacccatgtcacctcttgaatgtttagcagcttagaaatttattccaccagataccttaaatcatcattctcaagttcaaagttccacaaatctctggggcaggggcaaaatgctaccagtctttctgctaaaacataacaagaatcaccttcactccaattcccaacaagttcttcatctccacctgagaccaccgcagcccacattttcccatcttcttctgagccctccaaactgtcccaacctctgcctgttacccagttccaaagttgatgcctcatttttgggtggcttttctgcagcgctccactctactgataccatttttaccatattagtttgttttcacactgctgatcaagacatacccgagactgggcaatttacaaaaaaaaaggtttcatgaacttacagttccacatggctggggaggcctcacaatcatggtggaagataaggaggagcaagtcacatcttacatggatgacagcaggcaaagagagcgcttgtttggggaaactcccccttataaaaccatcagatctcatgagacttattcactaccacaggaacagcatgggaaagacctgcccccatgattcaattacctcccaccaggccctcccacaacacatgggaattcaagatgagacttgggtaggaagacagccaaaccatatcatccaggtttctgtgtgaggcagtttgccaaataatgaggccactaacccagaagggaacaagggaaaagcactttaaaagtaatattaagttgaagaacttccttggccattacccaccctgagatcaagacttaactgtgcaaagttaagaattcatcaagtacttaattaacaactgttttgcatctttaggataacaaagctgctgactgattggtaggcactttcacagactgagattgtctcatttttttaaccccaaaactctttatttttgtttatgaagcagaaaaattttaattattggtaattaaaccccagaaagtgaaatatggaaagttttagcataaagtatccacagcagctacggaaagagaaattagaacaatagaaactatttgttacaataaagagttacataaagttttatttcttttattttacttagcattttacaccacaatatacaggctctcttatgcatagttattttatctttattaattcttagttttatctatattcttttatatagatactccattttattttttacaaagctgttctttcctaacaaagctgtggctttgcttttacttaagaaattattctgagggaactatttcagctttctccaacatacctttacaccctgcctccccagttgatctcttccaaccttctattcctttatagtctctttctaggaatactcaaggaaaagaagctagagacaccagaaacaagtgcttcagaagcagcaaagcagtgtttccaaattttccttgtaatctacaggtctttgctattgagaaggagatgaaggatgcagatttgggaaggggaatccttttgctgcctttttaaagtttttattgatagataagcagtaagattacttttccccacttattccaaatttcccttaattgcttcttagaggtgtagctataacacttttcagatcacagaacccaagttagatctaaaaaccttagcaggacttgaatattgaactacgtctgctggcagggctctgtcatcatggccatcaggagccctgtgcttcctgggttacttattcctgttttacagtgcacagcagacctattaagttattattattattattattattattattattatactttaatgtgcacaacgtgcaggtttcttacatatgtatacatgtgccatgttggtgtgctgcacccattaactcatcatttacattaggtatatctcctaatgctatccctccccactccccccatcccacaacaggccccagtgtgtgatgttccccttcctgtgtccaagtgttctcattgttcaattcccacctatgagtgagaacatgcggtgtttggttttttgtccttgtgacagtttgctgagaatgatggtttccagcttcatccatgtccctacaaaagacgtgaactcatccttttttatggctgcatagtagtccatggtgtatatgtgccacattttcttaatccagtctatcattgttggacattttggttggttccaagtctttgctattgtgaatagtgccacaataaacatacgtgtgcatgtgtctttatagcagcatgatttataatcctttgggtatatagccagtaatgggatggctgggtcaaatggtatttctagttctagatccctgaggaatcacaacactgacttccacaatggttgaactagtttacagtcccaccaacagtgtaaaagtgttcctatttcttcacatcctctagcacctgttgtttcctgactttttaatgatcgccatcctaattggtgtgagatggtatctcattgtggttttgatttgcatttctctgatggccagtgatgatgagctttttttcatgtgtcttttggctgcatgtcttcttttgagaagtgtctattcatatccttcacccactttttgatggggttgtttgtttttttcttgtaaatttgtttgagttctttgaggattctggatattagccctttgtcagatgagtagatcgcaaaaattttctcccattctgtaggttgcctgttcactctcatggtagtttcttttgctgtgcagaagctctttcgtttcattgatcccatttgtcaattttggcttttgttgccattgcttttggtgttttagacatgaagtccttgcccatgcctatgtcctgaatggtattgcctaggtgttctagggtttttatggttttcggtctaacatttaagtctttaatccatcttgaattaagacctgttaagtttttatcgaacaagtgggaagacatttgcaattcagaaatatgtgcattttgcaggaagatcactgttaaaagaaaagctttagacaaaataaatttaacaaagttgagctggatgcgataactcacccatatactcccagaaactgaggcggggggatcacttgaggccaggaatttgaggctagcctgggcagcatagtgaggccccatctctagaaaaattaaaaagttagctgggtgtggtggcacatgcctgtagtaagagctatatgagaggctgaggcaggaggattgcttgagcccaagtgtttgagcctacggtgagctatgattatgcaagtttaacagagtttatttaagtgaagaatgatccatgaatcaggtacctctcggaaacagaagaggttcagagagctccagcacagcagtgtggaccatgaacttttattggctgataaagaagtacaacaaaatatattttgttgatcagaatagaaggaccataattagaggttagttgttgatctctgcttgataaagtctccagttagaatctgttcgttggcaatttctgattggtaaagtctctagtttcattttattatttatgttgggcttcattttgcttacatgagaactcaaggtgctagagctgcaccagtcaagtggcatcccaattaaaaacttatcaccactgaatgtaagagttaatctaccatttcagcaaaatgactaactcagacaatttcttcaaactatttgaccatttatttgatcaggaatttctgcaggttcattttgcttttaaagctaataaagcccttttctctttcatagcctgaagtcctaatgatgcaattcaggtctggtaaatagcctaccacctaccctgttgaaatgatgggtaaagcattaatatgaaatataattttataggtattttctttcttttgaaaaaatttttattgagataaaattcacataacatttaaattcactattttaacaacttaaagtatacaattcaatgattcttagtatatttacagcattgtgaaaccatcaccattatctaatttcagaatatttccatcacccctaaaagaaacagtccctttcaatttccccttacccttagagccttttatgcctggcttcttttacttagcataacattttctaggtttatccatgtcgaagcatgtatcagtactccatttttatggctgaatatatttcattttatggatataccacattttgtttatccattcatcagttgatgaacacttatgttgtttctattacacataatagatttttattatcatatatgagtttccatatgagcgtatatcctcagttctatttggaatatacctaggaatagaactctgggtcatgtgtaagtcgatgtttaacttttgaggaactgccaagcgtttccatagcagctacattattttacattgccaccagcaatacatagggtttcaagttctctatatcctcccaacaattgttatttttcatttcattatttattatatcattctaatgagcatgaagtggtatttcattgtggcattgatatgcatttccctaatgactaacagtgtttaacatcttttcatgtgtgtattgatcatttgtatatcttctttagagaaaggtctatttatgttgtaggggaggaaaaattcttttttcctactaccctcctacactctctggctggggctgtgaacattggactgatcaaagacaaattaaaaataataaaacaaacagaagttattagcacatgcatcatgcttacacatgggagcactcagggtgagtaactcagaggcttgattagaacatgggcttagatggcatcttagcaaaggaacaatatatttttagagaagtcacaagacaaaggaaaaggactttgactctctaaggtggcaaatatatgggaaactaatggcagttcaaggctaattagtcaagtttgttttgcattttgttctgatgccctctcaggctgattagggtctcaagttatctctggtgatgaacttttgtccctgatagagaggggaggagaaatatctctgtaaatttatgttccaaatagtgagagtgatgtactgaagcctgaaaaggcttcttttcagttgccttcagctcaaagtaattattatgccaaagtgtcatattttggggtggcatattctgctaccctataacatccttagcccattttataattgggttgtctttttattatggagttgaaagagatctttaaatattcgggatactagatgcttatcagataaatgatttgccaatatttttatctcattctgtgagttagctcttcattttcttgatagtgtcctttgatgcacaaaagttcttaattttgataaactccaatttatctattttttcttttattacttgtgcttttggtgtcatatttttaaaaactattgccttaatcataggtcttgaaattttttacctgtttctttccaggagttttatagttttacctcttacattaaatttttgacctattttgagctcgttttttaatatgataggggtccaaatttatcgttttgcatgtggaggttcagttgtctcagaatcatttgtttaaaggactattctggctgggtacaacagctcatgcctctaatcccagtactttggaaagctaagatgtatggattacttgagctcaggagtctgagactagcctgggcaacataatgagactctatctctacaaaaaataaaataaaattagccgggtgcagtggcatgcacctgtggttccacctactgaggaggctgaaattagaggattgcttgatccagggaagtagagaatcacttgagccagggaactagaggccgcagtgagccatgatcatgccactgcactccagcctcagtgacagagcaagatcctgtatatatatatataaaaaaaaaaagaaaagagaaagaaagaaaggaagagcctattctttcttgattaattggttttgataaccttgtcaaaaattaattgaccgtctgacatattgggctggataatttaagaaagagaaaaaaaaattaaccatagaggtatgggtttatttccagactctttatttgcttgtgttgatctatatgtctgtctttatgctagtaccacactgttttgattaatgtacctttctattaagttttgaaaccaggaagtgtgattcccccaaatttgttctttttcaaaactgttttggctatcctggttctcttgcatttttatataaattttaggttcagattatccatttctccaaaaaaaagtggttgaaattttgatagggatttcattgaatctgtgtagcaatttgcagattattgccatcttaatgttaagtcttccaacccatgaacaaagggtgtctttccatttatttagttcttctttaatttctttcaacaatgttctatagttgcagtgttcaagtctcatacttctgttaaatttattttttaatattttattgttgatgctattataaatggaactgttttcataattaaatttttcgattattcattgctagttccccaggaacactgcactgagttttgtatattggtcttgtatcctgcaactttgaagaacatgtttattagctttgacagttttgttgtatatggattctttagggatttctgtataaaagaaagattgtgccatcgatgaatagagatagtttcattctttctttcccacctggatgccatttcttgctttttcctgctaactgccctgacttagaactttcataacctccttgtcttgtttttaggtagaaagttttcagtcattttttttcagtcactaagtatgatgttagctgtgggcttttgtagataccctttattgggttgaggaatttccctgcttttctagttcgttgagtattttttgtcatgaaaagctgttggacttcgtcaaacagcttttctgcatctattgagatgatcattgttgtgattttcccttattcatttttgaggtctctcttaggaaagtggctgcaaactctaaccctgccctgacaggcctcaaaagcgggttgctgtttacagtgtgtttttcatgggatacttctttattgtggtgggaagcctcatgtctaagatgtctcgttcacaggaagcttgtttatactggcaaatgcccttgtggctcttgtctaacttgtgttgtttatttctaccaagatagccactctctaagagaacttgacctgcaaagaagttaggtgtcagtcaagtgagacacagaggaggcatacaataaaacacatgaaattacagaatctgtaagtaataaaagttacagatcccagggagaagagggcagcatgccaaagggaagtggggagccatccaggacacatgtgttcaaccagtgggtaggagcaaaagagagtgagagtgagggatctgtgggccaaggcctttattggggtccaggatatcacctaagcaggtttcccacaggaatttaattggtaggtttacagcaagcaggcagaagttccatggaatgatgctgtgactgagagttggttgttgtggcgtatatgcacagttagctctgcagagtgtgggggacagtagggtaaatcaagtaggttgtatctagctatcccatagggaaggtgatggtatgaagcagatatctagatgaccaccttaaggaactgggaggaggcagagaactagaaattgtatcaagagtgactaagccctgcttctgatatgagaaaattaaaggtgtatccaaaatagatgctgagataacataaattataagagttaactataatcatgtaatttttttcttttattctattaatatggtgtattgcattggttaattttcatatattaagccaaccttgcattcctgggtaaaacctggtcatggtgtataatcttttaatatgctgctggatccagtatgctagtattttgttgagaattttttcatcaacagtcataaggaatatcgcgctgtagttttcttttgtttgtgatttctttgtttgcctttggtgtcagggtaataccagcatcaaagaatgattagaaagtgttaccttttctttattttaaaaagcttgagaagaattggtattaattctttatacatttggtagaattcaccaatgaagatatctagttctgggtttttctttgatggaagcttttgttgttgttattgatgtttttttagagacagggtctcactttgtccacaggctgaagtacagtggtgctattacaactcactgcattctcaagctctggactgaggctgtcctcccacctcagcctcccgagtagctaagactacaggcacacaccaccaaaaattaggcccagctaacttctaaaaaatattttgtggagatgggttcttgctatgttgcccataccgctatgttgctggtcctaaactcctggcctcaagtgattctcctgcctcagcctcctaatatgctgggattacaggcatgagccaccacatccacctaaaaaccttgcttaatacaaattagagccatatagaaagattagaacaatcctcaaatgtctaacccaataccattagaggatataatgataggaaaagacaagcttagggaagtttgactcatttccagggaggatgggtctaaaaagatacagaggaagcccaatgttatgagcaatctgcaagccagcaagtccaaatgactctataacagagaacatcaagtcagtagtcttgtttatatcattgatgtggtgctagaaccattttcctttttaaatttaaaactgaaatttgagattttctttacatatccactcatacatatttggcatgcattcactttaaaattctgtcattttaaaaccaaattatgttcggcttggtacagtggctcatgcctgtaatcccagcattttgggaggccaaggcaggaggactgcttgaggccaggagcttgagaccagcctacacagcatagcatgacccatctctacaaaaaaatttttaaaaattggtcagccatggcagcatgtgcccatggtcccagctattcagtaggctgaagtgggagaattgcttgagtccaggagttcgaggctgcagtgagctgtgatcatgccatcgtactccagcctgggcaatgcagtgagaccccatctttaaaataaataaataaataccaaattatattgttctttttgtttgtttattgtcgtgcatgtgtttgtgtgtttttgtgttatttatatgtgtatgtctgtctatctgtgtagcaaggagctgtacctccaaccagttcagttcctcctgttgccggggccccatcggttggacaacctggagcaggatttggaatggtgagtgatgacgtgtgctaaaaattgtaatcaacatttctaaataatttgccaaatcccaaattactaagtattcctacagaatataatttttcccaaaacacagtaagtaaaacttaaaaagttgtcatctgctttaaaccttaggtagtctacacatgaagtgataaaatgagttataaaatacttatgttctaccatcaaattaatttctatagtacattgttatatcatttttgctataaaatttacaaaatatagtattagcccaatcatcaaaatcaacccttcattattatactaggactttttactcaccaattttaccagccaattttaggaccatctttcataaagaaacaaatttttctctttccaagaattatgcttacagaagatgaataaacaacaacaaagcttggttgggatggggataccatgtggccaaccaggcttatgctacccacccaccttagcgactctctccctcacagtacagcctcacattatccctaattaaaattacaaattatgcttcctcatagtcctggattcctcaaatattgtcagaagtacataaaagcaataaatgtcaggatagtgccctagtgagttccactcatgctctgaaccactctccattcttcctcctcagcctcctgctgggacaggcatgcccatgatgcctcagcagccggtcatgtttgcacagcccatgatgaggcccccctttggagctgccgctgtacctggcacgcaggtcagtttcttcaatgtccacaaatcagtgacattaactaataagtgtaaaacattggtgtagcaaactgtttaaaaagtgtttttacctaatgtaatcctcatacctgttgcttcagaagtaaagggagcttggaagacagatctgcaaaagtgagatttgggggggaaaaagtgatggaaataactcactgtctaaagatccctccattctcttcctacttaattcatattggttcctgagaacatccagatattcagggcatccaaggcatgtgtcccagagaaatgaatgcttctggtctgtagttttagtatgtgttcccagcgttagccagaaaggttggcagcacagtcctccagactgccatgtccacccaagactcgtgacactaactgcaataagtttgccaaactgcaaagtctgtgagaatactcccttttagaatctcctcactccagacgcaagacacatatttgtgagtccccaggaccacccccacttcagactagctggctacaaattcgaggtttttccatggccaggttagatagtttcctagaatgattcacagaactcaggaaagtactaaacttataagagttttattgtagtaaaaggatacaaattagatccagttataggaagagatgcataaacatcatctgggaaagttctaaacatgaagcttctttgtcctcagaggtgggttctcctgtggacatcatcatgtgacagtacacatgcagtatcgcaagctcacctgagcttcagcatccagcatttattgatgcttcattatgtaggattggttggttgaattgttacccattttgtggaactcaatcttcaacccctgttcctccctgaagatcaggctggtttcatgtggcccaaagacccagccctaaaatctcatggttgggctttctgcctccactctgagtcaccttgttagcataaactgtcaggtgttgttcccagagcccaccttgaataacaaagacatgcctatcatttgagaaattataaggatttagaggttccctttctgggcaaaggaaaaaacctcagtttaggtaaagctaaattccttactacacactgtgctacttacccttcaaaaatgccaaaatatgttacactttgttgaaccgttttgctgctagtggtgctagtcttagtgatgaatcatgctttcctgattcctcttttaaattgtctggccaaggtgatgttacatgtagaaccaaagaagttttcatcatgagaaattgacttggatgggcaggacaccaaattactactttggtagcagcatgctttacaaactagagcaaatagctcaaatatattttaatgatatgagtaaatgttttcagtcctataatatttttaacttatcaaatcagtatttatactgtcttatccatggaatacctgctgctgtgaactttctgagtatactttaatcccttttgcttccttgatgcatctctaaatccattgacctgttcccaaaatttcctttcagcttcttcactttgcccctcaaaagcaacagggaccaagagaaagaatggtggatgttgaaagacagaaatttagaatgtgagaaaccctagccttcatggccattactggccataactggcttcaggagaaattttctagtctatgtgaagactggtgaaccctgtgtagtgttgtttttggggacagtcaggaaggttttgggtataatggttgaggttaggtataacttagatatacttaaattctaagggatctcatttatcataaatatttccttgatgtttgaatagttccatgactatcatctttttgaaaaaaaagaaatatttctgttattatgcacttggaacaatgttactgagatttcttttaaccttattgtgtttgatatactgaaagcttcagaaataaataaatataattttattacttaaggcagttgtttttattgtgtaataccaaagttagcaacaatttatttacttaattagaagaatgaaaatgaaaaatagatagtatgatgggaatacattgtttcaatcagtaattgaattcataataagccaggtaatgatacaccatatttatgtaatttttagattatatttcctatatcagagaagaagcataattatactagataataaaataaatgtgagtttgtagcttcagaaaacaaagtagtttttttattactgatgcctggactatcgcagcattctttcattggctggtatcatgatattgtcatctcacctaattatcaattatggaccaatctttgaattgatttaaggaagttcaagccttactttatttatatatatatctctctctatgaaacagatcccaggttttttgttgttatttttttgtttgcttatttgtttatttgagataggttctcactctgttgcccaggctgaagtgcagtggtgcagtcatagctcactgcagccttgaactcctaggcaacagggatcctctcacctcagcctctcgagtagctgggaccacagatgcaagccactgtgcccagctatttttttttttattattttttgtagagatgaggccttgccttgttgcccagggtggcctcgaactcctggcctcaagtgatcctcctgcctcggcctcccaaagtgctgggattttacagatgtgagccatcacacccagcccatatcccagttttaaacatggaaatttgacagatagataatataattagtcagtagtttctggacataggaccaaatctcaaaatccatacttctggaactctgttcactgaactaataaaaatatacaacactgccccacagtcccagcatgttactacaagcataggagattaattagactcaaagcctagatgtcaactattactctataaactacatgagatttttcaagaccttgtatcctgtaaaagtcagctcccagaagttatatctgtgacacaatgaaaaaataatttagattctggttaaacagaaacaaggcaagttaattatttgttacttttgcaacaagtccaatatgattctttcctatagtatttaataattagttttggccttctctgagagctgaatagattgcattagaattttagtggcattcactaccaggaaactatttggtcatgtgaaacaaacagtgccctcaaacttgactgattttcacttaaaataatgtatatgaaattctagtatatttagctaataagtgtaagtaatttcttaaatagctttctgcaaaccgtttcctatttttccttcaaattcactctcactacaggaaaagccatttaaatagatttattagtttagaggtactaatgactgaaagtaaaaatgcttttgtatagagaaaacggttgtttgtttgttttactgtttgttcataatatctttatgttactagtgtttcacatcttccctaagtcatacccatattgttctactggagtccccaaattttactttggctaaatctgatgtcagagaagttcaagaaagccaaatatcagttgaagtatattttaccagtccagaattaaacacaactctgtgactatgtagaacaagtagatttcataagcctttaaccatctaatcttctgcaggtttgttttctttgatatgtgttctgcctaatgcttttctctctctctctctctctctctctctctctctctctctctctctctctctctccccctctccctctctccccctgccccctcttccccccatgtctcattctctctctgctttctattcctgctctttggggctggctttttcccattagctttctccaagccctacacctgccagtcagagtcccaagaaacctccagcaaaggacccattagcggatcttaacatcaaggatttcttgtaaacaatttaaggtatctaatattgagcttttcctgtaggcttgtaataatgagctatacaatgcttagctatttcagaggtactcattatttctgcgttttgaatagctgtgtataatagtaataatttgagtgtttatacttttaaatttgatattaaaagctctctttaagagttttttaaatcttaatttatgtaactaggagggaaagtaacctccaaattgtccttatcctggaaagcacaacgattagctttaataaagcaaaaaggtgcccaagctacttggtaaattagaaaattaccactttattacatgatgacttgaatttatagaaagctaacatttatactattgcatttagaaatcatctaagaatatatttgactgcataattgtatttttattttgtttatccttcttttgcctcataaagcttagattattaccctttacatttctgcattcaagcagagttttaaatttctaatgttctagttttaaatttcacaaatttcatataatttatgaaatgactcatgctgaagttatggaaggaaacgaatgaaggaaaaatgtttactgttgaccccagcacctaacacagtgggtaggttctcaacaaatccttgctgaatggatgaacataatttacacggtacttttcacatccacttctcaatagaacagtcatgtgagataaactatccagatattttttgtctccatttcacagctaaaagaactgatccttgggcattaaggaatttgcccagggtcccacagggaagaattgtaagaggctcagtgtttttggactcttgtccaatgttgttttcagtatgcacctgctgtgctacatatatttcttaaaacccttccctaatgtctactaagatttttgtggattcttgatttgttttttttttcttatacaagattaatgatgcattattctaaggtattaacatctcagtcaagtaaactctccttatgcccaacttttctattccactttggattggctaatgtagacataagtgagacaatgaacacttaatagtttcaggagtgaccaaggaaactgcatagagcagcctgtattcacctcttacttagtaaatgttgccctaatcatatgccaggaactttgataagtacaggaaacagatatgcttgagacagtccttgcctgagagagacagagacagacaaagagaaagagagacagagacagacaaagacagagacacagagagaattactattttatgaagagttatctatgcggctaagccttaagaccccacaaatgtttccagcagaaatgaatgatgcatgaattagccagggagatgagtgggaagtggctgaggaaaggcatcgggtcgccagggatctctctgttctcttctattctgtcactggttcagctgtttagaaagtgactcattgaacaccataactgaatacatgaaaaaataatgtaaggtcattgccatgccccctttttctttagctgccctttttaaaggttggctgctcttagatactgaatgctataccgaatgtcctgctactaaaatttctaatatgtatctaaattcaaatttttgttgatataattattatctaaaatgaaactatacatcaaaagtttttttttaatttctggctaaactttaaaaattttaagcttgttttaaagagctatgaaaagtatgtaaatttgaatttgtccatgcagagacctttttatgtaaaagttgttttcagaaactatgaagtaaaattgcaagggaggtaaaatgtttgaggactatgtaataatcttgttttctaattctagtttttgttttctttacagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgc

SEQ ID NO: 58 - DNA, 575470 bp, Homo sapiens
atggctcaaggatccggggatcaaagagcagtgggggttgctgacccagaggagagttctccaaacatgatcgtttactgcaaagtaaggcgcctggtcaagtgccgtgcgtgctgtccgtgtggactgttgtgttctgtgtagggctgataaaaagacaaatgttttctgcctaaactgccttactgataaatgcatattttcttctcacatcctctggttctctagttctaaaattcaaggaagttcatacttgagcacttggtatttaacacttgaaaaatattatgccatttagttttctttaaacccaaaggttgcctaagcaatgcagatgggaagacacattctccttcagtggaaaggccttagtgtaagatgtatgaactgaaagttcttcagactcgtagtatgtacaaaatctgggctgaatgctgtgggagatagagaggtatatttgtatgagatgcttacagttggtaggagacataagatgtacacaaataactgttatagagtctaaatgttaatttccaaaatagatgtgcaagtagagtgttacataatttcagaggaggaggccagttctcccagcctcagaggtgagaatgggcttgtggaagagtggtctttgaactcagttttaaaatatgtgcaggattgctttatgtggaaagcagagaggaagaacataccaggtgatgagatgtttcagcaagggcacagagctgaggaaagtaacagcaaccggaactggttagcttggacataggatgcattacaaggagtaaatggagataggattttgggaagagaggctggctggagccagatgttagtgttgaattagacaatttaatcaagaaaaacttctgtgccaagagttgcaagattgagatctctttgggattatgactgttgccccattgtgctgaatggattgttatcaagatagagcggaggctctaggagagagatttctgtgtctgtgtgaaaggtaaggagggaaaggagagacactaatccagcctgtgaaatcaccttcagaattaagagaaactgataagaggaattaaagtctggattaaaaatgacttggaaactgaaggaatataggcggcaagtagagggtcaaagatgacggggtttttgacgttgggtaaatgaaaatcattggtgctattaattcaaattgggatatttggaaaaagaatacattttaaaggaagaaaatggcacataagtttattttagtacatgctgaatttgacataattgcttcttattgtacacctttttgatgtttgcatgtttgtgaaaatttaaactaactctcttgtatgttaataaggaaataagttaatgttcatttcactaactacttgagtttctactcagttctgtgcattctgagaggctctgtgtattacttatatgggcaatgtggaactagatattcctggatgatcaatatggtgaatttttctcttttccttgtaaaaatagagttctcaaattattctggctttgagtgtaagattctgtaattctttgctttgcaagagaatgtctagataacccatctctaagaatcatgcttattaaattgcgataaagaaaaaaataggttaatgggactcagcaattagtgaaacatacagaataatagacattgagtcattgttactttcttaacccacccccaaactgggagaccccgtgccaggctggtaggaacatgggctttggagtgagacttaggttaaaatgccaactttaccactctttagcagtatgactgtaagttagttctttaacttccatgagccacaattttttcatctgtaaaaagaaaaaaaaatgtgggaggaaggtaattgtgaagatcactttagataaatcgaatgaggcatcttatatcctacttagaccacaatgtggtccgtaatgaatatctctttttcttttcatgtttaggtcttgtagagtcagtgacacttggagaggaaataaatgataaaatctctaaatgttggtgctgttaataagttgtctagagcaaatttatacagtgagtttttttttaagacacaggaaaacaataaaaatatttttatattcttcagaggattgcaaattcatggattattaaagaataagaaatgcaaaggtcatgtaacccaaccacctttctactagaatgtttgtattatgtttacaggaaaaaaaaacttcctgcaggtttatgagaacttggtttttactttttggtggtagtaaggggcccttttctggtttaatttagtaactaacatgtcaattgctgtagttctttagagaaatgacaactagtaatgaaactatatcttactttcgtgtgacaaacttgtgtaaagagtatatatatatatatatatatgttcatgtttatttgctatattaattaccataaaagggacattgaattggttcagtctgttagaaagaagacacacttattgcacagtgtgagctcaggtcctgacaccattttaaacctagttaacctgactgacttaaaccatggttgtacttgaactatgggattttcatatagttttctactcctgatgctgtaggctgccttttggctacaaccaagaacttacttgctgtaggacattatcctcaaggtatcatcagtaagggttggattgtgaagccaatgacaattcaaagcattttctttggaagtccttttgtgtaatcaattattcaaagtcatagccataaacccaaacctttccttagatacccacgactacaatttacatttaaaaaattgtgctttcatttttgttttctttctcttgtttgttgttgttgttttttttctcttgttgtcagacactttcagtgtgaaatttttgcttggactgcattgtgttgattcagatgctgacatttaaaaagccaaatctagagaaatgaagcttttgggtaaactttcgagtaataagtggatgattatgtccataatgttgttgtgacttttaaatgacatttaggatggtaacctcctgacatatgagtaatgatgggtgggtttttaaagcccacacttttcagaacactcttcatttccttttcatgttttcatgtcattaactgtgagaagttgtactttcccaaggcatgacttatttattgacttgaacagactttctaatttagtttttcatccctcatattcacagtttggattggaggtgtgtatgaaaaatgtattggtcacattaaagatctatttaaaagaaaaccttaattattcatgaagacacccagacctgttaaccttttttatattcctgtatccttaggatcctgagttactgaattgcccagtgtaatgatgatatttgaacctagctatacatcacatcatttagggtgctttataaaaatgttaatcctcaaaggaccccctccacaaggtatttctatttaataggtctgagctgggtcctaggaatctgagtttcaagatgttctcaggaaaatctgatgcccaactaagtttgaaaagcacttacttagtcttttacaatatccagacatagtatgtgttgcaaagtaatgagagagttggtgttttgaattagatttttgatttcataattatttgtagatctctcaaaacgtagaagaaccaagctcttgtcatagggattttagtagcttttccttagatattttctagtcttattttatagatgaaagaactaaaagtatagagagggtgagtaacttgattaaggctcctcagcactttcccatggaagccataatggtgtccagggagcctggccactccaatcagttgcctttctagcaccctatgcgactaccatgttatcaaccacagactactgttaccacattgttggagctgagtagccatggggcacattaaattaatgaaaataatatgtggcagatctttgactttcatgtttcttctgggagagttgacttggattaatgtctcacttttttattgatttttaaaaaatactttaagttctagggtacatgtgcacaacgtgcaggtttgttacatatgtatacatgtgccatgttggtgtgctgcacccattaactctcatttacattaggcatgtctcctaatgctttccctccccactcctgccaccccacgacaggccccagtgtgtgatgttccccttcctgtgtccaagtgttctcattgttcaattcccacctgtgagtgagaagatgcagtgtttggttttttgttcttgcaatagtttgctgagaatgatggtttccagcttcatccatgtccctacaaaggacacgaactcatccttttttatggctgcatagtattccatggtgtatatgtgccacattttcttaatccagtatatcattgatggaatgtctcacatttttaatgctaaagtttcattctactcattggtgcttttgcttcttcggtaaagattttctaaaatgtttacataggtaagattgcttttgagtaagagtaggttgctttctgattttgtttggatctttggtgttaacaatgcctcttgacaaagttctcctaactagactggtaatttgatttgtttgggtcaggaggcatggaagacatcacactctggatgtcttctacatccagaaggatggaggcatggcagatgtcacactctggatgtcttctacatccaaaagctggaggctctgcctgtctggtcccagctttgtgtggagaacttcactttcctgattctacttcttgttttgttttctaccttcttcattcttttcctccttccttttcaattgtgagatacttctaacacaaaaagaatatattcagtgtccatgtaaagtagaaagaattaaaaaatgaattatatgcactcaccattagcttaataaataaaatgtaatactttggcctcatttccccttctgtaaagggaggaaattggtctaaaaatgtacaaatacctttctgcaatgatttcaaagttccattctataactttttgatctttcgtaaattagtacacttccctgatatcaaaacaatgttgtgagactatatgcacgtttaaaggtcttttgagcttttgaagaaatattttagatagttgtaggtaatctaaattggattgagataaagcccagttaagtcaggcattagaataaaaagctttaattgtaattatttaatattcaacagtggaatttagatgacatcttggtggcaacctgtttctttggcttgctaataacatttaagacatttataaaattatcattttgtagtattaattatatgctatatacataacaagtggtgtttaagtagcaacactgtacattgccagtagtatatagtgtcatagatgaaataggggttttagaggaagacaaaaaaggccaatgttcttgtatatcaacaggttagttgcctagcctcgtcactgatggcttccttcacctattcatttctagttattgactccttttctgctggaatttgagtctagcctttatgttgctctgataccccaaggtcactcttcctaatgatttagggcccttgaagtcctgggcagttgttggtttaggcatacatccagaaagtaaatgtcacactattttagttacattggctgtggtatgcagcaagaagggaaggatctagcctggaagaatccgatgctatggaggaagctagggatagagtgtggtttggaattcatagagggcagtggtagaagccagcacaattgagagtctggggacctgcaggtcctggtgactaaggcatgatgaggattagaaactgtcgaatcaggaaatacgtattgagtgtcatttgtgtgccagacactattagatgctaggaatgcaagatgagaactgagccctgaatgagcccacaggccagctgggggtaaatggggaactagacaattacagtgttggtagaagcaactgaggggcatgggaggaggtagaggggtcatgtagtccatcccaggagaggggatgatgatgtagaagacatccagaggatttggcacctgcttcgattcttgaaagatgactaggaattaaccagatggaggaggagagagaaggtgtaggaggcaggactagcacctgtaaaagagcagatttgtgatgtcgtataccgagttcaggagactttaagtggttgatatgaagctaggtttctgtgatgaaaggttgaggaatagagctagacagatggattagggccagatcacaaaagaccttatgtaccatgccaaggagtttagacattgtaaaagtatcttccctttgggcctccacacccaagttcaactcctttgcatgctgctgtctgccccagaggctgagctgtgaggactacatttacagggctcctgtgacctctgggtttcagttgggtttggttagtaaaagtctggaaagagatgggagggaaggagaatcgcaatgtcagagaatttcttctcctgggtctcactctgcaaaaccttgcactggccatatccgtctactgaagtttgttgattctctcaaggcagactactttcctcttctgggtccggacatcctttttgtctactcatccttttgggcctttgccgactactttcctcttctgggtccggacatccttttcatctactcatccttttgggccttggggtggttccagtttgtatttgttatctcttgctgtgtaacgagttatctcaaaactcaatggcttgaaaacatttattatgtcacaatttctatgggttagtaatccaagtgcagattccgtgagttctccagcacagtgtctttttaaaaggctgtgatcaagatgttgactcggattatggtttcgtctgaagtctcagctggggaaaagtctactcccaaacttacttgtgtgactgttggctggattcagctccttaggggccgttggaatggtggactcggttcttcgttggctgtttgccagaggccattcttagttatttatgacacgtgtctctccatatcgcagctcataatatggcaggttttttttttttttttttttttttttttatcagagtgacaacaggcagagaaggaagatgggtggtagtagtcttagtgttttataacctaattttggacatttttttctttattatactttaagttctagggtacatgtgcacaacgtgcaggtttgttacataggtatacatgtgccatgttgttttgctgtacccatcaacttgtcatttacattaggtatttctcctaatgctatccctcccccagcccaattttggacatattatcccatcccttttgatagtaagaagtcactaggtccacccctcactcaaggtgagggatttacacaaagatgtgaataccaagatccagaattcagaaaatctttgtgggccattttggaagccatctaccacacagctctacttctactagccaggggtttctgagtgttttttttttataatttccctgtaccctagaactcctttaaacttggtccttttggaaatacattttccttaaattgtcctatgtatatcatctgtttaccaataagaccctaacgaatgcaagtattatcccacaagcaaagggaagcgattgagactctgcgtttcttgataagggaattcttcatgaaagggtttgaagcaggggagtcatttgtccaaagtggaggatgggatctgaaatggggaagtcaatgtggagaagattcagtgtggaggtcaatgggtgatcgatgtggaagggttcggtgtggagggagagtgttggagaagtggtaggattggaggtaggaggacagtttagagattgaacaggaatccaggtgaggaaaaatgatgcccaaatcagtggcagtggtaatacagatgggaggatgtgtttgagagatgtttaggaggttcaggcaacagaatttgggggctgagaagacgtagggagaatttgagaataatgaggaggaatgaggagtcttttccctaggctatatctgtgattctcagaaagtctcctgggataaacttttgaagcaaatagctgtagaactggattgcctgcccctctcttccctgtatgtagataaattgagagagcccaagacagagtctgtaaatggaccaggatatctgggtatttgttctggctgccccactccactagctcatttatggccatgcgtaagttgttcctactttttgttaagtctagttctttaatttgtgaagtaaggggttagctatgctgggtgatctctaaagcatttttttagatctaacattctaggtcttttgtaatctaaaatagagaaacccacattttattattttactacttcatagcctcctttactttatttttaattttctttaaaaagtgaaccgagccaaaactttaaaaacaggtaagtcagaatgtttaaaacaaatggcttttggtcttcagcacttagggcttgttttttttcactctttttttttttttaacattaaataaaattcctggccacatgcagtggctcatgcctgtaatcccagcactttggaaggccaaggcaggcagatcacctgagatcaggagtctgagatcagcttggccaacatggcaaaaccctgtctctactaaaaatacaaaaattggccaggcatggtggcacacgcctgtaatcccagctacttgggaggctgaggcaggagaatcacttgagcctgggaggcagaagctacagtgagcagagatggtgccaccgcactccagcctgggtgacagagtgagactctgtctcaaggactaacttcagaaagtgttcagggtaactaatttaattgttcagtctacattttaagattcctttcattaaattttttgaagctttttttattgccttaggaaaaaactgttctgttttccttttcccccaggattagacttgctggaagaaaagctcccccatcacattatcttggttggcaggagacaggcatgcaggcaagtcccagaccagtggtatcagtgtccacagatgaaagggatggtatttttagtgtggggaatagctcagtgtggtttcatatgatgcattttgatgagtataactttctaatttgaaaagcctttggtgtgtttacgtcttcatttaatctttccaatttctccccctcatttcatttcaaggagtctaagatttttcattttggcaggcagttgatcactcttgttattgacactcctttgcagtattcttacactgtggagaacctgaatggctgtaaattccctattggcaggattttggagaaaaaaaaataaaagcgaatagatacctgtgaaagaaaaaataaatacattttaaaataattggaggatagaaggattacttttaaaagttctgttagtttgccagtacagagcaaaacagaaaatggacacatttttttgatcagcattctctgttctaaaaacttatttcaataagggaaagaatatgcaaagacatatatatagatatagacatacacccactccaaaagaatagtgatatctttctggtaaataatatccaaagtttggaaagaaatcaaatatccattgaaaggaaactaattttagggggataggattcacatttggaatgatctcatagttagtttactggatttctgttctggtcaacctaataattgtcttgaaagtgagatggctactgacattctagggtatggttagggagaatattctttatttttaaaaccctacaagattttttcattttttaaaataaaatgtcttatttgttaaatatgatggttatgtaggtttactcaaaagtgattttttccattgctctttattattttctgcatctctgtgcttacagctgaaataatttttagtattttctttagtgcaggtctgctgaagataaattctctcagttcttgtttgtctaaaatatctttgggccaggcacgttggcttacgcctgtaatcccagcacttgggaggccgaggcaggaagatcacttggcccaagagtttgaggccagtctgggtaacatagggagacaacatctctacaaaaagaaagaaataaaataaaaaaaaattagctgtgcatgttagtacatgcctgtagtcccagctactcaggaggtggaggtgggggaatcacttgagcctgggaggtcaaggctgcagtgggccatgattgtgccaccacactctagcctgggcaacagagtgaggcatggtttcaaagacaaaaagaaagtctttgtttcatcttcattttgtgaagggtgttttttctagatttagaattctagattgtcggttattttatttatcataactgtcattgtctcttggctttcattgtttctgttgggcagttggctgtaagtttgattattcctccttcgaatgtaatctgttttttcctttggctgcttttaagatttatttcactttggttttagcagttttattataaggtgtgattttctttttaatttattctccttagagcttatgagacttctttttatttggttggtgcttggggattctttttttttttgatggaggcttgctctgtcacccaggctggagtgcagtggtgcaaccttggctcactgcagctgccacctcctggaatcaagtgattctcctgccccaacctcccgagtagctgggactagaggtgcgtgccaccacgcccaaataatttttgtatttttagtacagtcggggtttcaccatgttgaccaggatggtctcgatctcttgacctcgtgatcctcccacctcagcctcccaaagtgctgggattataggcatgagccaccatgcccgactgtgcttgggaattcttaaccattaacttttcaaatattgtttatgcctagttttctcatttctctcttcttgggattgtgttcatatgttaggacctttttcctctagatttcatgtgtttcttatgctcttttctgtattttttattcctttgtcattttgtgcttcaacatggatattttctaccgacttatcctccagttcactaattctctcttcaatatattagataatctgtggttaaagtcatcccattgaatttgtaaccttagttattgattttttaagttctaaaattttcatttaattttctttttatagtttctagttttctgctaaacttctctattttgtcatttaattcctaaacttattaatcataattgtttcaaagtccatatctgatactttaaagtctttatcacttgctggactgtttctactaaccttttctttcttttttttcttttttttttgttcttctgtttatttattttattttttattttttttaattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccagtttcatccatgtccctacaaaggacgtgaactcattcttttttatggctgcatagtagtccatggtgtatatgtgccacattttcttaatccagtctatcattgttggacatttgagttggttccaagtctttgctcttctgaataatgccgcaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgtcttttggctgcataaatgtcgtcttttgagaagtgtctgttcatgtccttcgtccactttttgatggggtggtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgacctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttctccattgcttgtttttctcaggtttgtcaaagatcagatagttgtagatatgtggcattatttctgagggctctgttctgttccgttgatctatatctctgttttggtaccagtaccatgctgttttggttactgtagccttgtagtatagtttgaagtcaggtagtgtgatgcctccagcttcgttcttttggcttaggattgccttggcgatgcgggctcttttttggttccatatgaactttaaagtagttttttccaattctgtgaagaaaggcattggtagcttgatggggatggcattgaatctataaattaccttgggcagtatggccattttcacgatattgattctccctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatggagttcactcatgatttggctctctgtttgtctgttgttggtgtataagaatgcttgtgatttttgtacattgattttgtatcctgagactttgctgaagttgcttatcagcttaaagagattttgggctgagacaatggggttttctagatatacaatcatgtcgtctgcaaacagggacaatttgacttcctcttttcctaattgaataccctttatttccttctcctacctaattgccctggccagaacttccaacactatgttgaataggagtggtgagagagggcatccctgtcttgtgccagttttcaaagggaatgctgccagtttttgcccattcagtatgatattagctgtgggtttgtcatagatagctcttattattttgaaatacgtcccatcaatacctaatttattgagagtttttagcatgaagggttgttgaattttgtcaaaggccttttctgcatctattgagattatcatgcggtttttgtctttggttctgtttatatgctggattacatttactgatttgcatatattgaaccagccttgcatcccagggatgaagcccacttgatcatggtggataagctttttgatgtgctgctggattcgttttgccagtattttattgaggatttttgcatcaatgttcatcaaggatattggtctaatattctctttttatgttgtgtctctgccaggctttggtatcagggtgacgctggcctcataaaatgagttagggaggattccctcttttcctattgattggaatagtttcagaaggaatggtaccagctcctccttgtacctctggtagaattccgctgtgaatccatctggtcctggactctttttggttggtaagctattgattattgccacaatttcagatcctgttattggtctattcagagattcaacttcttcctggtttagtcttaggagagtgtatgtgtcgaggaatttatccatttcttctagactttctagtttatttgcgtagaggtgtttatagtattctctgatggtagtttgtatttctgtgggatcggtggtgatatcccctttatcattttttattgtgtctatttgattcttctctctttttttctttattagtcttgctagcggtctatctattttgttgatcctttcaaaaaaccagctcctggattcattaattttttgaagggttttttgtgtctctatttccttcatttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttgaaagaacatctttatttctgccttcatttcgttatgtacccagtagtcattcaggagcaggttgttcagtttccatgtagttgagtggatttgagtgagattcttaatcctgagttctagtttgattgcactgtggtctgagagatagtttgttataatttctgttcttttacatttgctgaagagagctttacttccaagtatgtggtcaattttggaataggtgtgatgtgctgaaaaaaatgtatattctgttgatttggggtggagagttctgtagatgtctattaggtctgcttggtgcagagctgagttcaattcctgggtatccttgtggactttctatctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggtatgattttgcagcggctggtaccggttgttcttttccatgtttagcacttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggcccccactctcttctggcttgtagggtttctgctgagagatccggtgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaaagttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacatagttgtcgagccttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccgtccagctttgttccgttgctggtgaggaactgcttccctttggaggaggagaggcgctctgctttttagagtttcccgtttttctattctgttttttccccatctttgtggttttatctgcttttggtgtttgatgatggtgatgtacagatgtttttggtgtgggtgtcctttctgtttgttagttttccttctaacagacaggaccctcagctgcaggtctgttggaatacccggccgtgtgaggtgtcagtgtgcccctgctggggggtgcctcccagttaggccgctcgggggtgcctcccagttaggctgctcgggggtcaggggtcagggacctacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggtgggcacccctcccccagcctcgttgccgccttgcagtttgatctcagactgctgtgctagccatcagcgagactccgtgggcgtaggaccctccgagccaggtgtgggatataatctcgtggtgcgccgttttttaagcccgtcggaaaagcgcagtattcgggtgggagtgacccgattttccaggtgccctccgtcacccctttctttgactaggaaagggaactccctgaccccttgcgcttcccgagtgaggcaacgcctcgccctgcttcggctggcgcatggtgcgtgcacccactgacctgcgcccagtgtctggcactccctagtgagatgaacccggtacctcagatggaaatgcagaaatcacccgtcttctgcgtcgctcaggctgggagctgtagactggagctgttcctatttggccatcttggctcctccctccttctgtttattttttattaagttctgggcattatacaaataatatagaagacatcatttacggctctaggacaatgttacgttacttctgagagaacttaactatttttttcttttatgtcagtcaaaataggaatggattaccttaatcaagtcagacacaaagattacttgtagctggacttcagttcttcttagggctagatatatttctagatctcctttactctctgtagggagcccttctggttccaaccaaaaccctgggtgcccctcctccttggaggactctgacctctaatttttgtcctttaaactctatgacactgccaaaagctctgttcagcttcttgatcatgccttttgtttaagaaattgacaatgctcttgagaagaacaagcagctccaattgctgggctcatcttcttagttttcttctttcaggtcatggcctcacaaactcttactgtcttggttgcttttcagtgccctcaaacatgtttaacaaaatgtttttcagcatttccagttgctctcatcaggagggtgtttctgaaacatctagttagccattgtcagaagtagaaccccagaacattggccttgagagaaggtggatccatcttttatagccttggtttgctcttaaaatgttttagaaaagacatatcctgagtgtcttagtggtctagcgtgatggtggtagaggtgaagaaaagtgaaacttccagtatatttaaaaagtggaattaacccgttattagttttagatggagatgagagaggaggattcagggctaatggccaggatctggactgggcatctggatgtccagtcactaggataagtggttgggttagtgacactggagcctcaagtcaccacagtaacagaatgacattcaccacagcctagttatgtaaaactctggacagagggaataaatccaggcaaatacctctacgtatgaaatggacctgaaaagaagctttacctggaggaaaccttacctgactccagagacctttttggtttagaaaacaggaagtaacttgtatctgtcagtatgacacttttgaacatttctgtattagtttgctaaggtgctgtaacaaagtcccacaaactatggcttaagacaacaggaatatattctgtcacagttcaggaggatagaaatctgaaatcaaggactgggcagggctacgctccatttgaaggcttagggaagtcccctttcttgcctcttccaggctttctgtggctgctggagatccttggtgttccttggcttgcagcagcatcaccctggtcttcgcctttgtcctacctcaccttcctcatgtgcctacctctgtgtttcacatggccttataaggacactagttgtgggatttaggcctacatccccatacccccaattgattgtgacctcatcttaatgaattacatctcaaagaccctaatttccaaatgaacttacatacgcaagtcccagggtttaggactacaaaatatctttttgacagacacaactcaatccacaacaatttctagtttatcaccgcgtgaagcttagtgctctctgcaaagatcaaatgaacaagtagtgtacttattgagctgttgcttctgacaaagcactgtgtggggaataaaaagtagcgtggcacacagtctctgtcctagacaactttactgtccaactggggagaccaagagtgatgcagaactcaggaggaaaataagctttggttggccacctaccatttaccagatactgcagtgggggctatacatatattgagccatttaatcatcagaatagcttgctaggtaagtggtattcaccctatattacagataagggaactgagggtcagaaggagtaaataactagtattaagtggtgctatcagaatttgaatctagatttgttgtattctaaagcctgtggttttggggaagaaactgaattatgttaaaaaaaaaaaaaaaaaaaaaaaacaaagctgttagaaattaaccataagagagttagtgtgagagctgggtgtggtggcttgcatctgtagtcctagctactgaggaggctgagatgggaggatcccttgagcccaggagtttgagaccagcccgtgcaatatagtgagaccctgtctcaaaaagaaaaaaaaaaagttggtgtggacaaggaaggcttattgaggaagaagaaatttgaagagaaatcatctgaactgtgtttttaagaaagggtaggagttggctggtggaaaagagccaaaaactgattccaggtgatgggagctacgtgaaccaaggcaaggggatagaatatatcagatgtatttaggagaaaatatattttataacactatatataagatacgtgctttatataattatagcctcattcttcatatggagaccttgaagtaagaaaacaaacatttttagctctgtgtctcacatggtaaggtattggtaaagctgagccttctgccaatgaattttttttccattcctcttcagaaataatcgctttccatttaaaaagtaataattcaatttagaaagaatcaaaatataaagtagagaaaaaatctcacatattcctatcatgcaaatatgactaaagttaacattttggtctcttcctcccagtccttgaatatgtatcagtagtatacataacacattaacctagagagtaatcatagtgtatgtgctattttgtgcttttctaccataacctaagcactaatctgtgccataatatgtcatcattatcatagttttatttatttttattatttttaattttgagatggagtctcgttctgtcaccaggctggagtgcagtggtgtgatctcggctcactgcaaccgccgcctcctaagttcaagtgattctcctgcctcagcctcccgagtagctgggactacaggcatgtgccaccatgcccagctaatttttgtatttttagtagagacggggtctcactatgttggccagaatggtctcgatctcttgacctcatgatccgcccaccttggcctcccagagtgcggggattacagctgtgagccaccgcacctggctatcatagttttaaaggttgaataatattctaagtagataatgtaccatgatttacttatttagggtttgttattaatagcaaattaaaaaattcctaggtcaaaatgcatgacctgtgttacaactcctattatatatatggttttctggaaggtcaatattgattttggcatatatagactgggcttctctgggttgttgtaaaagttctatgtcattgaactacagaaagagggtgaggggatttctaacaattagggccagtgttttcttcacctctaaaccgcatccccatcctagtgtctgcttggctttgcaacaccatccttatcctgagagctttgttgatgcctggggatattcagaaattttcgacttggaacccttccaagacatttgctattttattctctatttgtttttcttaagcaactaactaaataagaataacatttcaacctctttctactccccacagcattttttcctgcctgcaccacctctgcctacagtttaaccatggggttgcttcttatattttaaagctaaatacaaaagcacagttctgagaagcagccaagttctgcagccaagtttgaagaataaaactttaaaacagctcttctgtcacacacttgagaggggaggcaggctttgctataaataagtcacattccatttctatctcatcctttgcagtcctcttgggtaatgctttttgtatatgactacagtgttctcgaactgcccactcacccctttcaaccttccattttgtgcctcactttatttaaatgttcaatagttttggagtttagggaccctgcatgaaaggagtagacctttcctttcattcttcaggcttagatgtaatgagattcagtggctaacttattagaaactatactttctctttgtctgtaacgttttcagcagctgcctggattagtttcctattgctgccataacaaattgccacaaatgtaatggcttaaaacaaggccaggcacagtggtgcatgcctgtaattccagcactttgggaggctgagatgggattgcttgagctcaggagttcaagaccagcctggccaacatgatgagaccccatctctatttaaaaaaaaaaaaatacaaaagttgtctgggtgtggtggcgtgcacctgtaatcccaactactcaggaggctgaagtgggaggatcacctgagcctggggagctcaaggctgcagtgagccatgatcgtgccaccgcattgcaacctgggtgacagagtgagaccctgtctcaaaaaacaaaaaaccaagaaaccccacaaatgcattttcttataattctagaaatcaggagtgaaaaatgatttggcagagctgcatgccctcagggggctctaggagaattcatttcctccccttttccagcttctagaggctgcctacattccctaagtcatagccccacatcagtcccacctctactcttggcatcatatctccttctccaactctgaccttcctttctctctcttataggacccccggtgattacatggagcccacacacataatccaggggtacctccccatctcagagtccttaacttagtcccacctgcagagtctcttttgccaagtcaaataacatatttataggtttgtgggattagggtgtggacatctttggagggccgttattctacttatcacactgtcttagaaaaggaaaggaaaataattttggaatttttgtctttttcatagctagggaggaggtacgctgaagttttgtttttccttcctgtatttgtgatggttgatatgtggcaatctaaactaagtctgggatgtctgtttgtattggctgaagttcattggagggcagaaaagaggagagtttcagagactggcagtgaggatgggagggtggcttaaagaccttcacaacctgctcactgggtgctcctgttaggccccacaaacaagcccatgccatcgaggagaagtgaccaagcagatacattcaaaatgaataaaaggaagacctcatttactgtagtcccatccagtgtggcttccttataggactatttgtctctaattattttatttattttttattttttcagagagagtctcactctgttccccaggctggagtgtaatggtgtgatcttggctcactcagccttgacctctggggcttgatcctcccgtctcagccttcccatagctgggactacaggcatgcaccaccacacctggctaatttttaaacttttttgtagagacagggtctcactgtgctgcccaggctgggcttgaactcctgggctcaagtatatcctccctcctcagcctcccaacatgctgagattacagatgtgagccaccatgcttgaactatattttaaaaaaatattaattatgatactaaacaatacagtgaataaataaccttctcatgactgtccatctggcatagtagaagactttatgtgcttttttcaaacaatgagagaaagtgctggcatatcgcacttcccttagcttgagagacatgtgccaatctgcttgttgactctgccaaggcctctctttccgtcattttccatgttctggtcaggatttgtgacatatagtggctgacaaaaggcacacaagtgatagtgttggtggccaatctgccagggaagagtctgaccctgggcgctaatgtgactcaaggtagatgagcccttcgaggagctagtcaaggaaacagatgataaagtctaactatcagtgagcgagcagggggtgagcattttctttctgaagggagttattactgtcattaacttcattgcgttgctgggaaggaggggtcagtagttgaaacaaaagtctcctatggctgatgacatgttacaactttaggacagttgtcagcaagcaacttgctgttgggcctaatctgtccccatgcctttgatcccttgagcctcaggatggtttctacattttgcaatggttgaaaaactttaaaagagaagccatattttgtgacatgtgaacattatgtgaaattcaaatttcagtatctgtatatcaagttttattgaaacacagccacatcatttgtttatgaattatctatggcttttttttttgagctaccacggaggagttgagtggttgtgacagagactgtccgtatgaccggtgaagcctaaaatatttactaactggctttttacagagaagtttgcagcttctgttttcggagatttgaaagagactgaaaaagcatcggcaaatgtccttgttgggacaatatttccataggaaccaagacccagtgattccatgtggtgctgatttatttccaggaacccatggagggtctaactggggagggggtatacaagataaattagaaacaagtgcacattcctgtactacaaaaaatatacaagacctgccattcacccctcaaataatatgtttcctttcctgaggggtcacataatttatgccagtacattattgatgagatttttgtttgtttttttaaaataaaaaacaggcatattgagctgctggaagtgttgagctggctgttctgaaatatcccactaggatattccacttgctggctggctacctccatctcagatgcaatgtccaaatggctgtcaatttctgcaggacccactttgtgccaggcattgggccagtgctttgggcacgtgaattgctcacactgagagcactgctgtaaaatcattgttattcccatgccgcatatgaagaaaggagcttacactgggtaaacccatgcctgggcctcccctgtaagtgggaatcccgagttgcaggtcaggctgtctcttcttcacagaccatgctctttcacaagacctggaaggaacaagacaaccacctggggagctgcttacttctgatctttcctctgggatgccagggctatcacaacctcataggcaagatactctaatcactgagttatggtgttcggtgataatatcgacttccatttttataatttcttctagcactctgcatcctgcatgttatatttgtaaaaggcctgtgaaaaacataaggcagacatatctatttctgctttgtaaatgaggaaactgaagctcaggggtaaagaggcctttctaggctcaaccagcttttagtggcagagccagacctcttgacctggggtctggtgcctgtacactacttcccatgggccaggtctttgggaatagagctgcgtcactcacacttaccttagcagaggctgtgatagactctaagccgtatggtttttagtttatcctcagtgaacctcaggtcatcaactgacctccagagacgaatttcacgttgtagatggttttttttgttggcattactttacaactgtgactctgctgaatgcactgtacctttctctttcctattaccacatccattgcttgagtttcagtcctgtcttagtccattttgtgttgctgtaaaggagtaccagacactgggtataaagaaaagaggatttataaagaaaagagggttatttagctcacagttctgcaggtgtacaagaagcatggcaccggcatcaacatgtcagagaaggtcaaaggagaagtgagtacgtgtgaagagacaccatacccaaagggcatcctggctttacataataataaaccaacctaatcccatctcgccagagtgagaacagcagcccagcacgaagtcattcatgagggttctacgcctataactcaaacaccttcccctaggccccaccttctgacaccaccacagtggggagcaaatttcaacatgagatttgatggggacaaaaaatcccattatccaaaccatagcaagccccaatccaaaccaaaagcagatccccattcgtggttcccctttccacatggttccaaatgaggaagggcaaaattcatgtgttctgctcagtaaaaggttgaaaagttattgggaaacacatcttccaaggtttgtgtcctttgggacatgggaatatgttattaaccaggacagctgctcacagctgcacagggatgtactgaaacagctcattttaagcaaattttaagtagtggagaggatcattcctgggcacatttcacaagcattctgtcttggttttaccccaatctctgcatattccttcttcgtcttcattcccggggcagcttcttctgcccaccccgtgaaactttggcccattcttttctgtatgctgtccaggggccatctcctcctctctacatgctgcattgaggatccccaaattgctatcctctctccaaactccaaatgcctatatccagctaccaaaaagacatctctgtttgaatcttcctcacttaccacaaacataacaggtagaacatagcttatttcttgccctgccaaaactgttctccttctgagcttcagtgcttggtgtagcatcctccacatagttggcatcggaggcagaacctgaacctgattctctttgacaggcctaatcactcaccactctacgcaatatgaaaatgacatgccatgtgaatccaatgccatgtaaaaaaagataacattttctgtttgtctccctaggatattgtaaatgcttggcaccaagtaggtgataaataaatgtgaaggacaaacctgttgattaagcgttcctgagacatatcctttatctttctcagatgagattctctgccacatagcttatccctgtattgggtggattgtgtaactctgaggttcaaacattgggtattgcctctaaaccttgcacagttatttatctcagaactattgagtttggcggctgtccacatcatgtaacaattctgctgttaccttcctttccttgttttcttccttccctctctcctcatcttccacattcctatctgtgagagaggatgagaaaaaaacagacaagaagacaaaccaatatttctctcaccaatgaaaaatacctttccgttctgtttttaccattaaatgtggtatttgccctctgtgtctcaattaaaacaggttatttccttcttagtttcttcttttatattttttttcttgtttcagaaatggttcatgttaattgtaaaagaaaaattccgaaattatagataagccaaagaaataaataaaacatgtaacaaccccctgctcagagagttgtggttaacttttgaagtacctacttccatgcttcttttctaggtacatattttaacagaaatagagacttactgtacttgctgttgggaagcttcttttcacataatagattgagaatattttcttgtgacagtcaatattcctctagaccagcaattggatcactttgtttaaagggccacatagtaactattttaggctttgtgggacttactgtctctttcagctaatcaactctgctgttataagtgcagaagcattcacagaaagtgtgtaaatgaatggacatgtctgtattctaataaaactttatgaaaacaggcagtgagccagatttggcccatgggtggggctgtagtttgcctatgcttgtctagaatatcttttttttttttttttgagacagagtgagacagagtcttactctgtcacccaggctggagtgcagtggcatgatctaggctcactgcaacctccacctcctgggttcaagtgattctcctgccttagcctcctgaatagctgggactataggcctgcgccgccatgcttggctaatttttttgtagttttagtatagacagagttttgccatgttggccaggctggtcttgaactcctgacctcaaacgatcctcccaccttggcctcccaaagtgttgggattacaggcgtgagcccacactccactagaatatcatttttaatgcctaaatagtgttctatcttattgatatatcattatttacttaaccagtcagagtaatagctaatgttgtttgaggccttactctgcgcttgcaacattgcttcgtttgttctatttgcattctgacttacacctgcccacagccctgtgtagtgtaggtattattctttctatttaacagatgagggaactcggataaagaacaggtgggtaatttgcctaaggttagatggttagtaaatagaaaactcaaaatttaaatttgtttgatttttagaagccatgctcttaactactcattatgtttttacgcacgttagtaattatttgcttggataaattcctagaattagaataacacatgcattttaaggttttgatatttgttgtcaggttgatatatttggccaacttatatttcttgagtggtatatagcagggctgtgtttctacacccttgtctataacaaggactcttttgacgctttgctactttaataggtaaaacaagcttcatctttttttatcttatgaatactctctatatttcttctaaggtgagtgtctgatgcatgttctttctccattgttcaataagagcatttgtcttctctattaatttgttggagccttttatgtaagggacttctgtggtttttaagttgatgctacatgacgtgttatgaacatagccttttactttaaggagatgttgtctttacaattgaagataattaaatggaaaagtatttagttttaatgcagcattaattagactcctggaattgaaaaaattcccagaaactgtaaggtaagggaggacttactcctgttggggaacttgtccctttagtttccatctcttaagtactagaatttgtgttctttaattggaaccattgctttgctgtggccatggcaacacatcttagctgccatgaacagcgcacactttgacaaaatattttttttagagagtggcttttagatggaattcattttccaatgtattcatggagtctagatgaattaatggatggtagacccatacttttataataatagtaataataatgaaatgaatagttactatctattgatcccttactgtattctagccacaatgctttattttatattatttcatcggatctttgtgataatcttatgtcatagatattgttgttatccttactttatacataaagaaattaacacagaagagttaagtggcttgctctggcttatacagatggtaagtagtggagtttgaccttgaccttaaccttgattttctactgcgtgagtcttacaggtttattatagcctttagggtatatactgaattcaacagtggtagcatggatggcaaatcttgatgtcatctagagtctaagatgacactagcatcagtgggccacagggaatctgacccagactttcataacttgtattattatgaagattagagttctgaagcttactggattagaagagcacgagggggtagctgccccaatatattctaatttctcttgaggaccaccaaattggcagagtgtctctgatagggaaaaggaagagttggaaggcatcttagcctctaggacagaagaaccatttttattggccaccaaagttacatctagttgcctacaaatttatatccaaactccttatcctgccaattcagggttctgcaaactgatgccaaactatagtttagtcttctatcacatgactgcattatacatacccaattatctgggcaaacagacctgatccaaacacagtttgtactttcctttcctttcctttgtttagcctgttccgtctacttggggtgtctttgatttctccagcctcagtctcccgctgttagaattctgggcctccctcaataccaaggttaagtagtacctaacgaagaattttttatttttacagacaaaagcagtttctctcctcctctttgattcttatggttatttatattactctcaagtcaatcataaccttcttatttgtaggatagtttctccctgtaggacttgcaggattcctcgaatacagtgcttttccaaaggtaaatgacgacataccttaatcttgttgttagggattctgactctgagagacatgaaaccactgtttagagtcttgttatgtatgaattgtgtccccctccacccagtccatatgttgacatcctatccgcccatgtctttgaacgtactttgaaatatgattgttgcagatgtaattagtaaagatgaggtcatacaaaagtagggtggactcctaatccaatttggccgtcacactggaaatttgggcttgcacccaccgagaacattgtggaaagattggaatgatgctgtcagaagccaaggaactaccagaagctagaagagaggcctgaacatacccttccccagagccttcagagggagcatggccctgccaacacctaggtcccagacttccagcctctggaactgtgggacgatacatttcttttgttgaagccactcagtttgtggtactttgttgctgtggccccaagaaagtaccacaagcctgaggttttcaccgtccttacagccagcaagacgggatgtttcagatgaccctgtcctatgtggaactgggggctgaggtggggtggcctgataacagagtcaccaaagagctgcctctcttatctgtactcctgagttctcacagccttctgggcatcttcagcaccagcaactcagcatgtcaaaactgaacatctttcctctccaaaccccttttccctcataagcccatctaaattatggttaccatgtccctctcagtccctctggaattcttcccttttctcatccccaattgaaaaaaaaatctggaattctatgttcttctggaaaataaggaagatctggcaacaccaggcctttgttactgcatggctataattggccagatggatgggctgcccctgaacatagagaatgtgtcctgggtcctgtttgacatcgcatgccagaccctgtgggcattggagcctggcccctggcagggtggaagtgattgcctctgcctcacagggacataagtggaaagcttcagatcattctctgagtcaagctgtccggtttatgtcctgctgtgtcgcttactggctgggggcagccatgggaagtttccttgatctccctgtgcttccgtttcccagtctgtaaatggagataataatggtgctcgcctcataggggtgttgagagaattaaatgatttaatgcgcatcaggagattggaacctgacacgtagcaggtgcacctgaaatgttcccttatattcttatgtagtcaagaaaatcttgtcaccctttatctaaactgctttattatttttcatgacgcacggcatatttacttcttggttttactttgctactctccatcccccaccagcttgacacacattcagaaaatgtggccatagtttatacacatagattcagggctggcctaccaaggagtttggacaaagctcccgggatctcacttggtggagctcctgggcctctcctggctgccgagtcccctgtgctttctgccttctgtgttgtttcggttccagtgaccaagggcacagcttggtgactggcctcccgaggccttccgagtcaccgggggatccctctaattaggtacactgttgagcatgcaggtgtatatcctgcaggcaagaagggctgctgaaatagtagcttaacatgaaatccaggcagcaagtcgggtgttcgttagaagtgtgtttttttttttttgtgatttgggacactgacaaagcccagacaaacctccccacaccaattgtttcccccagctgtattccccttattgggccactcctaagcagtgctgatgacttatttagctaatatttgttgactgaatttttattaatcaatagagatttgttaagtaaatggagcattattcagacatgtggcatcagatccattactagatgtaagtgataaataaagtggtaggtaagacacagtcctgcctgtaagagatgtgcaatctagtcattgagagagaccctatgagaaacagtgggtggagctgggggattaccggtgttgtttatgggatcccagagaggaaggaccctgactcagcctgaggttgggactgggggcaactgggggatcatcagacttgtcattattgatctaatgtcccagtaaaattgggcgttttcaggacagggactgtgactgtctttttattgctctatgtcttgtcctagcccagtggttgacatataacagacggtcaataaacatttgatgagtaagggaattaagtgacatctaagctgagaactgaaggatgaggagtctgccaggaggaaagtgtgggaggtaggggaggaagggggtggcgggaggaagtaaaatgatgacgaaggatggtacagggagggaggagcatgtgctccttgagggtgacaaggactgcagttctgggaactgttagcttgtatggtgggtggcatggagccatttcaaggtgggggcctgggcagagctgaatggtgagaataacatagagttcttagtttttacatgatgaggtttgatatgcatgatccaaggtgcaggaaatggattggagaggacagggtggaagaggagaggccattcgatggctattgcagcaatcttgagagatggtggtggcaggacaaattactgacacctgagatggagaggtgactagattcagaagcaactagggatgtagaattgtcagaacctggcaattaggtgtctgtggggaaggaaggagagatgtatgaatgatgctcaggcctccaggggatgtgggcaccacttacttgtgatagatgagaagaggagctgtgagaaggttaaattcacacttgggcatggtgagtttgagatgcctgtgggaagtccagagcgcagttgtatacagcaggcttcacctccagagagtgatcagatttgagatacaggtttgaacactcattggcatagagggtcagggcttcatagcctagaaggacatagataaaattaagaaggcctatgaacttcagaaattatattaaaatcataatgcatgtgcattgttctgaagagctagctttgtatcaacttttcaaaatgtctgtgtcctcaaaaaggttaacccttggtgcatatggttaatgaagccagaaggagagatgagatttttcaggcagcaagaagggaagagagccagggtttgtgctgcagaaaatatcaacatttcgggggtgggaggcactgtgctgagtcagaggcctgggggtcagagttctgggaatgagataaagacttacaggtagcaatagctttactgttcataaagcacttttacatacaatgccattttatctctcaggaactcaactagatctttataatttggctctgtatcagttagagttcagtacaagacatgaaaacttggctataaattttaaagaagggatttcctagagggaataggtgcttactatggacccagaaaatctgagataggtctcagttaatgtagaaagtgtattttgccaaggttgaggatgtgcacccatgacacagcctcaggagggcctgacgacgtgctcaagctggttggaatgcagcttggttttatacagtttagggagacatgagacatcaatcaatgtatgtaagaagtacattggttcggtgtggaaaggtgggacgactggaagcaaaggcaggaagactcaaagcggagagggagcttccaggtcatagataggtgagagacaaacagttgcattattttgagtttctgattagcctttccaaaagaggcaatcagatatgcatctatctgagtgagcagagggatgactttgactagaatgggaggcaggcttgccctaagcagttcccagcttgacttttccctttcacttagtgactttgggggcccaagatattttcctttcacattacaaaatctctggaagggcagccccagggaaagattcccagaacaatatagaactaaggtcagagtacatccctgtagctgccaccctggcatcgaaaagctgggactggaaagccaccatggctgcagctctttctcggccttcatggagctgaaggaaggatgctggacactactgtattaagaaatctgttttcgtgacctgccttgatagcagtgaacagtcaaatagaagccaaagcatggccctcatctcacttccaccttctagaactccttgcttgagtacatttaattagtggaatccacttcagtcctgaatctctagatgcagagaagtctggaagatatctttataccacctctcttcctaaaaggagtgtgaaatggagctagagaaggggtcttattttgtaagggtcaagttaagaactgtttcagtcttagtgagccatgtggtctctctgcagccttgccattgaagtgtggaagcagccagagaccatacagaaatgagtgagcatattgtgttccaataaaactttatttataaaatcaggcctggcacagtgtttcacgtctgtaatcccagcactttgggaggctgaggcaggagtgagcttgattgtgccacagttctccagcctgagcaacagagtgtgagaccctatctctaaaaaataataatgataaagttagttaattaaattaaaatgagtgatggggcctaaaggccacagtttattgacctctgaggtaagcaaatcaattctcaataattatcgtaggttcttttttacagatgagggaattaaaaccggagagcgtcagtcgaagtgaaaataagtcctggttatttagttttcaaagttcatgttctccaggaaatcctgatgctcagcctctcctcttacaaggcttgtgatctaaaagaggagataaaatatgtactttgttggtgcagaccatggtaaatgctcccgggatggtgcggaatgcttttgcatacaaggcatttttgacaggagaaatcagaagtatgatggtgaaagtagttttagctagatgttgaagaaaggtataactctaacaggtggagatggagaagggaggagtcaaaagagctgatagggtttggctctgtgttcctgctcaaatctcgtgtcaaatcataacctcaatgttggaggtggggcctggtgggaggtggttggatggtgggggtggatccttcatgaatggtttagcaccgtccccttggtgctatccccgcaatagagttctcatgagctctggttgtttaaaagtgtgtagcacttcccctctctctttctcgtgctctggacatgtgaattgcctagctcccccttcaccttccgccatgattgtaagcttcctgaggcctccccagcagctgagcagatgctagcatcatgcttcctgtacagcctgcagtgcatgagccaattaaacctctttttttttttttataaattacccagtatgaggtatttctttatagcagtatgagaactaatagagaatttttgatggagtcaaaaactgcaagagaagtttaggaaaacagctagaaatggaaactcatctgaacattgtgaccttctatggtgttagtggagataagactggatcagggagaaccttagatagtaggattaggaatccgaacttggaaaaggggaagcactgatagtcttcgagcagggttgtgatacacacattacctcaggaagaattatctggttttgttctacagaattttgtgtaagtcagaagatacagccagcaagaattcgctcaggcggttgttgtaatatctttacatgaggatgcaaaggaagaagtggacatgagtcttgggccattcatgggacagggcaacttgtaaatgtaggtggaatagaaggatggctttgatgggaagagatgaaatgaataacaatacttgggaaatttgaggaatgggagcttgttttgtgggtaaagtaatgggccccatcttggatatgaggtgctgaggggcagaaacggaaatatggagtaggcgattggaaatgttggcttcatcttcaagatggggttggttgggagtcatcccatacaggtggatagagagccaagtaagagctcagctctctgagggagtgtgtacagtggaggatgccggaaggagaacccaggagacaaaggtattccagaactgggagagggacaagagataggaaaatgtagtaggcagggtagtgagagtggcaggatggatgttgtaccagaggagtcaagttagggagctatttccagaaaaagaaagagccaggaatgttgcatgccacagaaaggtcaagaaatactcgaaaaaccactggatttggtgaccacatctcaaggtcatgggcgaccctgagagagctgtttagtgtgtgttcttctcttgaggagtttcatattgaaagaaaagaggagagaaaatgggagattgaaatttgtggcttgttttaaagtggattaattcttcagtgccagaagaccacaaagaacttggtctgagaatatatcctgatttctccccaagacttttcttaagaaaaagcaagttgaaagaggaacaccctttagtttcgttctctcttgatttcaggattcggtttttggtcagttgtttgtgtctgactccacttttggccctgtcgtggggccgctcctggcaacctgggaggtcacgcacaagtgtgtgcagttgttaagcaactgctcgcagtcgcggtggccctgctaaattgggaacatgtattcgtcccagtctgagtcttcattcagtgggaaacaatgagtccctgactttgaaatctcagaggttacacatttgtggaatatgaaatcagtgtgttgatgatttttcctacctcatagaattctttaaaaataacactggagaattgctatgcaattctgtgaaaatttagttctctctagggccttttctagaaaaaacgttatgcccaaatcccaaaaggaactgagtattttatatcaatgctttctaagataaataaaaacagaacacacacacacacacacacacacacacacacacacacacacacacacacaacgcagcaacaacagcaaaagtcaataaaacaactcaccaaactaactctagagtttcagatggaaatgatgttatcagtccaaattaaagacatattctcttattttcttttacaccttggtttgtggcttccataatacaatcatctgagtcttgtatggtttctgaaatggatgctagaagagataacttgaatgagtacttttcccctggtggaattctcttcctcatctatatttaaacagttgttttgcacctaaagggccctaagttacgtttctctggagatatttagagataagaagtgttgtaagtactctttcacatttgtgcagaactttagtctttgaagtgtttagacatccattaatctttttttttttttttttttttttttgagacagggtttccctctgctgcccagactggaattcagcagtgcaatctcagctcactgcaacctttatctcctgggctcaagtgatcctccctcctcagcctcccaagtagctggcactacaggcctgcaccaccatgcctggctaatttttgtattttttgtagagacagggttttgccatgtcacccaggctggtctcaaacaatctacccacccttgcctccaaaagtgctgggattacagacgtgagccactgtgcccagcatccttaatctcattctacctcactttctgcctattgagagataggcaccccaagtaggaagtccaaatgctgataaagaaattgggattcagagtgacttactaactagccccagatcacacagcttattagaggcagattcagggctaaaggtcagattttccagctgcagatttattctgctttgagtggcattttagacattagtgttttctttaatccttaagcatttcagtgtctaaggtttgtataacatcaggttggtttctggtagtacgttgattgtggagagggcccagaagcagaaaccacagtctttacatgatagttactcttatctgaggtttggcctttattgaatggaagtctcttgttaaagaagggtatgcattgaggcaagagtcttgccaacttttcaaaaaaaaaatgggaacccctgggctccttggggatggctaatgacaatgattatggaggaggctgcaaatgtgaagtactttataaatcctggaggtgtggcagtagactgtgtgtttctggggagacagatttttgcatacattatcctctggacacttctgcctttggtgcatgcttgtttttataaaaaagcttgttttgttcctcctgtagaaatgagcctatcatctagagtcatggtggttttctgtatgtgtgagcttatgcttcagttacactgaacactcgtactactgcaaaatcgaattcagtgacattgccaatatcttcgctctcagtagtctttaaatattcttagccctgggaactggcccaagaaactgcttattcttttccctgtatcacttagcatataaatcctgaattactgctgactgaagatacataaagtacaaatcaataagtattttgtttctatattttggagaatgagacaatgagtgaaagagaacccctcaatgagggctttaaaatattgtcattgttctatggattagtagagctgcggctactattttacttacccactggccaccaggtactcacactgcagtgaaaggattcctaaaaacatctttattaagatattcacatactatacaatccacccatgcaaaatttaccattcgacgttgttggtatattattactttgtaaaaatcatggccctatgcacaacatacaacttgccactttaatcattcttaatgtacggttcggtggcactaattatgctcacagttttgtgcaactgtcactgctacctatttccaaaactttttcatcatcccaaacagaaactgtgtacttattaatcaacacctccccgtgaaagaatttttaaacataccttgattattagctttggatgtatataaaacctttaaggaagattttgtttagtctgttttttttcagggaaagtttattttttaaggggcagttccatacagtaggtgacacaggttaggttcctccagaaagcagcctcttatagtagcatgtgggacattgccagagtctcaggagcaacacttctaggggatgggggaagggatggagggaggactgggtaaaaggagaacgtgtactgtgttgtcattggaaggcctcaccctacccagtggaactctggaactggcatttcccaagttggggcaacagggatggatctttgtaccatatcattcagtcatagggttcagctcccaggacggcgcatgagcttggacaaattctctccagccaagggtcagagaaggttgacagctgagagctaagagccagcagctgaggggtgaaatgctcagtccatactttgccaaactttgctctccactggaatcacctttgcatcctcaaaaatactacgcctgatttaattggtatggggtaagagacaagtggaatgcttccaaagctccccaggaggtttgaatgggcaacacagattgggaatggctgctttcagtcttgaaggggagtcagcatagtatacatcatcatgggaaatgcctggactttggattgaaaaaaagttgaacttggctcaaccatttactgacgttgtagttcttatttatgttctgttaagattttgctactaggctttaaaaaatatgaatggatggtgcacctgggtggctgagagggcacttacaaattaaaacaaaaacagtgaacacctccagaatttgatagaacacaagaatgcataattcataaagaagaaattcaaatgctttttaacatttgaaaatatagtcttaatagcaactgaaagaatgaaagttaaaactatattttgcttattatattagcaaagatgaaaaataattgctattgctcagtaatggtgaaggtagtggcagaagacactctcaagctcagcacagtggttcatgcctgtaatcccaacattttgggaggccaaggtgggtggatttcttgagctcaggagttcaagaccagcctgggcaacatggtaaaaccctgtctctacaaaaattagccaggcatggtggcatacacctgtggtcccagctactcaggtggctgaggtgagagaatcacttgacccccaggaggtggagcttgcagtgagctgagatcatgccactgcactccagcctgggtgacagagcaagaccctgtctcaaagtaaataaataaataaataaaacaaacataaaagaaggcattctgatcctcttggtatgtccattggtgtaacacgaatggtggaccatttggcctccattcatgtgtctaccaatgcaatgtagataaaaattcataaaaagcgaatgccttttgacataacaaatctaattctagaagtttatcctgaggaaataacagaagagtatgtaaaaatgtgtgcataagttgtaattgcctgggtcttgctggcaattaggagaagcacaaatggtcattaataaaatattggttaaataagttctggtacatacctatgtacttctaatgagagaagccattaataaaatagtgtgagcctatttttgcattaaaacatttgcattgaaaaatgactttgagaaaaatatcagatgttaatggtaaacagtgtttttccccctgagtataagaattatgggtgaattttattgtctaactcatatctctttataatatttatacttagaaagtattacatgttatttaattatgtgttaattttatattcataaagagcatagagctatttccaaaaattacatatttccaagattacacacctgcatatctctatctatctatctatctatctatctatatctccctattcattcagcaacctaaaatgaaacagcctataatccaattagtagttatccctagaatttgaggtcacgggtgatttttattttctttcttgtgcttatttatactttacagatttttataatgagatcatatctctcttataatgagaaatgttttaaaaaagcttttaatatctcagtgcacttgcctgacctattttatatccattcttgcatctatttcatttgaagggtcctttggatagcatttctttctccatgtctttcttcctgctgtcctatttaaataatcacaattctgtgttgaaatttttgtatgctttacctaattaggacaaatattctgactcttgcatttgttatcaagatgtacatttttactttattcattattgttttttttttcttaagcaaagtttggcctttagatgatgcatttccaagcctagcatccatcatctaccattatgcttttgactcatctattaaatagtaatgtgtcctccaaaaatattgatgttaaattaaatgactctatatttgtccttggaaaaagctttgaggctataaaatttaccaagcaggtaggacatgcaaaaagagaaatgcatgcaaatgcttcctataggcaggagctcttcaatgtgtctgacaaatctcatctatcctttaggtcctaaattaaacatcacttctctgtgatgcccaccttgactttcccagggtaagctggtgctgacttctccttatgtttattatgcctcttattaaatcttattttaagtagttattgatgtctaccaatgcattagaccaccagataggaaatatggttgccatccaccaacactcttccaacagtccctacctcctcatattcaagcccctgacaaatagatgatgacagacgcgaccatatgtcacttccaagattaggttttgaaagacagaggtttccgtgttgggctgtttctcttggcccactaacctatggaaagctagctgttgtgacgataggcaatgtatgcagagaggctcatgtggcaagagctaataaaaaatggaagctggccacacacatgtgagtgagctttgaagcagatcctcccccttgtcaagccttcaggtattacaggcctggccatcagcttgattgcaaactcataagaaactctgagtcaaaaccgtccgtctaaatggctcccaattcctgaccttcagaaaatacgtgaaacaataaattcttgttgttttcagttttgagttttaggatagtttattatgcatcagtagataactaatccacattggtactagaggtgcagtgcttatgtaacaagaaactaaaatgtgataggactttgaacgaggcagcgggctgtggaaaagctgtaaggattaaggaccatgttagtaaaagtgtaaagtgccttgaacacactgtccatagaagtttggactttgaggaggctgccattgaaggcttcaaggaaaatgggagaaatcctattggaaactggaaaacagagaatctttgttacgtagtggcaaaaaaaagaaagaaaaattaacaacactgtcacctgcagtaatgtagaaagtagaaaatgtgcctgataaactggtgatatagttaaggagatttctaaccagagtgctgaaagtgctttctgattttttttttttcctgttgcttagagtaaaactgcaagaagagaggagaaactgaaggtaaaactattaaataaaaaagagccaggacttgctggttttaaagattcccagcctccccacatggtacgtgatgctaaaattaagaaatggcatctgagcaaagaccaaattcagggcacttttaggaaaacaaggtccaaacattaagccaaggatgcgactataaagtcttttcttaacatctcagtaaacaaagatagtgtctcagaatactgtttagtcagaaaaacctaaagatactaagacaagcttgtccaacccttggcccgccggctgcgtgcaacccaggatggctttgaacgtggcccaacacaaatttgtaaactttctcaaaacattatgcgtggacctttatttttatttttattttttagctcatcagctattgttagtatattttatgtgcggaccaagacagttcttcttcctatgtatctcagggaagccaaaagattagacacccttggacgaagggcttgccttacagatcctctctatcaaccagtagtgctccctggaagctcacagacattgtacctcagtccaagctcaagaaggacctgtttcaaagagatttgtgggtgtggcttttgtgtagtggaattaagcctaaagggattcccagaagacccatggagttgaaagggggttgtgcttgaagaaacaccatcagctggaaagaaaagagacataaagagtacaaaatgcagagaggcctttggaccaccaagtgtcaacaagtaaaaagcagactgagaaaactaactccccaagcacatgttacctttcatgaaaatgaaaggatgcctgagagggcacactcaagatttcaaagggtgagactaaagccatagagaaatattcctaggccttaattagagaccaaatcaaggagcttccatcatttgcttgcctggatttcagaactactatccttgcatacttcccattttcccctttgtgagttggagtgtctatggcagttatcctctccttatcctgcccttgcatgttgggtgcatggggccagataacttgtttctttatttgcacatgcctctatatcaagaagaaccacattcaattgttgtatgtcagagactacacccaagaaggctgatttagatgatgagggtctggacttggaactgatgctctgttgggatgagacttttggggacagtaggaggggtgggagtccttgggagccaaagggtgtcctgtgttaggcagcctccaagatggctccctttgatctctgactcctggactcacagagttgttaatcccctccccatcccacattgtactagggttggcctgtgtgaccaattgcaaatggcataagtgatggtatgtcgctctcaatattagtttattaaagactgaagcttccattttggtcctgctctaatcccgtgctttcctggatccctcacggtggggaaagccagctgccataagttgaggacattcaggcagtctggtggaggcccacatggtgaagcagttccagccaatagccatgtgaccctctagttccaatcaaggcttcagatgatgcagaccagattgacagtttgactgtaacctcatgagatactatgtagaaaaaaactgctgtaggccttagacttctgtacttacaaagacttcttgcaaaattggcttggctggcatccaggaatttggatttaggggaggcctgacaccatttcctaatggataagagtggttcactgtgcctaaactgtaaacaatattatttatgctgagcacttgctttccatatgggagtcttggatttttatatgtgctaggcagagggtgtgtaatgagcaaccctcagtaaaaaccttgggccaggagtgctggcttacgcctataatcccagtgactcaggaggctgaggcaggagggtagcttgaggctgggagttcaagaacaacctgggcaacagagcaagatgccatttctgaaaacagaaaattagccacgcatggtagtgtgcacctgtagtcctagatactcgggaagctgaagtgggaagattgagcccaggaagtcaaggctgcagtgagccattaactgtgccactgaactcccgcctaggtgacagagtgagaccccccaccccaaactctaaaaaaaaacagacaaaaacattgagcactaagtctgtgataagcttccctggtagacagcattttccacttgtcacaatacgatgctggaggaattaagcccatgctgtgtgattccacagcgagagaactcttggaaacttgcatttggttccttgtctggcaaagagaaaaggtgctgattttgctttatattcttttgctataataaatcctagctatgaataatattatatgagtcctgtgaatcctcttagccatcactgaatctgggggtggtcttgaggacctccaacccagagctcctgagctaggagcacctagatcttcctagaccctcagaaaccataggataataaatatttgttatgttgaggcactgagttttggagtagtttgcttcacagcaataggtaactaattctggaagccagtcatttctctcttcccagcatttagtttagtgtcttggaacataggtgttaaagaaatatttgttgagtgacttgacactatttctgcctttgaagaagttcatagtccatttggttcctttgctggaggaatctaaatcctggcttggtattatgaagcaggcttactctcttttttctgtggcctagaagaatcaatcgcagtggcagcagcctgccttaacgttgtcaggttctgccatcttccctgttgaatgagatccatgggtataagaattagtgtatgaccatgcctcttctcttttactcacttcttaggtcctttgatttttattttctctcccttctatgtcatggcagtggtagctattcttactattgaaataaaaacttcttcctgctgaaaaattaattaccaaatgtttcagggccttataagatattaatatttccatatcgagtcttgcctcttactctatcatatgattgccttgaggaaagttcagacaaattaactttccattttacattgcaccccactttcccagcttctgcaaactgtcttgaaatagactttatagaaagataggaaccatttccactaaaatgagtttaatgtagggaaaaaactcaaagtatacactgaaagtagacttctttgagtcatttacagttaaaaattattttaatctaaaggtgtatttgagtgtgtgcacaggtatacacatagaccgccccccaccccatactcattcctgtggcacacttcttgctagttgttggcactgttaaataaaaattacagggggccatcgttttggactaagcttctgcacttggccccaacaaaccagattgaaaatcaaaatggagtcactcatgctaaagttccatgtcaccttccaataaatcaggggaggaagataacaatctaattttccaaacagggcagtttcaatcttcaatcagcctgatgaagttctctctgctttaatccttacaacaaaaagtaacctgaaggaacgtgatgttaactagatatttttttctctattgttctgttttcctgttcctggattacaaagaaagtaactatgcaatgaccaattgcttttgttctgtgtttctgctttctctagcccttttctgcttacaaagccaaccatctctgcccactcattgcagcacttattaatggcaaaaccgcaatacttttgcaccaaaatatttaatggaatgaagtgttgttctattctaaaattgcaaataaagctacttgagctcctgaaagtaaatttgttgtaattttgtcctttgacagatccttttcctcctctttgagtctccttccggttcagcagatgaccttggttatgagtttcatgagaatcccagggtgatctaatagaagctctctcatttatcttctttccatctaattttttacaatttttattgttttttcttgtgtcagagaatcatctacctttgtttcaaagggttctagtcctgctttcaatcccatatacttgggcctgatggatctttcgaaagtgaaattgtggcctcatgatggcatcatttgaaagcctccgatgactgtttcccgaggagggtgaactttctctccttacctgctcttgctttcctgcctccattttgctcatggcattcccttgaattaggttctatgagtggaatacagctttgaaggcaattccagagatccaacaaaaacccaggagattggaaggaattcatatttgtcaaaaaatgtgtagctcaaaaatataaaaaaaaaaaataatgcaaataaaacccaatagagtataacaactatttacatagcatttatattgtattaggtattataactgatctacagatgatttaaagtatagaggagggtggcataggttatatgaaaatactacaccactttatattaatataagagacttgagcatctgcagattttggtatcctctgggggggtactggaggcaatcttcctgggatactgaggggtgactgtaacttattttcagtactttggtaatagtgtatttaacggtctattgtttctcagggtttgtggatgatagtccattaggatctgaaaataagatattagaagttctatttacttttttttgtttttctgaaattttaagtgtatatgaagttaagggaatacatgtaattttgaaataattaaatattcatgtttggaaatctgttcaaatttttgggtggctgggaacacaaccaaaaagatatgaaaaccaataacaattatgtatcagtaggcattttataaatagtctttgatattattttggatataagtgatttgattggcacttctcatttaattgcttattaggtgggtttctgttttgtagagaacatttaaaaaaaatttagacaagcaaaagttaataaaatcacctgtggtatgaccactcagaggtaagtataatgaatgttttattgtatcttctttgcagctagttttctatacacatagacatgattttcttctaaaaaaggaaagatcatgatgtatttataatttgtaaaacttttataccttgctctttgaactttaaagaatgtcatgaacatttccttagatactaaactctttccccatatattttaatggccttattatatgaacatataaaaataatttattttgataccttaattcatgtgctgttggatttttaggctcttgcaccattttccccacttctctgcttgctgttataaacagttctgaaaaccagatgctgttagccacaccatacatatctgtgatgtttcctgacaagattcctaaaagtagcaccttcctttcataggtgaggttttacctctacctttgttgtctgtctctaaggcaaaggcaattttgtgtaatggtgaagaactcaggacagaatttgaattgtgcctcaaccagttactactgtgtgactctgggctagttgtgaacctctctattcctcatttcccctcatctgtaaactgggggaaacactaataccaacattgctgggtggttgtgagcaaacaataaacaaataatagtgtaagcaaacaataaattttagcaattgtttataaggtatttctcttgtcaagtaagccaagttaatcatctaatggctcctataaaataaagcatagggccaggtgcagtggctcatgcttgtaatcccagcactttgggaggctgacgtgggcggatcacctgaggtcaggagtttgagaccagcctgaccaacatggtgaaaccccatctctactaaaaatacaaaaattagctgggtgtggtggtacgtgcctgtaatgccaactactcgggaggttgaggcaggagaatctcttgaacctgggaggtgggggttgcagtgagccaagatcacgccactgcactccagcctaggtgacagaacaagactccgtctccaaaaaaaaaaaaaaaaaaaaaaacaacaacaaccataaaataaagcatagttatagtattcagtaaggtgaatgacacattaatgactccattttccatttgatcagttcttacatccaggaaccatgaacacagctatctcaacatatggtagtttatagggatagtctgtaatcttgcaaatttaaaaggtaaataggagtccttcagtaggcagattcatatattgacaaatgaaggaagaattagtcttgttagaagaaacttgccatttcgtttgtgaacaatgtagttaatttatcacaggctcagtgagggcaaggatggagctatttcactttactatttgtgtacagatccagctcttgggccgtggtaggcactcagtgaatatttgtgaaatacataaatattcatgagcaaatatatctatactttgttgaatgtattgcaatgtatgttgtaaacataatgaaggctttgtgtgatgaaccgacaattgacaatgaaattattgtctgcaaagtgggctggggccttcaggcttttctcctgattatagattcagaaataatgcaagaggctgttgctcaaagtgaatcccttactccgtgctggtcgtgttctttaattcatgtgctgttcccttgtgtgtgctcagtccttattgcagctgctgggtctgagctcactgtgaaaatcgtgtttcctttctgccgacccatagggctcagtgtttgattaataagtttcccattttctgagaaaaatacctaggtaaatcccccttggacagcacaaggatctgcagtaatttacaaccaccgtgtgagccttgtgttgaatgacatgctctttgtaaggatatggcataatttataatgctggccccaacgtccactcctagggcgttctcagtgcagtgccttgactctgatattggataatgttgacagttaagagaggaatgactttagttgctgctgctgaattaaaaaagtcagacacacagtctaaatggattttgctgtcttcaaagtagtgaccttgggatagatagaactctttgatgcttccattgatgttgctattgccccaaacatttccggaatcctttaaaaattacctttaaagcatgtggcacattcttgtgaatatttttgagtctaacaaatactcattctttgtatgaggctttgatttttggaaagagtgaagagtcactggcatcaagtgcaacaactgaggtgggtgatgagggcagagagtgctggttttgtttagggcaacatatggttttagaggccttttaataatgtcatgagacttgagcatttgttctaaacatgatttccttttaaaataatgtttgaaatgatgaaatagtccaagcctacagaacacaacattacatgccagataggcacgttcccagcatggatgttaaacagatgttaacgtgctgtgtttgtttgcgtgtgttctttcatcttgctctccttccctgttttttctttgaaagacagtgttttagatattcctaaacaccccccgcttccctccatacccgtctgccttctcccctttttccatcaatattcatacttctgccaatgttgccatgcttcattcccaggtgtgcttgtaccttttgaggaaatgtttagaaatttaaaggaattatcttgtgtgtgtccttctaacattgtctttgaggtttatccatgttgatttgttttaactgctgttttagtccatttgtgttgctataaaggaatacccgagactgggtaattaataaagaaaagaagttcatttggttcctggttcttcaggctgtacaggaagcatggtgccagcatctgcttctgctgagggctcccagctgcttccactcatggaggaaggtgaggggaaaccagtgtgagcagatcacatttcaggaggggaggagagaaagagagagaaagggaggtgccaggctcctttcaacaaccagctcttgagggaactagtggagtgaattaactcattactgcaagggcagcaccaagccattcatgaggaatccgccattatggcccaaacacctcccatcagttccaacctccaacattggggatcaaatttcaacatgagatttggagaggacaagcaaaccaaactatagcaactgctccataggattccagtatatacgaataaatcaagagtcttcatctgttcacctgagagaaagttcagatgctttcaccttttttgttattacaaatagtgatacagtagtaactgtgtgcatatctatctagaaatatgtactagaggttgtctagagccagtactcagaggaaaaatggctaggttctagaacgtgcacattttaacttagtggacattaccaaattgctctccaaagcagttgtaattatgcttccattggtggtttcccatatcctcttagttatcagatttttaatttttgctaatccgattggcacagaattgtatctcattgttttatattgcatttctctgcgttctagtgtgattgagtgtctcttctgtactcagtggccgtctgagtttcgtcttttgtgaattgcccatttatattccttgctagtccttctattgccattggcctttttattaatgatttataagaatcatttataatctagtattctttgtcagtttaatgggccccaaatatctttactactctgtggcttatgttttgactttttatgatgtctctaattaaacagccgtgctaaattttaatgtaatcatatttatccatttctcctttgtggcttgtacttttttatgtgtttttaaaaagaaatactgctctatcccaatgtcataagaataatttcctatacattcttttaaagttttcaaatgtagtgtttcacagacacttagaattgatttttgtgtatatgtaacattggaatccacttttatctttttccatatggatgtccagttgtctcagttacatgtatcaaatcttttcccactgtcatacaccacattcccaaacacgtgtgactgtgtgtggcttctgttctttattttatttttatgtttatttttattttttgaaacggagtctcgcactgttccccaggctggagtgcagtggcttgatctcagctcactgcaagtgctgcctcgcgggttcacgccattctcctgcctcagcctccagagtagctgggactacaggtgcctgccaccacgcccggctaattttttgtatttttagtagagatggggtttcaccgtgttagccaggattgtctcaatctcctgacctcgtgatccgccctcctcggcctcccaaaatgctggaattacaggcgtgagccaccgcgcccgactgttctttgttaatggtgtgtttgcttactctggctctaccctattttaattaccttggtcttataggtttgggtagtttaagtttcacttcagttttcttttttggaattttttttggctattctaagctcattatactttaaactgtattttaggaatgtggaagccctattgggcttttgttggaattactcagatggtttacagataaatcgtaagaatttgctctcttatcctgggtcttctcatctacaactatggtatagctatgtttatttagttctctttttaggtctttcagtagaattttgtaatttttgccatacttttcttacatatctttgttaaatgtctttgtaagtatctcatttctttctttcatttgttcctttttttgagataagatctcccaggctggagtgcagtggtacaatcatagctaactgcagcctcaaccctcctgggctcaagtgacccttgtgccacagcttctttctaagtagctgtgactacaggtgctcaccaccacatccagctgatttaaatttttttatcccacattttttgttgctgtcaatgatatctttttattgtatcttttcctattattgctggtgtataggaatgttatttttgtatatcttgctgaactcattaattttcatggtttagatactcatacattatgcagacagataaaatcttttaataataatgacaggtcttttccttttcatgttatgtggcattcacttctttttcttgtcttgatgtactgacttggactttcatgatatcacctgtttttgttaataaagttttattgaaacacagccacatccatgttgtctgtggtaccattgtattataacatcagagttgaatagttgcaacagagactacctagtttgcaaagcctaaatacctgccttcaggctctttacagaaagtttgcctatcttcacaaaacagggttgaacagaggcagtgatagtaacctttcttgtctcatccctggctttaaaaggagagcttgtgccaccaagaataagtgctgcttctgggttggttgatgtgtgccttttattgggttaagaaaatgtcttttttttttcttcaacttttattttaagttccagggtacatgtgcaggatgtgcaggtttgttatataggtaaatgtgtgccatggtggtttgctgcacacatcatcctatcgcctaggtattatgcccagcatccattagctattcttcctgatgctaccccacacctcacaggccccagtatgtgttgcttcctcccatgtgtccatgtattctcattgttcagctcccacttataagtgagaaaatacagtgtttggttttcttttcttgtgttagtctgctgaggatgacggcttccagctccatccatgtccctgcaaaggacatgatctcattcctttttatggctgcatagtattccatggtgtatatgtaccacacaagaaaatgtctttcttagatttgtaggaagtcttttcttgtttgttttgttattaaaaaaaatcatgattgaatgttgaattttatcaaatgtagttttggcatctgattattttttctctcattttaaacatacgcaattatattcttttgaatttttctattatttctagtccttggggctagaatccgcccctttgatgtgcttttataacttgtgatctcagtgggtctcattttttctgtaggaattgtctgcagcatggattgtgggaattttgctctggcattttccctgcccattcattagtccaggaccaatttttatgtgaatttctcagattgggcatttccggaccatataggaagcctaaatttgtaccgccaaaatgttccagaggcggtggtctggagtttaaactttgcaagggaaggcttttattctcctcccttggagacagacagaaacatacgagtctctttgtggttgcagctctttgaggagcctcactcagggcagcagccttctacctcgggcagagcccacagactttgcctgtttctcctctgtgctagttgaaatctaaatgcctactccccctggaccaatacttgtttctctccttctccctcaccatgatcctgtcactctctaaggggagtgaatttatgcttgcttctggttttagttgttgctttgtttctggcacctggtaatttcttctttcttattgcaggttcagctatgaatttaaaaatatatataatatttccaggtgcttgtaggaggtgagtgtgaatgtgtgtcttctcaccctcttgctgaaatgagaggctgccctctaaatgaaatttcaatattgaaaagataaaacccaaataaaacaaaaagcaaccccccaaatcagctccctaaccatgagccaggcagcacgtgaagtcctttgatattagctcatgccattcttatagaaactctgtaactctttttaagtggagaagttaagaaactggcccaatcccatgtcagggcagagccaggccaaaaacccctctgttttattggctgttacctcattttacatgtctgaacagtaataacagtgggtgtcaagtgtacctttcctaaaggtaactactacaaaggtcaacactattttccatctaacactcctaatatatttttacacattagtctcacctggtaattctaagatagaataatgatcatgcttgtctgtgagaattagcaatttttttcatggatttaagttcaagaaaaatcagaaattagcagttcaggagttttcaacatttgtaaaaaggcagatgggtgcaccattagcacttccttctgagtgaggtagatctccagggaattaataggaacccgttgttttccatgttggcaagatattagagaaatatgtcttactctcaggtttactaagacatgttttaaagataatactgtcatgcatgtggcttatggaaggctatagggatgtggatttttatattctctctagatttatttgcccatactctgaaatcaaggcagacggtaaaggtggagtcagtggtcattctgtttttttgattaggggtttatagatggctgacattttaatctcagttaatgactggggatggactccagggtccttcaccacagctcacccttgtttgtgatctaatttagcagcatcttgatttgaattgaaagacagccttgggaatattagctcggcccttgtgagagcattctggaatgctgcatattacctgatgctacctgagatgtaggtggttgggcagtgacagcctctctgagccctgacctgtcggggagaggttgagaagtggcaaaactttgattctaccagctgcaaagaccgatgtcaccatgaagttatattaatgactttgacaagaattttctcagtgtacagtaggcatatttgctgaatgagctgatcttgtaatcccagtatatctggagtagtcaattatgaattttctaattagcttgatgtttggtctcccagctaagtgagctcttgtgaactctgccagaatctggatttccaaattatctgacaggaggaaaggaaaggattgggccaaagtggccattgcaagtcagtttcttataagtcaaaaatttaatcagaccaagtgcctttcttttctgtgttcagaaaatacccattctttgtttctcacaactgttaacctgtcctaggatgaactggttctgcctccctttgctgtttcctgcattagtacttggaaaagcctgtggctgcatggtctgaggtgtgaccttcatggtgggcacaccttgtctctcttctctgcccgaaaggaggccactgttttcttgtctctgtaactgctctgtgaattcttcttcttcctgatgactaagtgtgactattctccaaggtctttatctttttgcaagttttctgagatcttcaccaataagcacgaatacttactgaatatgttttgtgtgccaggcactttttaaagcactttaataacaataactaatgtttattaagcatctactgtgtgccaggcactgcttttggtacaaaagatgtgaaataaaccacacaaagaccatccctcttggaacctatgttttattgagatccagccaggtggtagaacacatcagtaaacaaacatagacttcagcaggtggtgacatgtgctctgaaggagaaatggagtccgagtagagagtgactatgcatgatgaactggtcaaggaaagtctgtctgataagggggtatttgagaagagcacttctccaaggaagtggaggagcaagcccagtttgcttccaatttcttcctccttgtgtcttgccaactgggaccaagcatgcctggcgtggaacaaactctttctgttctctgctgatggagccattttctcccagagcccaggctctaggtctgaaccctgatccttctcttcacttttcttttctaatggccagacgtctttgtccttcctttgaaatagaagtgacagcaaaatcttctttcccacagccgttgtggataggaagcctctgcctggctgagcactttgctactttatttctgaattcctgtgccagcctcctcaatgatcttagctgctagtcttgctcttctcacccatctgtggccaccaaagcactggaacacgtaagccatcatttgagtgcttactccataccacacactggatcctcacaacttgctgatgctattacaatatgttttttttcttttttcctttttctaactttttttttttttttttttttgagatggcgtttcgctcttgtcacctgggctggagtgcaatggcacgatctcagctcactgcaagctctgcctcctaggttcaagcaattctcctgcctcagcctcccgagtagctggaattacaggcgcctgccaccacacctggcttatttttttttgtatttttatagagacggggtttcaccatgttggccaggctggtctcgaactcctgacctcaggtgagccaccctcctcggcctcccatagtgctgggattacaggtgtgggccactgcgcctggccttttttttttaaagttttatttaggttcaggggtacatgtgaaggtttgctatgtaggtaagctcatgtcatggggagttgttgtacagattatttcatcagccaggtgtattaagcctagtacccaataattattttttctgctcctctccttctgccacccccaccctcaagtagaccccagtgtctgctgtttctttttgttcataagttcttatcatttagctcccacttataagagagaacatgcggtatttggttttctgttcctgtgttagtttgctaaggaaaatagcctccagctccatccatgttcccacaagagacatgatcttgttattttttatggctgcatagtatttcatgatatatacgtaccacattttctttacccggtctgtcattaatgggcatttagattgactccaccatgtctttgctattgtgaagagtgctgcagtgaacattcatgtgcatgtgtgtttgtggtagaatgatttctattcctctggctgtatacccagcagtgggattgctgggtcgaatgatagttctgcttttagctctctgaggaattgccatactgctttccacaatggttgaactaatttgtttttcttttacaaagttttttttcaagactagtcaagtacactagtgagaagggagaaaaaagtagagcaaggagtttgatctgtaactgactgaacaatcaatggagatacctcttacctttggaccagttgctattacaattatgattcccattttgcagagaaggaaacagactttcctatggtcacttgctaatacaggaggtggctaagccaggatttgaactcaggtccaatggaatccacaggctccttccagccaccagaccaagcttcacataccctgctgtggagcaccatggagaccctggttcgctctttcactctttggctggctcaggattctttcatgcttcctattatcagtgggataaaagtccaaatgttctggaataatatttgagatctttcatgcctggaccgtacttcacctgtcttctggttttgtatctgagctccctcctgtaacaacctttgctgaacatactcaaatgtatcatggaggtaaacacagcgatgcctacgtttatacagtgagtgctttttctttccctttacctgaactcactctttcttcatgccccagctcagactccacctcctctcttaccttcgtctgtgttcatctatacttccaaactctcctgtcagttagaaggcgtgtcctgcctgtttcatgtcattcctaacatcagaggacatagctcttaaagatcttattaccaacttgccatttccatgaatttccttagcccttgatcctaaactattgagaaagcttacatatccaaaatgagtctaacttttctaagcaatggtcttgggagatgtacatatttcactagggcttcctggagctggaaatatatttggtggagctcctttttctaaattgccttccggctacccaagaaagtcaatttccttctttaatagctgtgactcatttttggactgatgatggcactattccagttcagtcacctatctgagtcatcagtagggactccatttaaaatttgactctttccctaaattgaatcaattctcaagggattaaaactagatattcactagaacattccccaggaaaatttagaaatcagagttctgaaaatgtttgctcaaaatgtcaaggggtgaaactgagagaaggcaactggaacgtttctcttaatccactgtccctcacttacctgcttggcagaaagaaggcgggggaaggaaagcattagaataaaaagagaaatgttcagaggcagtttgagtcatgaggaaacagctaaaacttccaaaacagaaactgaatgacatcctcttcctaattcaagccttcctcaggggaaaattgaacagaacatttcacttgataaatggaatgagacctggtcctggagtatttggaaagatgaatgacaggcaggaggaatacagtggaagggaatgccatttatttacaaatgcatctcctcaggtaagggaggggatttcacagagagagggaggtggaaccgcagagggcttggtccaagttagaacatgaacttactccttgctctcgtttctgggggagaaagccatgtatacctccagcactcagaagtgctcgcgacaatgagctcattgggatttgctactcaattagattctgctttgtacatgtagcacttagcactgtgtctagcacataacgaggactcggtaaatatttgttgaatgaatgaaaaataattgctgcctgggagaagttgagaggctttgtaattctgccctgtcatttctggtagtgaccaccaggtggtgccttcttaagaacaggaggaaataaaatcactccagtgaacacagaaggcttggggttgactcagaaccttgcccctgtgcacaccgtctaacagtacatcacaatttcttgttcctaacgttgaatgtgcacacaggattcagatacgtggctggcactgactttctttacttgagtcaaggtcaagtaaggttttcatcgttggctgagctctgggatttaaaaccagttctatcccaggccaagtgggtttctgttgttcctgcttatcccctgtcctccaggagaacacatgctgcccttgcttccatattttctcagaaattcgtccccagcatcactaatggattcatatccagctcttgcactcacgggttgaaaaacttggtacccctgtgtattttaagcagctacctgatgagtacctatgttgaaataggtttctgtggtcgaaattctcagaaaagtcccacaagatgggcataaatgaacaaactagctcagcaggcttaggtggctctcccaaagtaacacagataagtgagttggcagagaggattccagcccaggacagtctgcccttaggttgtgctgtgatctctattctgttttatgtggagtgagtttaatgtatctgcattaacgagatccagggacaaaaatataacaaaattcaaggaatgtgaagcaatgtcctatagaaggaggacagttcactatcagtgtgagccaacacactcagctcttggcagttttcagacagttgcaaagaaatacttagcctgaggcttcttcgtgcccataaacctaattaagggtactagagattctgattggcaagagctagggacagagaggctgagtgagactatacgtgtccctatgtttctgtatataaagacagaaagagggagtttgagagagcgaatgagttaaatcctaagtagacctggaaaactatcattttgctaggactggacttaagcaaaacagcagagcaaagttcagagttaagccagaactttgccttgaacctcaggcccattgagccctctgctccaacagggccaaatcagcatccaatagtccccttcaagttgtatctgtcccgtgtctcggtgtttctggtttctgttatttggtaggtcacaattaattatacagggttaacaaaaatagattaacataatgtacttgccgaatagtgtttctttgggagaaaatgacttaactcacctaaaatatctccaggcataaaagatattaatgttgggaatatcaggagtgattaacctctgagagaggttgaagggaagcaaaattggacaggaaggataggaggaatggagataggggatttcgggtggggagagcctcttagagtcttttatttcagaccttactctgtgcctttccatagggccaagtctgatcatcctctttttatggtctgaatatctttgagcccttcagaaactttcaaattagtaatatacatgattaatatttttgacacttacatgttaggaactagacattatttcagtaatcctcagaggagccttgagtggtagatgctatcattcttccccctttcttttaaataatgaaatagaggtttaggaagacccaaagctagttgatgtcagagccaagatccaaagcccatgtgtggttataaagccgtgttcttaccactatattatgctgtaagaataaagggacaaacctcaaaataaaagctttcactatcagtaacacagcaaaaaacaattattcattcaataatgagcaggatgaataaaaacagacaaacctcatcacatgaagttgaacttcagagaatagtcgaataaaaagttccctcaaacttaggagaaacctaaggctatgaaactgattgtttcatagccttggtaataagtagccatcaggggccgggcatggtggctcacacctgtaatcccagcactttgggaggccaaggcaggtgaatcacctgaggtcaggagttcgagactagcctggctaacatggtgaaaccctgtctctgttaaaaatatgaaaattagccgggcatggtggcacatgtctgtaatcccagctactgaggaggctgaggcagaagaatcgcttgaacccaggaggcagaggttgcagtgagctgagattgtgccactgcactctagcctgggtgacagacagagactccatctcaaaaagaaaaaaaaaagtagccatcagaacccatttaaaatctgttcatttggtcaacaacaacttgtcttagtgaaagttggttttaaaactggcagaactgaccagtgtcaaatccttacttcagcccatcagggatgcagtttccagtaaacatctctctgagtgccagccaatcaaagaatcaattacagcctcagctgagcacccacgtgctgtcaacccacgtgtgcctctgaacatctcacaaccacagagctccatgctttcaaagccctctaagccatcagccatctgtcctgctcacagacactgtttggccagcatagctctcttctgtgatgagcaatgtattcagccttggagttctgtgtcagatactaagtggtgatctcattgttatttgaaaaaacaagcacacatcagtatgtatgtagtgtatggctacagagacaatagcacaggtaagaggttgggtagggcaggtgctagggggggctactttggatgggaagctcaggagagcctctttgtgggtgcaaggtttatgaagagacctatatgatttgagaagagtccagacattcacagatctaggcctggggcttccaaaaagaaggaaaggtcttaaggtaggagaggatgcctgcgtgtctggggaaggagtagaagaggaggctggagaggaaatgggtggaggctgatccttcagggccttgtgggtcatggcatggtcaggatttgggattttgcttcaagtccaacggggaggcaggaaaccacccagggaaggactatgtcctctgctttaagagagagagagagagagtgtgtgtgtgtgcatgtgtgtataatatacacttgcacatatgtgcatattgaaagaaaggggatggaggcttagggtcaggagtgcctcttagagtctcttactttataccttactgtatatctataaatgcacatacatgcatatatacacacaagttttgcagttaggttcaaagatcctgtagatctagaagaatgtctatgacattgacaatgtgagtcagtacaccctccactgtgtgctaccaaatctgcccaccctcttccactgggagtcccataaatgaagtggttttactaccctgttgtagcccagtgacagatgatcagtgatgtcaaaagcgtgattctggagaggttggtcactttgttgcaaagctgctgtatcatttcaggtacatagtctgggaggtacagagtctagggtcagagtagagtctcaagccattgtgcatgcctgcccaagacagagtggagttggtctactcctgaatatattaaccattttttcccttagtcattacatgtaaagcttcatgtctgcatttgtcagttatgatttatccggatcacctttcttacagaaagcggtagatgccaaccagaagactggaataggcttccttttatctcttttgcacagttgtgtcttcggtgagatgacttgactctctgatgttgagagtgtttttgttaatttttgaagcatgatctcagttggtttaggatatgaatgccatacacactcattgttttcgtttggggactgccgctgtgctgggtgactgcgtgtttgtgctgctggcccttgctgacactgatattggatttacaaagccaaccttgcagttttgtgtgggcaggtaggctgcctttaatttgtggttgctttgcccttctgaaaacacgaacttctatctggttggaagtcattttctttttcatcaatctcaactactgaacctatttcttcaggcacatctccagactgccttggatatttcgaggatatgttctgcgtgttcacatttgaactgcagcttggtttgcagacaccctctccttagattggcagctgtttgtggaattcctgagtaccaattacatccagtagcaggaaataaaagacaaacaaggaactagtagagctcaaggtattctttcatccttcctccttcttagctaatacatcttacagttagctctgaaaggagaatttatttaaacatactaaacactgtgcatagtgactcttacatcttttctggtaatagcatgctaatgctatacttcaaagtgcagtgaataagccctgtagagaaatatcctcatggtatggtttcaaaggacaggcatccttctggaacatattgttatcttaggtttttgttttaaatgtcagcacatggagaccttattctaaggctgcgtctgtgctccgctagtgagtatggaaggcttaggtgattcatggtgggaagttgaagtaactagagaagacttggtgctgtttggctttagtgaaatttttagaagctgtagttgaaaaaccaacacagattggccctctgtttgttgcttttggctgtctagggactgcaaagtaaaaaatgacattttcttgatgtctttctgacagtttctcacctgtaggtcaagtcctaattgaaatatgacataaatatttggcgtcataaaagcagaatctccataacacattaggtgatttctagagtaatgctcacttttattgtttgggttccattgatgagttaggcagggttatattttaagaattttcttacatcaggaagagtcaacagaggatggataacatattttgaacgtggacattgcttgtaagttgcaggacacttgtaaacactattgagtgtcacctatagcaggaaccagtttttctttatccctcgttctgtgacagctacctgggttctatgttggagccccgtagtatagtttcaaatgcaatagccactgcataatccttgtcacccaaagactgcagatcttgacagaacttgtacaacagtggccttgctgaggagtgatgtacatttcttttgtcatttggccacataagaaaactgcagccatcactgtattttgatgcatcagactctgtgtcctctgagtgtgattcagctgttggatttcttgattatgaaagtatctagagtacctcatgttcagtgatgtgaactgctatgaaagttccctccgtgtattctgctggatttcttaagttatatcttcacagagagggcttgcctcttatacagtctgcatccagcacccataagtactttcctttgctgcaggagcaggaactgaacccaactgtggatggagtgggaatgtgtgttctgattcctgcttattagcggtaggatgtgataaatatgttccaaagcaatgcctggtagaagtgttcccctacctgcatgtgacaagaagcattttcctcccttcatttggatagaggaagggctttggataaggaaaaaaaataaagaagatcttggaccttaagctggagacaggaaggtcaagtgctttattttttctgtgatgagaaccagctcatttgagaactgaaggtgaatactgactgtcatatttaataagtagtgatggaatttgcatttcttccttgaggtcagtagtctgctttcatagatagaacaggagtttaaattctgagcaaaatatgcaatcttttctctttctttgattcttatcctgtcaattatctcgtcattctacagaggactaaaaggtaaagagttctaagatcttcgcattgtctgggaagaagtggaaatgttaatattagtctttaataagttattaatgacacatattataattgttaggataactcctaaaaggatagtgaagagcatataacttccatattaatggttaaagatgtgccaaacaatagcaacaaaggaggaggaaaatttgaacattgggataaaagcactgcacacagtggtagatgtaaacacaaatatttcagcaattacattacatataaatggactaaatgatgcaattaaaagataaagacatggatgaaaaaacttttcaggaggcatatttaaaagataaggaaataaaagtttgaaaaaataaaaggatagaaaaatattatgcaaatactaaaggaaagcagctgtaggttggctggtatcagtgttgatcatatcatggacatggttgattatggtatgagtttgtgccttatgttgtaagtattcacaatcagagtttcttatagttagaaaaaattagatgatcaaattataaattactagaaagatttcataattgttaaggtgtaggctttttactgcacctggagaggcctttcagccatgatgtgaattatgtaccattatgtaagataagtggagcgtaaatgctttgttcaaacaattataatgtaattggaaacttcttgtgttaacaatatcattatcttaaaggtgaaaggggtgggaagaatgtggtagaaatcaagttccctggggaataggctttacagccaaaagtaaagtcattttttcctgaccagtgacttagcttaaaacaggtcaatgatattctttaaataaagcaatatttaattggattcatttgcagctgatatggattctggggcttgatagcacttacatattaagctggaaatctagaaataagaactttagcaacaatttttttttttttttttaggatttgagattagttattaataacacaggatgcaagactcttaggttgtagttgtgggtaagcataaatatatactgaatagattcagacattggccaagtagactcagtttttttcaggagatcatgttcattcaaagggataatttcttctttctgaaaaacttctattttgaaaatattaaatgatagaattccccctgaaattttttattgtgctgtttaaggaatggtattttacccattagtgataatccatgaatgcatgctatgaatggatacttaggaaacatttcctgcatgtccatggaaagataattatttttaatatttgtatggactgttaggcttttttctgtgagtaagatgtttttaatgtagaggtgtacttatagagtatacgatttttattgtattcttttaaatggactatttaatataattgacatatttcccatggagtaaaaacactatttagatgcttgtggtaacataactcctcaaatcttagtgacttaagacaacaaaggtttattacatggataatgtagatcaacaggaaactgctcattggaattgaagactccatgctgacactgatgggaggctccatccatgcacaggcactcacagtcaccaaagcagcataggaaaatatggtaatccttgcactggctgttaaagcctttctagaagagaaataacacttgcttatatttcattgaccaaagcaagtcatgtggccatgctaacttcaaagaaggtgggcaagcgcaatcctgtatgtccaggactggactattagggaacagcctaattgactactccagattgctactgacaacacttttttaaatgattgggataatactccaataaatgcctatgccatagtttacagagttagcccattttaatgtttgcagtgccaatagtttattaataatgctgaaatggacattttggtatagtcaccattcctccacactgctccttttctggggtacttaaactaatcctagattaagtctcctgttgtatagtttaatggactgctgtatgtctactttgtagcacttattttctaccaacacgctataaatttcatatagagaccacacctttttttcagtgctgtgtctgctaaccgttacataatagatattaaataaacattaatgaaggaatgaattaattggggaagtgggaagggtaaattggtaaaactactattaaggctttttctatatgtttccaaattgctttccaaaagaattatagcaaattcacatgtgagtcagcagtggtttatcagtttaccacccattgccaccactggttattttcctttgctaaatggaaagtcaaaataaataatatctcaatatttttagcactgtaattggcatatctttgattatcaataagactgggtatttttcatacatttggtttttgttattgtgataaaaacataacaaaagttaccatagtaaccattttttaagtgtacagtaaaatataactatgtgtacattgttgtgccacagatctctggaaacctcattttgcaaacctgaaactctttaaccattgaacagtaacttgtcttcaccctcctccaacacttggcacccaccattctactttttatttctaaaatttcgactacttaagtatacctcatataactagacttatgcagtatttgtttttttgtgactggttaatgttacttagcataatgttctcaaggttcatctatattgtagcttattgccagatttccttctttttaaggctgaataatattttattgcatatatatatgtatatcaaattttaaaatctgttaatccgttgacatttaggttacttctacgaacttggctattgtgaataatgctgtaatatacatggtgtgcacttatctcttcatgattctatttttgattcttttgaatatacagatgcttgacttacagttacgtcctgataaaacccatcatcagttgaaactatcataaggtgaaaatgcgttcaatacaactaaccaattaagcacaatagcttagcctagcctaccttaaacatgctaagaacacttacattagtctatggttgggcaaaatcttccaatacaaagtcaattttatagcaaagtgttaaaattgtcatataatttattaaatactgtaccaatagtaaaaaacaaaatggttgcattggtgggtttttgatgttggttatcatgacaaggtctctcactctgccacccaggctggaatgcagtggtgtgatcacagcttgctgcagcctcaatcccctgggctcaggtaatcctcctacctcaacctcccgagtagctgggactacaggcatgagccaccatgtctggctatttttttttattatttgtagagatggggtctcactatgttgccccagctggtctggaactcctgggctcaagtggtcctcttgccttagcctctcaaagtgctgggattacaggcatgagtcagtgtgctcggctgatgctttggttatttaccctcatgatcatgtggctgactggaaatggtggctctttgccactgccccgaatcataagcgagtatgttactgtatattgctagcctgggaaaagatcaaaatttaaagcatggtttctgctgaatacatatcacattcacaccatcgtaaagttgaaaatagtaagtcaaactgttgtatgttgaggactgtctgtatatctaagggcaggattgctggataatatggcaattctacttttactttttttcagaactgctgtcctgttttccacagcagctgcatggttttatattctccccagcagtgtacaagggttccagtttcttcacctcttcaccaacacttggtattttctgttttgttttttgtttttgtttggttttgatagtggccatcctaacaggcatgaagtgattatggtttttgattagcgttttcttgatgtttagtcatgttgaatatattttcatgatgctcgttagccatttatagtatatcttctttacatagatgtctctattcttcaagtcctttgcccaattttaagattggtttatttgttttgctgtgtgaagagagataattttactccaatttggatgccatttatttattgcctaattgcttgggttaggacttctagtactatgttgacgagaagtggcaggagtgggcctctgtcttgtttctgaacttaaaggaaaagctttcagtttttcaccattaagtttgatgttagctgtgggattttcatatatggtctctgttatcttgaggtaatttctttctattaatgaaattttttgtgtgtttttgtcatgaaagggtattgaattcttttcagtgcttttttttttttggcaccaattcagtcatgtggtttttagccccttattaatgtggtatatcacattgattgatttttgtatgttaagccatcctatcattccaggaatatatcccacttggtcatgatgtataattactttaatgtgctattgaatttggtttgctagtattttgttacgaatgtttgcatcagtatttatcagggatccttgtggttttcttgtagtatctttgtctgctttaggtatcagagtaatgctggcctcaaaaaaatgagtttgaaaattttccatctttttcaatttttttgtaagagtttgagaagaagtggtgccaattcttctttaaatgtttgatataattctccagtgaaaccatctggtccggggcttttctatattgggaggtttttgattacttacttagtttcctttccagttaccatattcccctattatctgagagttcactttctgcagtttcaggtactggcagtcaactgcaatctgaaaatattaaatggaaaattgcggaaataaacaataagctttaaattgcatgtcattctgagtagcatgataaaatctcccactgtcccatttcatcccacccagaacttaaatcatccctttgtccagcatttctacgtatacactactcccccattactgtataggaaaatacatggcatatagagggctcagtactattcagggtttcaggcattcactggcggccttggaatgtattccccatgtataagggggaactgctatattgctatgttcagattgtttattactttatgattcagtcttggtagatggtatgtttgtaggaatttattccttttagattatccaatttactggcatatgcttattcatagcaatatattataatcctttttatttggacatcaggtataatatctcctctttcattttgatttttgttatttgaatcctctatatttagtctgaggatttatcaattctattggtctttaaaaaaactcaatttttgttgtttttttctattatttttctattctctaatttgtttatttttactctagtctttattatttccctctttctcgcaactttgggtttagtttgtttttctagttccttgaggtgtaaagttaggttgttaatttctttcttccttgttaacgtaggtatttactgctataaaattccttcctagtattgcttttgctgcatcctatatgttttgcaatgtgaatctcaattgatagaggtttatttagccaaagtttgaggacatgcccaagaaaaacatgggtcacagtagcatttgtgccctgtgcttttccaaagagcattttgggaacttcagtatttaaaggggaaatagcaaaaatgaggctctgattagtgctcagcacatctacattttatttatttgttttaacttcttaaaattttactttttaaataaacatatggtaaaattgacgttgtatgtgagtacagttctatgaattttgacacatgtatacatttatgtaaccactgccataatgagaatacaaaacagttccgtcaccccagagaactccctcatgtcatccttttgtagtcaatatccctagtcccacccgtaacactaacctttagcaagcactaccctgttacccatcaccaaagttttgtcttttccacaaggtcacataaatgaaatcctaccgtatataatcttttgagactggcgtctttcactctgcataatgcctcgaagactcatccaagttgttgcatgtaaacatattattattattattattattattattatggctgagcagaattccactgtgtgaacataacccgttttgttttgttttgttttgttttgtttttcacccattgtagagcatttggctgtttccagtttttgataattaagaattaagcttctataatcattcttatacaggttttggggtacagatatgttttcatattgtaatgcttaggtaattcctagaagtaaggttgctgagtcaaccggtagatgtgcctgtaactttatgagaaactgccacactgtttgccagagtattttcaaatttcagccattctaatatgtgtatagggtattttatcatgattttaatctacatttttcaaatggccaatgatgctgaacatcttttcatgtgcttatttgccgaccctacgtcccctttggtgaagtgtctgttcaggtcttttgctcattttaaaaattggactgcttgttctctcaatattgagttttgagagtccttaatatattctgagtgcaagtattttgctggatatgtgatctgtaaatattttctcccagtctgtagtttgcctttttattcttttaacagtgtctttctaaaaacaaggttttaattatgatggtgtgatttattttttctgttatagatcatgatttacccctttagttataaaaattttataattttatattttacatttaaatgtgtaacttagtttgagttaattttggtataaggtattgagaggtgtagccagctgggcttctgggtcaggtggggacttggagaactttcctgtgtctagctgaaggattgtaaatacaccaatcagcactctgtaaaaacacaccaatcagcgctttgtgtctagctaaaagattgtaaatgcactaatcagcactctgtaaaaacgtaccaatcagtgctttatgtctagctaaaggattgtaaatgcaccaatcagcactctgtaaaatggaccaatcagcaggacatagatggggccaaataagggaataaaagctggccacccaagccagcagcagcaacctgctcgggtcccttccatccacactgtggaagctttgttctttcactcttcacaataaatcttgctgctgctcactctttgggtccgcaccacctttaagagctgtaacactcactgcgaaggtctgcggcttcattcttgaaatcagcgaggccgtgaactcaccagaaggaagaaactctggatacatctgaaggaacaaactccagacacaccatctttaagagctgtaacactcaccacgaaggtcccaattcttgaagtcagtgagaccaagaacctaccagaaggaaccaactccagacacagtatgagatttaggtcaaggttcattttcttgcatttagatgtttgaatgcttcaaacaccgtttattcagaagactgtcctttctctgatgaattgcctctgcaaatttatcaaaaactcagttggtaaaactgtagttgcccatgggtatatgcagcagagcagaactttctgaagtaatggaaatgggaatacacgttacagggtgtgttatgtgggcatatgcatttgtcaaaacatcaatttacacactttaagtcagtgaattttactgtatgtgagttatacttcaattaaaatatcagttggccatatttctgtaggtttatttctggaagtctattctatgctgttgatctacatgtttatctttttgccaataccatgctgtctttattttttattattttattttatttttgagattgaggctcgctctgttgcccaggctggagtgcaatggtgcaatctcagtcactgcaacctctgcctcccaggttcaagctattctcctgcttcagcctcccaagtagctgggactccaggcacatgccaccatgcctggctaatttttgtatttttaatagagacgaggtttcaccatgttggccagtcttgtcttgaactcctggcctcaatcaatccgcctgcctcagcctcccaaagtgctgggattacaggtctgagccactcccggccaaccatgctatcttgatctcaattactttagctttatagaaaccttgatgaagtggaaaagtgtgattcctccaactctgttctttttcaaaattgttttggctattcttgtttctttgcctttccatatacctttagaatcaccttagttctacctacaaaaatcttgttgggattttgattaggtttgtgctaaatttatagattaattaggggaagattcacatcttcacaatactatcttccaattttgaacatagtatgtttttttcatttatttaggtcctctttatttcattagcattttatagttttcagcataccctctaattgtttacataaatatttattagatttatatgtaagtatttcaattttttggaattgttttaaatatcatttttggagttattttaaacagcatttaaaaaatatttggtttccagctccttattgctaacacataaaaatatgatccatttttttacatgtactctacaactttgctaaatacattcattagttgtaggaggtttgtatgtatgctatttcttgggatttttcatgtaaacaataatttcatttgtgaacagggacagttttatttcttcttttccagtcaggatatctttatttcttttccttgcctgattgctctggcttggaattccagtatggtgtgaaataggaatggagatagaagtttgccttgttttcattcacaggaggaaagcattcagtcttcatcattagatgtgatccttgttggttttccaatgatatgtcctttattaggttgacaaaagtctctttttgtagcaaatctacattttacatgtcaaaagagggagtagatgaaaaaagtaaattacatattcatctcatactcagtgaatctacattttactaaataagttgaagtaaacataaaaagaggaagcagaggaaaagtcaattatgcattaatctcagggtaggtgaagagataatttctggtcttgtccttgtcctgtacccgcaaagataagctggtagttgacattgtgagggtgagagtcaacagagctcagttttagggctagtttataggagggatatagatcctgaacgatttagggcctcacgtttatacttattgtatcttccctatgaattggcccttttattgttgtataatgtccttttttgtttcttctgacagttttgacttaaaatctatttgtctaatattggtatagctacctctgttctcttttggttactatgtgcatggaatatctttttccattctttcatttcagcttatgtgtgccattatatctaaagggaatctcttgtatacatcagatagtgaggtcttgttttttaattccttcagccattctgtcttttgattgaggcatttaatccatttacattgaagcaattactgattgggagagactttctgttgtcattttgttaactgtattctgtatatgttgtatctatctattcctcttttcctttttcctttttatttgctgccttcttttgtgtttcattgatttttttttttttttttttggtgacatgctttaattcctttctcattttcttttgtatgtcttctataggtattttctttgcggttgctatggagattacaaaaaacatcttatagttgtaacaatctattttaaactgttaactacctaactttgatcacataaaattcctttacatcccccgtcctactttgttaccaatctttcaaattatacctttttatattgcatatccaatcaagctttcaaactatatccttttatattgcatatccatttatagagttttataattgtagttattttttaagcttttatcttttaaattctataccagaatttaaaatgacatacaacctaccagtacagtattacagaattctgtatttgtctatatattgacctttaccagggagcttacattttcatatgctttcatattgatatctaggatcctttcatttgaaggacttccattagcatttcctgtaaggcaggtctagtggggatgaactctcccagcctttgtttatttctccttcatttttgagtgacagcttttttggccatggtattttgtgttggcttttttttttcttttagcatgttgagtatattatctcacttccttctggcgtataaactttctgctgagaaatctgctgataatcctatggaagatttcatgtacatgatgacttacttttctcttgctgtttttcaagattctctctttgtttttgattttgacagtttgattataatgtgcctcagtttaggctcttcaggttcatcctagttggagtttattgactttcttgaatttagatgttctttttccccctagatttgggaagttttcagtcattattttctcctttctctcactgttctttctcagggactctcataatgtgtatattgatctgctcaatggtgtttctttctttgtttcttttttggctttgactagaaaatttcaaatgacctatcttcaaattcattgattctgttttgctcttgatcaagtgtgctgttaaactcctctggtaaatcttccaattcagttgttgtattcttcagctcaagaatttgttaggttcttttttaaaatagtttctatttatattctcattttattcattcttcattttttggatggtttattttttattgctggttgtctgtacacccagttaactctttaaacttctttaagatggttattttgaatcctttgtcaggtaatttatagatatctgtttttctgatctgcttttggagatttattttattcctttgattgggccatgttcccctgattcttcatatgcattgatttttgctgggatttgggcatttgaaaaacaactacaacaaccagctcttccagtcttaatggactggctttgtgtaggggaagacctttaccagtcagcctggctagagattctgagggtctctgcgaccttctctggagatgtgtcttgtctgggcttgcatgtaatttcccaattagagaagtttgctaatttctttttcaacagtttgtgttctcttgctttctctgtgacactccacagtactgtaggttctccggtacagcaagaaaacatcaagttcttttgttctctgcagccctagatgtccaaagtataccagtttcccgttagagtctgtgttaagcaaaacagaaactagtctcttaggcagccccctgaaaaactggaacactggatgtgcattcactcctcttttcctcccaaaggagaagctctgagtaggttgttttctcccaattcattgagctgtgccagcctggggaaaggctaagaatagcaaaataaaatgacttttcctacctgttttaattctgctgttcttcactttgtatttgcctaggggcactgtggtttcataactggtttctggaggtcttataaaggcattttgtacaatatattgttggtaagtctgtggggggtgggcagggaatgagatctggggcatcctattttgtaatcttacttatatcacctcccaggaagatcaaattttatacttatcagtgtatgagagtagaaatgtcattgtattggggggtcagtagataagattccatatctgtttctatcactaatgatagaactactgctaaattataaaaatgtaaaatggtgctagaatagagattagagtaacatatttttgaaactttaaaatctgaaggaatttactgcttaacttctgcctactttcagggtattaatactagagaaatttcctctaatactttcctttttctttttctttttcttttttttttttttttgagatagagtcttattctgttgcccaggatagagggcagtggtgcagtctcagtttaccgcaacctctgcctcccaggttcaagcaattctcctgcctcagcctcccgagtagttgggattagaggtgcatgccaccatgcctggctaattttttgtatttttagtagagatggggtttcaccatgttggccaggctggtctcaaactcctgatctcagatgatcctcctgcttcggcctcacaaagtgctgggattatgggcatgagccaccgcacccagcctctaatacttttctaattatgaacctgatgaatgcttagtaggatatatatgtaaatcatctgcaattcattcaacatgagtaattactgttaacattttatagtattttctttacattttgtatgtatctgtataatgtattcaaaattatgtatatttaaatgttctctatacacagatctgtttgctctctgatcaccaggctttatataataaactttttttttcatgttaaacattcactggtttttcaatatctgcatattttcctaataatatattgctgtaatatacctcatttgaccatgtaaccatatctcatatttctattttgggaggttattataaatatggggccatgaaaatgtttgtagaaatattctatatgcttttaaaatatcctgttttcttcaagtagattgctggagatggaatttctaggtcaaagaataatgtggacataaatgattttagaactttttctacctttgccagttacctttgaaaaagtgtgagagtgttacattgcttttgtttctcatgaatactatcttttaaaaattttagctaacttgataggtaattttatttgtatttctttgaacattaattctgcttctgtggcttgtttattcttatcccctttgcccttttctttattgtgatattggaaatgtccctttcaattagtttttactctttatttattaagggtgttaatactttttttagatttgtggtaaatattttcccctgattcgtagtctgcatagcttttaattgtcttatgttattgtgggttgaaacttttatttagtcaaatttgtacaactttctttagtaacttttttcctttgctgttgtgcctgcagtcacacaccatccagatattaatcacctagattttaaattttctatatatatacaaatttctgactatactatattccttctctatgaataacctcttttaacatttttttgatgggcaaatttgctggcaatgaattccctcagtttttgtttgtatgaaaaagtctttattttttcttcacttttgaaggataactttgctgaatatagaaatctatgttggtggactccccccatttaacacattaaatatttttctccattctcttcttgcatggtttctaacaaaatgtctgctgcaactttcatcctctatagatgtttccctccttttggcttctttcaaaatttcttatttgactttggctttcagcagtataaatatgatagcccaggtgtaggtatttttgacatttattgtgcttagtggtggtctctaagcttcctagattggtattttggtgtctgtcatttattttggaaagttcttggtcattattccttcaacatttcttttgcttcattctttcttccccttctgttcagttacacacatgtcgcacctttgcaattattccacagttcttggaaggtcgctgctgctgtcactgctgctgctccttcctactcctcctcttccttgttccgcttctcctcctcctcctctctttttcttctctgcccacctcccactctgttttcttctctctttgcatttttatctgggaggtgtctattgagctatcttcaagttctctgattctttcttcagccatgactagtctcctcatgagcccatcaaaaacattcttcacttctgtttgtctgatttctagcaattcctttagattctctcttacagtttccatttccctgttgacattacctgtctgttcttgcatattgtctgcttttcccatcagtgttcttaacatactgtgatagttaattttaggtgtcaacttgactttagaagggatacccagatagctagaaaagcattatttttgggtatgtctatgagggtgtttctggaagaaattggcatttgaatcagcgtactgaataagaaagatctgccctgccccaatattgacaggcaccattcagtcagctgaggtcccagatacaacaaaaagggagaggagaaatgaattcatattctctttctctccccttctctctcttccttcctccctctccctctccttttccctctctccctcccttctagagctgagacattcatctgcttctgatcttgaacatcagaactccaggttcttggctgggtgcggtggctcatgcctgtaatcccagcactttgggaggccgaggcaggcggatcacttgaggtcaggagtttgaaaccagcctggccaacatggtgagactctgtctctactaaaaatacaaaaaaataagctgagtgtggtggtgggtgcctgtaatcccagctacttgggaggctgaggcaggagaatcacttgaacttgggaggtggaggttgcagtgagccgagatgatgccactgcactccagcctgggcaacatagtaagactccgtctcaaaaaacaaaaaaaaccaaactaacaaaaaaacccaaaaaactccaggttctccaccctagggattctgggtcttgtatctgcagtcccgcagtttcttaggccttcagccttggactgagagttacattgttggctcttctgattctcaggcttttgagcttggactgagccatgctaccagcttccctggttctccagcttgcagatggcgtactatgggacttcccagcctccataatcagatttaattcccctgatgaatcccctcttgtctatctatttatcctattggttctgtttctcaggagaaccctaatacacatattaatcatagttattttaaatttcctatccgataagtccagtatttatctggtttgattattactttgcctcttcaaattgttttttcttgccttttagcatgccttgtaattttcattgaaagctgaaaataatggattgggtaatagacctttagtataaggttttatgttaatctagactagattaatcacagactacagttggcctgtgtttagtatttgctgtagctgtaggtgccagaggcttcaaattcctctggcgtcattgtttcagtctcccctgttgtctttgggattccctaagaactcctcagatagagtttgcatcttgcagctcttttagacgtaatctaatgtaatctgttattttactggtgaggtatggtgctaaggtgtagggaaggggaaacattctgtaatcttaggactacataccagtttcttagtgggcttgcattcatggcctatgaccttcacaagtgtttcttagcttttattttcttaaagaaaaaaaaaaaagctcccataatgagataggaaggctagagggggccagagtaggaggaatgtccttccctcaggtggataaggctctggtaaagtctttttggattccactctggagagtaggcctttatttttgaaactcctctgggcatatttcacaatagttaccattagggatggaatatttgtgtccccccacgcccccgcaccccgccaagtttatatgtggaagtcctgacacccaatatgagtgtgtgtggtaggctgcgtgtggaggtattgggaaattcaggttcccaaaagtttggtcgtagtgaagtcctcagaggtcttcttgagtctttccttttcttcaccaaaggctcactgacgtcatccatcctcctgatggaggtcaaagcattaaagtcatttttctccctaggagcgtctcccccattgccaaattgccaggctagtattagggagaaatgtcctccctgaatttcattgttgggtttttttttttttttttttaaaccttattatggctttaatgttgaaatttctgttttggactttttagcatgacacatacacacacctctcattttattttcattgctttttaaactcccatgtccaatgtctattttaatcttatgtttggcagcctgaaacattttatttctaaaattaattctctaattatacaacatctacatggcttgtaatgacatcagtagagcagaatctagaatccaactcaaggttttcgttttgttttttaagagtaagtaacttattttgatcaatgtagtaagaggagattgaaaggtaccagtgtgtgtgaaagtgaatagttgcttcctctccccatctcctcttcttcctcccctgctcctctcctcttcttcctccccctcctttcctcttcctcctcccccaacccttcttccttctactcttcctcctcctctgcttattccttcatcttaactcatccttcactaaaaagagttatattagcattagaagtattccttaatggctatacttttcagatattataacttcagaattttctagccaataacaggattctagggcaaatgtcatgtaggatatggctcttcgagtaccaacatggcaagaaattgatttcctctattgaagacacattgattttcagctgtactgaaaaactcacagccttccagtatcgacaaatagtaaaaattgacttcacataataacacctttatttacctagccttgtgaccctctgattttgttagatgatcctatggtgaaagaatgcaccaggaccaatgcttggacaaatagtaagtctccattttctttatagtagatgcttctacataaaattccgctttgggcagtaacttgcgtagacagctgttcttgtgacacgacataatgcacactgagcacggtgacagctccagacgatggtctactctggagtttccaactggactggtaatctactggatactctcatctggaattgtctcctagctgagtggttaagctatagaagcccatgattaaacaatgttgtttctggaaagaataatagaaatggttattattagtgagtacttactgtctgccaggccctgcactaagggctttttatgtgttagttttgtttaatccccacaatatatctaagaggtattatcccccttttcccgtgaggacactgaaggtccaacagctaataagtgaagctggcgatatgtcctgttttagctactaacatttatcagcttcatcatacagacatactttgtcagattggttagccaggcaagtgaccgctgagagaatggggcacaggagaagtaagtgatgactgcgaacacaggctggacaaagatcactttcttatacgagtctgcagttcttgaaataatacctatcagatatggcattaacagtgattggtagccttatccaaatgcgatatttgacttttgccttcatatcatggtttgaatttacaaacttcatttctttttctttttttttgagatggaatctcgctcttgtcacccaggctggactgcaatggcgcgctcagttcactgcaacctctgcctcccgagttcaagtgattctcatgcctcagcctccagagtagctgggattacaggcatgtgccactatgcccagctaatttttgtttttttttttttttttttttttagtagagacagagtttcaccatgttggccaggctggtcttgaactcctgacaaacttcagatgggggcattgccttaagtgtatgatgcccaccattgaggtagactaccacatggtacctggatgagcatcttatgtttcaccaaaccagaaatttcccaggcaaagtgaacggaacaagagagactgcggattcagacgtttcctatgcagttatacttctgaatgggtagtcacagtgtgttcaagggtaaatgatagctaaattatcacccatctttaaatgttttcactttaacggggttaccaaatcgctctttaaacttgaatttctatcaagcttcagaaccataaatgttttcttagaatttttccaagattatctgaatcagtgagtcctttaactcacttctccaggtatcaaaagtcttttaagtcttttttctgccaaaggtgaatctatgctaacgccttctagtactgattctcctttccattttcccatgcaccctactgctttctgtctccctttgcaattcaacagaaagagaaatcatgaggcagtatgaaatgaaggacttttctgggctgattttccttttgaatcagaatggaaatttatggtcatagtgctttccatgaggtatttagaagtttccagtcaatcattgctcttatcaggggttcttaaaggctttgggagatactaggttagctttcttacaatataggctgccctttgttacagcgacactttctttttgcagattttttttttcttaacagagaaaattgagatatgaaattatttccttaatctctacaataatcaaatcataattatttctattctattttttaaacttttaaatttcactaacagtacatagccattgcagtaatttttttaaaaaatagagaggagcttaaaaataacaaaaacctctataatcccatcacccagagatgagttttggccccattcatctcacaagttctgtgcaactattgcatttcatgttgcctattcatattaagagaatagcattacttttattatgatgatgatttgtaaacaatttcccagagttaattcccagacatttaaaaattttggccataattgaaagtcaggattttatcttctcagttggaaagtagaagagaaaagtataacagtgaaaaaaatttttcttaggtgtgtatttgtgttggattgttctaatttcaaaacagagaaagttttgaactcctgctttcatggttcattcttagaaataaatagaattgttttcccaagaaaaccttggaaaactttctagtaatagcaggaggaatatgggagtaggaaatggcaagttgaaggattttaatttggaaactgccaccttttggaatacagaagagctggttatgggattggcccctggctttacttgtccttaacatgggctttgataaggggaaaacaaagtgagggcttcgagccacaagtcaaggtcttgggaaagcttagcaaaatggtgcaagtctctcgtgatatctacctttatgcttactgctttctattggcaaaaatctctcatcttttgcagatgcactgagatcccatcagtagacagagaaagaacgtgggtgagtcagaagcaatcagccagaagcacacaaatgggtgtggacatgtcactgccaacaacccacacagagtggctggctactgcattcacccttaggatctcctaatgagcacagttaacagtagttggagctttgtctctgacatcctcttgcagtcatctgccttatttgctgattgatttctgttcttgaaactctgaacaggaagccttctgttgactcatccctgcttttcagactggaaagcacttgtaattttatctgccatgtatagtctctaaaaatttattttgaagatatgctgtatcaaaagcaatttaagaaagtaggaaggtaggaaatataacaaccaaaaccaaacagtgacactaaatatatacatatatatagctgtacactagacttaacctaaactgaccagctagatgattttgatgcagtaaagacaagttaagaaaatttgtctttactgtcaacaagacagtaaacttgtctctatgtcaacaagaaaaaaggcaattagaaattcttggaaaaacagaaatttgcaaatgaagtcccaatttaatatgaggtaaactgaaatgtgacagaattctgcataattgatggtatataagaaaaaagaaaaaagaatacattggaacttgacgcttacagctagtatggtgacaacggactatatctcctttaactgatttagtttcaccatctggaactgcactgaataaaaatatttacctaattgtaatactgaatatattttattagttttcatttttcataattaacctgtatgcaaagcatggaagataaattatatttgctgaacaaaatggaaatattctaaaacttgatgttgtaaattaatgcttattataggtgataaaatgtaagggggggattgaggtggaatggagtacaagagcatatgttttcttctgtttcatagtggatggttgaaatggtactctttagtcttgatacatagagaagtagagatttaggaatatgattacatgattaaggtaacaaatgaaagattatatatctgaagaggacagaggggaaaggagatgctgtgtctcaaaattgtgttctcctctagcagggaatcaatataccgttgacccttgaacaacacgggtttgaattcaggagtcctcttatatcccagtcttttttaaaccaaacatgaattgaaaatacagtattcccaggatgcaaagcctgtgtatagggagggctgactttgcgcatatgcagattctgcaggtggactgcaggacttgagtatgcctggattttggtatatgcaacaggtcctggaaccaatcccccaagtgagtatactgaggggcgactggattgtttcacttttgtagaggcatatgggagttaggcagccttgtgcttttcatactatgttcttgtttaatttctggggttttttgtttgtatttttgttatccatgtacatcttttgaaactgaaaaaatggtgatcagatgatttacaagaaactttgattaacaattatactagcacaactttgttaaatttccctaggagaagacaacagcctcaaatgcagtgggaaaaaaaagcaaaatctgcctgcttccacattgttttcaaggagagcacttgaacaaaatggtactatttggacaataaatagatgggtaccaattctagacaagcacaagcaaaaagaaaacagggctggcagtattcgcatgggggcaatttcaagacagaaagcattaagtggacaaaaggtgatattttgtaatggtaggggttagaatccaccaagaatttatacagccatggttctttacgtatggaaaattagcgccgaaattggtaaaggaaaaactgttaggagataaaagaattaaagaataaggcaaaaaatattagtacttagaaaattataatagccaatggtataatttaaggtatgaaaataaaacaaacaaaagtctgcacctgcaaaggaaacttgaaaggcagggctgttggggatggggtgtgtgtggcggtgaaaggggtacagatagtttatcctaatcataggttttaatcactttcttgtagaaggaaggaaaagttttatttctgtgacaccatctcattgtaaaatccagtaaaattgaaaactttgagataaatgtattatcaggagttacagccataacttttagtatgtgagctataaattctgttcttatcactaagtcactgagaactaaggctgctgattttcccaacatagtaaaacagagcgacctgaccaaaaaatgaaaaacatttttatggacttttattctccttcctgcaaccctaatctccttccttcctctatagattctagtctatctaagaaattctaggtggatggtttgctttctctgagggaagctaagattgaggccaaaaggagatctgctaggtacctgtgcaaacgtcaggtgggacagtgaatagaaagtaggcatgcaggggaccgagaaagataggctctgggcatcacaaacagcttttccaactctagagacttgaaaaatgtatttggagttacatctaagtcagaagagtacatcttgtttatccccccaaaaagcctcctggtatataccttttagtcaaatagcattgtgatcttgtcacaatatatggacaacagatattttcagttcatttgatacttaacatagaacatattaatgtgccattttatcagaaacctgtaaaggagtttaataatggataactagaatgaacataagtggtagcaggtccttactctcatcccccctcccacttttcataatgtactgatttgaaatgttcgtgaaatcaatacagacaaattaactcagtgagcagcttctccccagtctcttgctgcagtgatgagaagcctctttctggatctacttgtttccagatggtagacaaggcttattctgacacatggactgaaaacagggcagaccagcagtcggaatcttccctgcttagtgtcttaatctatagtaagacctcaaagaattagattccctagcatgaggaatttttcttactgaattttttaatgccactatatggcagtgattaaatagcaagttcaagtgattaaatctggtccatctctatacttttcctttacaattgctatcaggttttgtaagtaaggaagtggaggcatttttgtaagtgtgttaactctcaaagcccacaaaagtatgtttttaaacttagggatcaagttgtgtggatccgatttcagacccccagaggttcttccaatgtgtctaatgtccaggacagtgcacatgttcagagtttcattgtatttttctttctttctttctttctttctttctttctttctttctttctttctttctttctttctctctctctctctctctctctttctttccttctttctttctttccccctccctccctccctccctccctccctccctccctccctccctccctcccttccttccttccttccttccttccttccttccttccttccttccttcctttctttttttgatggagtctcgctctgtcaccaggctggagtgcagtggcatgatcttggctcactgcaacctccacctcccaggttcgagcgattctcctgcctcaacctcccgagtagctggggctacagctgcccaccaccacgcctggctaattttcgtatttttagtagagacggagtttcaccatattggccaggctggtctcgatctcttgaccttgtgatctgcccgcctctgcctcccgaagtgctgggattacaggcatgagccaccgcacccagccagcagcatgttttctttgaagtgttgttcaggggtctcttgcatcagaatgtcctgaactgcttgttgggaatgcagtatcctgatcctaccctccagattctgattcagtaagcctggactgagccttggaaatctgcattttatttagcataatgtcctgggggcttgggggctccccaaagtttgaaaaccaccgctaagggctattatgtttctgtaggcaaacctatttttctgttttcattttatgtcatacaaagtaggagtttaagaatttatttttggtgaaactagaacactgtcttcaaattaataagagccttgttgtgtaggagaaatattctcttcaaaatctctccacgaaattgatctcaaaaagactggctgagtcaaatgctaaacagatctgtcctgtatctggctgccacctgtcaaaattgctgaccttacacttatgtattcaaatgcttcctggaagtcaaaacatattttcaaaagtttctagtggaaaagaactaagcctgtcgcttggttttaaaaggtggaaattgagataagaccgaatggttgagattaatttcacatcacaagaataggggtgagaagagaatagcaatttccataacttctatcatttatcttttaggttgaggatactgtgaaataatccttccctttccaaccaacatgaagatgactgatacacccatcatactgaaggattcctactgtgtcagagattacattatattaagtccttacagaaatataaagagtataaccttcaaaaaactgggaattgttaaattatacattggattttgggggctattgtttgggaggttttgttttgttttgttttgtttttccttctttcataacagttcgctcaattaactataccagaggcatctttggctgcaaaggtggaggaatcactgtgctcgaagatgacagttctacaccttggcctgacagttttgagattcttgcttctaaaataagatggaacctgaaagatgggatgattctagcatactaagtatttgactttaattggaatcattgaacgtcccttgaattttttttctcattggtattggattctgttgtctttactgatggaaatttcttttccttccattcttggttcatgacaaaccaccaactgtccacgcatgatctcctttcattttacttgtatttgaaatgaaaacctgtgagtgcaatgcctaatctaagaatcagaacattattcttttatacccctatctctgtaattctcctttatcttactccttcacctccccatccctctgccaccagaggtaaccaccattctgaacattgtttatcattctcttgcttcacccctacatatctacatgtagccttaagcaatacattgtttcattttgcctggctttgaactttatgaagaggtatcatccctggcttatatgatctcttgagacttgctgtttcactcagccttatattcctaagattcatccatgctgtcattgctgtgtagtatttttatttgtgcttatactgcagtttttctataaatgttagtataggttatactatgatttatcaatactcatgtcattgggcattcagggtgtttcctgtttttgtatctatgagcagagctgttagtaagcatttgcgtctcctggcatgcatgtgccgaggtttcccttgtgtctatgcttagaggaagtacagcaaccactgctgtgttgtggtgtatgaaatcattcaactttacaaaagaatgggaaagcgctttcagggtcgctatatccatttacacttccaccagaggtgcagaaaagatcctatcagttcacctcttcaccaactctttgtattttcagacatcaattttttttttgccaattttgtgtttataaatctactgatatacttcttaagtattttatctatcccttaggaaaaaaggtaggaaatagaatgtggttgccttcacatagagaggctagaaaacaaagtatcatgcctgcttagtttgatggcacccaaatttttctcccagttatctcactactagtagttgacattcttttctcaccctcgctagaaatatgaaaaccttgcctctgcacagtggaatcccttggaacatttaaaaaatgctaatgtctggaccccacctccagagactctgatttctttggagcccagcattgaacatagggatttttttttttaaataaaagcttcccaggtgattctaacgtgcagtcaaggttgagaatcactgctttaaaatacagaaatcttgacaagcaagcataagctcagggtagcctgatattgttaattgttctttttctcatttctaaagtacaaagtttgcataattttggagaatcctcttgcctctaatttctagctcagcagcctttgagagttttttggtttttgttttggtgtttgttgttggtagaagtaaatagtagaaattcaataaaagttagtatgggctagaaattgtgcttgacatttatttttttcttataactgtggatctcaaagtttagtgtgcataagaaacacctgggaagcattttgttttgttttacaatgcggattttgattcagtaagtcttggcgtgagcccccgggaatctgtgttctaacaaagtgattatgatgtaggtggttctagaatcacctttggataaaaactgcctcataataatcctacagtataagcagtattctcatttacagatggggggatgtgaagcccagagaagttaagaagcctgcgccgtgtcacagagctccctaggggactagcctttgctctgtaagctctcagccctgctcatagtatgcctccaacaaggctctcagaatttaggaaagtctgctttggaacatgtgttatcttctctatacttacattctttcttaatctgccatgactttctctcctcatcaaaaaacagcctttaatctcctacccaaatccacctcgtacctgtgagtcttcaggtgtgttacactctgaacatggtcccgtgagagaatttcttattaaaaattgagcttgcaaaaaatcaaatgtgttatatttttgttcttatttcaccctaaaacaatgactttagttgacaatcacttttatgcaaccttagtaattatttctaaactcatgtacaagtggatggaagtatttctgtgcacatttagaaaatttatattcattgcttgtttccctcccctgccaccccacagagtgaggactttaccatgaaatctgggcctttggcctatgtatttttaatcatgttcatattgtactgtatctgcaaccatctgtaatacagctgtatatgtttacatgaaacacaataaacttttaagtttaattccatttgtgagcagatggtagcttgtcaaggaaacatttgatcatgtttatgtctgtatttggccacaaaaacctcataattactctcattaattacatatccttttcatgttacctgtaataaatgctaaggtatcatatgtgttggccttgtgggatatatttttgtatgtagagacagtcctcttaagaatgtttgcggcctggagcagtggctccgacttgtaatccaagcactttggaaggccgaggcaggcggatcacttgaggtcaggagttcgagaccagcctaggcaacatggtgaaaccccatctctactaaaaatacaaaaattagctgggtgtggtggcaggtgcctgtaatcccagcttcttgggaggctgagggaggtgaattgcttgaacctgggaggcagaggtttcagtgagctaagatcgtgccattgcactctagcctgagtgacagagtgagactctatctgaaaaaaaaaaaaaaaaaaaaaaaaaaagaatgtttgcttctgtaggcacatttatgtctacctattatgatgtcaagggtgtattccagtttgtatctgtagctgctacaagaagggtgtcatgggatctgtggttacactcttactcttcccatctgggtatttctgagtgtatttgctccaggagagccactggttctgctggcctacatgcaaagtgtatctatctctctgttaatgcgtttcccatgatgatactcgctgctgagatacttcctaggaagttttgctttcctatcacctcctttaagtgctttcctttaagtgttctcattttaactcattattaaactagcagacttgattgcagtgaatttttcttaaataacttaattgtagggccttttgcgcgtcattttgtgctcctacttactgctcagaggtggtacaaagtcagcagctcaagagacagacctgccacccatgatctctcctccaagttctcaggatgttcagaaagttaaaatttcactctgtcgagtttccatctggcttggcaatcaatgccggattagctccaaatactctttccaagtctcttgaaggatgtgctagcctctgttttgaattctacttcaggatcacaccatctctgcatgcaagaatgacatatctgagtgactgccactaaacccacatggtggaagtgtttgcttatcctgctatgtgatgctggctatcatattgtcagtttatgaggtgtttttttttttttttgcttgtcttcttccatgtaagtatttccagagcagaggcattggcttgcagaaggtgtgcctgcaatcagtccagcttccccagatgtgctgaggcttcaacaggggtttttaaaacttgtgctagaatactcatcttccaaaaaatctttaagttgatgcaatataatagctgccaattgagcatacattttgaggtagttttctttaatgggagtatatgctcatccacactctctttccagtgttaaatattttaagacagctggttagagttgagggtgccttttttttggtcataaaacgatgacagaactctaaaatcacatggttatttatcaacattaaaaacattcttttatatccattaattaatttattctttataacagcttctgtggaataggtatataaagggtttttttttttgtctactgttatttaagagtatcataaaacctgagaaagaaaaacataattagttgtcatctagtctaatgctctcattttgcagataaataaattgaagttcagagagatgaagtcactcacttatggacctatagctagtgaatggccctgaaattgtttcccagtcatggctggaggcacaactttgtctgagacctgactgatacttttgactatgtgatgttgtgtcaattatctaacacttctggacctcagtttctttacccatattatggattattgtgaatattatattagactacatccaagaatgctattaacccagggcctaccatcaaataagtagttaatttatatcagccacttcacagctgcacttatttttatttttattttttctgagacagagtctcgctctgttgcccatgatggagtacagtggtgtgatcttggctcactgcaacctctacctcctgggctcaactgattcttgtgcctcagcctcccaagtagccgggactacaggtgccaccatgcctggctaatttttgtatttttagtagagacggggttttgccatgttagctaggctggtcttgaactcctgatctcaagtgatccgcctgcctcagcctcccacagtgctgggattacaggcgtgagccaccgcgccttcctgctgtgcttattttcaatactcttttctcagggatcttggtaaccagagcagaatggcagtttttcagctcttacaatgcctttgtttagaagtcttgtatgtgtatatctgctccatcacttaaaagttctcctaatgcaatttggaagggtttaatatggaacaagagcagggactttgggatggagtctaatgataacttgtcacatgttcttttagaagctgaattaggtagtttttgccttactggtgcgctctcatttaactgtgaggtatcctggcacttcaaacaggtaccatatggtaactgttttgtgttttaagcctggtactgtttagaacacatgcttcagagagtggtcattgtttcgctgccacccagttaaggcatgtgttacctcttgttatggatggaatgcctgtgagccctaggttcctatgttgaagccctaacccccagtgtgatggtatttggagatgaggcatttgggaggtgggtaaggttagattagctcatgatggtgggaccctcttgatgggattcatggccttataataagaggccatgtgaacacagagaaaaggtcatgtaaggactcggcagaaaggtggccatctgcaagccaggaagggaggcctccctagaagccagacactgcctgatcttgatcttggactttccaggcttgagaactgtgttgtttaagcccctcagtctgtgatattttgttatggtagctgggcttgaacagactgagagacctctgctggagtgtgcgttgttcaatgatttacttccttgtttgcctacattatacactttcactatgtctccacgatggaagaggcatgactgttcagatgcatcggggttcgtctctacctaccaaggtcctgtgccatgaggagatgtcgggccagggactcaaacaggagcagtcatccaactcctttctattaggtctttggtgatttaaaatctcatatgaatcaagagctggtagagtgctaatgttcacaggtttttatagaacattaaagctctgtaatagttattttgtatgttatataaataatttccctgcaagtatttattcatttactcttcatttacataattgcttataatcttttttaatatattcttgtcccctgcgccacccctcccaccttttttttttttttgctgtggttcatatgcttttatgtaacctgagctataaaagactagaatactgcagatattctatctgccatgtctgtcattttcttatgatgggtacttagtctaccgtatacaaatttctgtatagttaccaatgtctttttagctatttattaatcttatcttgtttctttggcttctgaatcactttgctgaagttgaaatcatctgaggtcagagccagtttttatttaaatagactgaatgcagctaaacctggattatagccaagaaagatcttacaccaagtgcctacaaaattagaagcattgccaaggacgcatcagcagagtgttttgcttactgaagtcttattctgaaataaatttgaggccctggcgatgggagcttttggttgttattggtagacctcctaaaaaatgtaatgtagtttaattttacttttaatttttttagcatgaactttctccttcatttcttctttccagagatttttgggtctatccattggttgccatctatgtgttcaaacatgtgactaggtagaagagaggtaaacaggagtgtattcacctgttatcatggagaagttattattcaagacctgtaaggggaatgtggcagtcctaaaggctgcaaatattctggcagcattgtaggattgcactttccctcctcctctgaaggtagatgggagccatgtgtcttgctgtggctaatgaaatgtgagcaaagtgttgcaagctttaagagccagtgcatgattcatcatgttcccatcccattgccacagtgtttgtgaaagcgagtgttgagatggaccctttgttttctgggtccttaattgactgtggtaagataaattattgacaacctgtactagacatatatcttcagcagtatcctttggttgggattttgttgagataagggtccgtgatttggcatactcagtgtaacctaacctattctgattcttatagggaatcagagaagtgtccttacactcagggagcttgtgatttaatatagttgagaagatgtgtttgcataatgaagaaggaaccagctgcttaactgtactctttatttagccacattactgaacaagagacaagctgattatagcataatattgagattttgagtatattcctgagaccctggtttcaactggaaaagtaactttttttttttccttgacactttcagatcacaattgatcaaaacacctatgcaaggaattaaacttgctacaaataagccactagatgcatgatacctttaaaaaagaccaattatgagttatcttttattgttctttttatattaaaaatctgcatgggaaatggaatgagaatatttataacagtacagatttgctatgatggtgtctattaatcaaagttctttattttttagtatgtggggacgacacatactcatggctaatattggtgaaattgctaattcattcattctttatttggtgattcactccacaaacatttattgggcatttggtataaaccaggcatagctctcaatgctgctggtacagcaagaaacaagacagagcctctgactttgtgtcttacattttagtgagagaattgggtaataagcaaacaaagaaaggtacagtgtggtatcaatgatgagagttataaagacaaagcagagaaatgagacagacagtgcaaggtgtgtgatctcacatagagtggtcaggaaaggctgctttcagaaggtgacatttgaacaagaaattgaagaaagcagggagaaaagccatgtgactgccctgaggaagaatccttcaagtggcataaatagccatttcaaagaccctgaggcagggatgtagtaggatgtttgaagaacagcaaagagaccagtgtggctggaagaagggtgagcaagtgaggagaggtgggtaggagatgaagccagagacgtggtcaagagccacagaaccagggcctgccctgcctctgatgaaaaggcactgggattttgaatgtgagagaaccatgacctgctttatgttggaaactgatgtagtctgtggagggcaagaaaacaaacagaccagcaaggagacttttgcatgagtccaaattggagatgatggagtttggacacagttggcaagtgtggtggttgtgagatgtgttgggttcaagatatcttttgaaaatattgctattaggactttgtgatttgttgtggactttggcctgagcatctgattgactgatgatgctattttctcagatgaggagaatgttcaagatgttgttacctatttaagagaaggtggccattgcatattgcatatgtgagcctggacttcaggggaaagtttaggactggagataggcggttggtcattcaatggataggtggatttgaatccatgagattggatgagattcttttttgtttgtttgtttctgagacatagtcttgctctgtcatccgggctagagtacagtagcacgatctcaactcactgcaccctctgccacccaggttcaagcattcgtgcctcagcctctgagtagctgagatttacagatgtgcaccaccacgcccaggtaatttctgtatttttagcagagacagggttttggcatgttggccaggctgatcccgaacttctggcctcaagtgatctgcccgcctcggcctccaaagtgctgagattacaatcatgcgccaccacgcctggcctggatgaaattcttgaggaaaggagggtaccgagaggagaaaagatgttgaagaactgaatctggggtgctcccaacagttagaggttgaagagctgaagaggaaccagtaaaggggaccgaaaaggagcagccattgaggagagaggacagccagacaagtgaagtgatccacagctacatgaagacagtgccaaggaggaaggagaaatgagaaatgaaaatactactgagaggttgagggcctgggctgagactggaacacaggatatagcagcatggagatcatggtgacattgacaatatcatgtcattgattgggtgggggcacaagcttgattgaagctggttcaagtgagaataagagatgaggaaataaagataggatatacgtttcttgagagatttttgctgtggggtgagaggtaagggaggatagctatttaggatgtgaagtcagaaaaatttaattttttaaagatgggggttatattacacttgaaagctgatcattatttagtagagataaagaaattgacagaagcatctccttaagtaggcaagaggggatgggacctagtgtaagtggtgggttggctgctgcattagctggagttaaggcattgcatgttctagatttgtacggagacatataggtgaatgcacacacttatgggaagatactgttattatcttctgcttgcctttgttttctaagaaatagaatcaagatcatcagatgggtgtgagtaaggggtcatttctaggagtaggagtgtaagttggccaagaaagtgtaataagattgctgagcagaactgaaagcacattgagattactatcatatctttaaagcaaaatcagccagtgtagttctttgtttttctctagattgtgtcatttgctgtggtgtagggagagagtctaaggattctctcgtaggtaatcatggtcatagttttgcaatctgaataatgtggaagtggagatgggcagccgtgcagtagggcacttgcaagggagcaatttttgggagtgccaaaggccaggctggaagaggtgaaggaggagggagtgatttttgggtggtgccctagaccaggctgaaggaggtgaaggaggagggtgaagacataaagtggggaacggaccatggagaggaggtcaagtcaatggatccagagggcactgatgccaaattgttgacaggcatgagagggaatgagctggaaattcctttgaaataaaaagttggcagctttcctcaagcttaatctcaaaagagacatttaaaaattacttacttttgctgcatggttggggaaaaatgtatttttcaagcatgagttcaactcattttgtaccagggtattcacactgatattcttgggtaagtcattaaaattagtcaactatttctgtgtcttcacccacaaaaggagacgtgtgagaagtgaatacttagtgattgttagattccactgaatctcactgctttgttgcagtttaacgagcaggctaggattgcagcgctgtcatttcagttgggccaccaagccttgaatgaggagataaaactggaagataaagtcttagtaggtacaacaaaagaagcttttgagagatcgttggatagatgtcatctatttggttgctaaataataacacacaaagaaatctctctactgtttatcatgtgtacttatcttgagaagcatcagtgattaaaaaaacaactttgaaaacataaaaatggtgaagtgtggcaatggtatcatgtggcaacggtaaaatgtgtttacccatgtaaatataatgtcacaaatgaatcttgtcattatattttgtagtatcttggaggttactggccagaactattataatagtcagattcatttcatatttatttaaaatccgcggtgttttcacatacattgtgtttttaggggaaattttaccaatgattaacatatattgtctagaagcagagccatctgaattgaaactcaaatataattgccacttttattaaatatacaactggcagactttgaaaatgttatctcagcatctagcattggcttcattttggtttctcattttcctattttattttgttcagtttagcaggggacagtggggaacagggttacaaattgcattttttcctgcattattggtttttgtcaagtggtttacaggccaaagtttgtggatctgccagaggctttatcccaaaactataggcaacagctatttcttgaaataattttagatagatttctacattgatttatgttttggggtatatgatgcacaatcccttaagtcttaatatgactattggtttaatatggcagaattaggatcaggttcactcattgtttattataatttacccatgcttgactacccaataaaatgtcttccctttacaatgatctttttctattgccatattcttcttgtccttaaaacaacaataacagatcctcaaacgtcattggggttaataaaagatgtttctttattttcagatctttaacaaagcttctccttaacccagagggttttcagaggagtaaagagtggaagtcatttgtacatgaattggcttttgaaagtggccctcattattttattttattttattttatttttttattatactttaagttttagggtacatgtgcacaatgtgcaggttagttacatatgtatacatgtgccatgctggtgtgctgcacccactaactcatcatctagcattaggtatatctcccgatgctatccctccccccctccccccagcccacaacagtccccagagtgtgatgttccccttcatgtgcatcattttttatgaagtggccctcattattaagccatgtctctgcctgttgattgatgttaactatctgcttatggtctgagatcagtgtgtactgcaaatgtttgggaagatatcttctttctgtggaggtgaaacttaaatatcttctataaaatatgcctcgatttcagaagtagcaattgtagcaatgcctgatgtgaccactttattactgccttagaagtacttttgtggtttgactgtggggagggaacgggtcactggagattttgctatctctccaggtttcatgctttgggaatcaaaggtaggtaacagtttggaaaaactctgtaggggctaaagctttttctaaaggtttttacgtctatatatacctctgtatgttactgcttcaagcccagcaactagcaattttagtttcactgaaattgtgttttctttaaatacacaagataatagaattgtaactggaatttacatgttatatataaagatatattttatttaatcttgtcagaagggttttttttttttttttttggtgcttttaagctaatgtggcatctttctcttttcaaagagtggcatctccaaggaatagctctgcctggaaggtgtttgtggctgtccacttaaaagctgaaattaggtcagtgttattttgtcttgagataacaaaaataagaccccaagggagtagtgacttgggatttcatttaagtacttaatttacaggaaaaaaaatacagtttccgatactgaataattattacactactgaataattatatattttttcttctcccggtgttcttatactttagaggcaattttttttttttttttgtaaagatcacaaaaggtctgattagtcaaagaatgaaagaaatgcactgtggctccaaagtcccttatccaaaacctctgggacagatgtattttggaatttaagatttttgtgctgagaatgatggtttccagcttcatccatgtccctgcaaaggacatgaactcattcttttttatggctgcatagttttccatggtgtatatgtgccacattttctttatccagtctatcattcatgggcatttgggttggttccaagtctttgctattgtaaatagtgctgcaataaacatacgtgtgcatgtgtctttatagcagcatgatttataatccttggggtacatagccagtaatgcgtcattcccagcaaactaacacaggaacagaaaaccaaacactgcatgttctcattcataagtgggagtcgaacaatgagaacacgtggatgcagggaggggaacatcacacaccaaggcctgtcggggaggtggaggacaaggggagagagagcattaggaaatatacctaatgcatgcggggcttaaaacctagataataggttgatgggtgcagcaaaacgccctggcacatgtatacctatgtaacaaacctgcacgttctgcacatgtatcccagaacttaaagtaaaatttaaaaaaagattttttggagtttagaaaaataatacatttggatttagcagggtttagtgcggcactttttaatcacacacactaatatttctgtagtgaaactgaatattcacactgagataaagactatgaataacttcacatcagttcaggtaaggttttgcctcctattaagtcttgataacaaactttaaaaacttaaaaaaataaaataaaataaagtttattttcaaaacttttgaagtttgcgcgtacagctagcttgtaggtctggccttgcttttctttagattatatttcccttattagtcttctaaacacattaaatctgtgtttaccaacgctgtaatattttgccaccgtgaggatggtctagaggccagcaccatccacatcccttgggagctggctagacatgcagaatcacaggtgctaccacgaagctgctgaatcacaatctgcattttaatagaatccccaggtgattcatgtgtgcgttaaagatcaagaagcattgctgtagtattatattggctttaatttagattccaagtcttaaagggaaatgctgatggggggatactttagttgtttaaatcctgggaaagtgagcccagattacactaatatcatttatttaattatgtatgtatgtattttttttttttttgagacaagatctgacggtatcacccaggctggagtgcagtggtacaatcttgactcactgcaacctctgccttgtggggttcaagccatcctcccacctcagcctccagagtagctgggactacaggcatgcaccaccacacctagctaatttttgtattttttgcagagagggggttttgccatgttggccaggctggtcttgaacttgtgagctcaggccatctgtccacctcagccccccaaagtgctgagattacaggcgtgagccactgcatctggccgaatatcagttctttttaattttttattcaatatttcctccgtctctccctcccactcttcctatttttttttttttttttgagacagagtctcgctttgtcgcccaggctggagtgcagtggcgcaatcttggctagctgtaacctctgcgtcccaggttcaagcaattctctgcctcagcctcctgagtagctgggattacaggcgcctgccaccacacccggctaatttttgcatttttaccagagatgggatttcaccatcttggctaggctggtcttgaactccccacctgttgatatatgtgccttggcctcccaaagtgctgggattacaggtgtgagccactgcgcccggcccactcttcctttctctcctccttccttttctttttctttctttttaaaaataagtctcataatacttgactttaaatggatcatttagtctatttatttacatttattatattcttgatatatttggatttcttctcttttatactttctgtttattctacttttgtttctttctcttgttttatttatttttttgagatggagtcttggtctgtcactcaggctggagtgcagtggcgcaatcttggctcactgcaacctctggcctcctggcttcaagtgattctcccacctaagcctccgagtagctgggattacaggtgcatgccaccacgcctggctaatattttgtatttttagtagagatggggtttcaccacgttggccaggctggtcttgaactcctaatatcaaatgatccacctgcctcagcctcccaaagtgctaggattacaggcgtgagccactgcacctggctctttttcttttaggttgatattttttttctcatcctattccttcctctgctagtttgttatataccctatttctctcttttagcagtaatcctagaaattgtagcatgcatactttatttataaaagtctaaattcagtcagtatcttttcttcctcctaaacaatagctcagaatgttttaactcccgttttcctctcttgtgctgtatactattcttgttgtgtgtttattctatttttaaaaattattaatcatagatgattttttaaaacttatttttttcaagacagggtcacattccataagccaggctggagtgcagtggtgcagtcacaatgattgcagcctcgacctccctgggctcagatgatcctcctacctcagcctccagagtaactgggactacaggcacacaccaccatgcccagctaatttttgtatttttagtagagacggggtttcaccatgttggccaggctggtcttgaactcctgggctccagcaatctgcccgccttggcctcccaaagtgctgggattacaggtgtgggccactgcgcccagccaatcacatatgatttggttgtttaatagtggtgtttatctacatttattcacatatttgccacattagttgcttactacgtatttttgcattttagaccttctacttggaatcaccttcttcaacttggattctttagaccttccttaactgagagtctcttcatggcaaactgtcttggattttgtctaaaaatgtctttattttgcccttattctaaactgttactaaactatacattttgttttttgttagtgtatctgatttgctggctgtcattcattgtgctttatttctctctctctctctctgtctctctctgtgtgtgtgtgtaagggagagaatttgctaattagttgattaattttccactgtgagctgttcatttttcttacagctttgttatgaggattcttccaggtctgagttacagaaggattctcctagaaagtatttaaggttgcttctgctatgtgcctgggttattaccaactgtgactcttcacattaaatttttggcttcagggttttgggactctaagagctgtatgaactcgcactgcaaactcatatgagttttcacttattatagtaaattctcaggtttgatttttttcttcttccatccatggccaagatttgagacaggcaagtttccttgcactccaggaatgtagcttgacttactgttcctggtgttggtggtggtgctgctggagatgagatccttttagccatcctatctttggcaggccctgggctttgtttcaccctgaactctgaaccctgaatcctgtgggcagggcttctgctagcccatgtggctccactctaaattgatgcaggcactcagcttgttaaagggagcactggatggatttcagcaagcttcctgttccttatggttctgtctggtaggccttaaacctaggctcaagtactctggagttaaacaagtggcccaaggcaaaagccagcttcagtgcttaacttacttcgcagggattgtatgtatgtatgcatgtgtatgaatatatgttatgtatacatatgtatgttttgtgcgtgtgtatttcaccgttgagtgttaattactcccttgttacaactcattgatgcatttaaataaaacatttaaaatattttattcatctcctctcatggttttcagcaaaaatgtaggtcagggtaaattaccagatatattggaccagctggatgtagtcgcctttgatttttttttagttctaccacctatgtatgtatcaataaacaatgtattctttagtgcttccttatttttaaacattatgtgaattgaataacttatgtaatcttttgcaatttggtttcccgcaacatttctatatggagtatggttcgttcatatttactttataccaatatatgaatttctttagctattcaacacaatttaactattcagattccactgttgatggacttttggattctttccaatttttgctattggagttttccagttttgctgctaagaacactctcgtacatgtcttctggtgcattgtccaggattttctctagaatatattcctgggggtagaattgatgattcattgagtaagcatgtgttgtaccttactaggtaattacaaatggctttccaaagtagttgtaacaaattatgcttccattagcggtacacaagagtttctgtggctccatgtccttaccaattcttagtattgtcaggtttcttaattcttgcctattaggtgggtggacttaatacttcttagtttagttgttataacttgttttttaaaattaacatatctatgtgcatattcgtagtcatacatgtttgtctggtcatttaggtacttatgcaatactctagtagactcagaatagaaattagccatggcaacatatatattacattcttcatattgctacatttgaaaataatcataattatttgcagaaatatgaacagaacatatagaattaaatgttttcacgatgtcttgtattatctttcatgtttcatagcaatctctgtgttataggccacatcaactgcttttgcattgttctgacttacaggaattgcagatttattgttctcagtgccatatttaagttccttctctgtaacaatcaggtgtaatacttgtaaatttttttaaccttagtacaaatttaaaaagcagaaatttctcttgcagcttcctgtgtttcaggcccagtgctaagcacatggcaagcattgtcccatttagttctctccaccatgcttcgggcaggtgctgttgttaagcccctttcatggaggagtgaactaaagcatggagaggttaagggtcttgatcaaggtcccacaatcttattctcaatggaccttctccttctctaatctaaaaccctcattttattttgggaagtggatgtaggtctaggaagcttgtttgtgtgtgtgtagtttgtttgttttttttttttttgagatggagtctcgctctgtcgccaggctggagtgcggtggcgcaatctcggctcactgcaacctctgcctcttgggttcaagcaattctcctgcctcagccttctgagtgctgggactacaggtgtgtgccaccatgcccggctaattttttgtatttttagtacagacggggtatcaccgtgttagccaggatggtgtcgatctcctgacctcaggtgatccacctgccccggcctcccaaagtgctgggattacaggtgtgagccactgttcttggctgtttgtgttttatattaggaggcagagagcacttaggggaagcagaagctctggtctgaggaggcagtggtttacttattagttcacaggccttttaggtaatcactggtccttcacttaattaagcaacttaatatatgtcttacggattaagttaattttaaatcaatgctaatttttatgtcaaaatatattaagcagcatcacattaaagtcaaaggtagtcttgtaattattagagcaataggtatcgtgctgtcgttctccaatgtggctgcacattggacaacctgaggagctttaaaaaatactgctgcctggggatcactcccataagctctgatttatctcgtctggggcaccaggagttttaaaatttctccaggtgatctaatgtgtagccaagcttgaagattactcgatagtcattgattatgtgcgtgccacattcagattggtggggttcaaatcctccttctgccactcactagatgtgtggccttagttaagttttgttaacgtttctttatgtcttcatctgtaaaatggggatgaatgataaaaatactgtctgcatctcagagcattgttatgaggattaaaggggtacagtaagtccttatttaacgttgtctataggttattggaaactgcaacttttaagtgaaacgatgtataacaaaaccggtattaccatagattaattgacataaatgagagttaagttcctgcagcatatttttggtcctaaaagtattatcagacttctacataaagaccaaaacatttctaatattaaacactgagagaaatctaggttatacatacatttaagaaagattaattcaatcatttactcaattattcgactccagaatagtgggtggtccgagcctgtcctggcagctcagggtgcaaggtgggaccagccaaggacaggacaccatcccatcacagggcacactcacgctcatccacactcacactgggaccacttagacatgccagttcacctaatgggcacagctttgggaagtggagaatgtgaagaaaatccatgcagatgtggtgagaacatgcaacctccacacagacaatggccttggctggaataaatttttttttctcacaaattttataatgaaacaatgttactgtaggacctgctgtataatatatacatattaataaaatgcttggaatagtgactggcacaaaatagtcctttactgtgagctattttaagtagactaagaaaaaattattactattattggatattctctcaaaagtatcttgggggctaagattttaaattaaatcaaattttgcctagtactaagcccactttggtgttttcttggctttgtttaatttttttctccatggttttatttaaaagttatttctaatcaccctgtcaacttagcagatatctgttggaatcatttaaggtgtttgtttccaaaagactgcagaaattaaatcaagatatttgcagaggaatgactgacagcttgcaggtagactggagaaagtgcttcctaccataacagacagaaaaaatggtagtacaagagtcagcatttcttatttatttttctatgaggcagggtctcgctctgccgctcagactggaatgcagtggtgtgatcatagcgcactgcagcctcaaacttctagactcaagggatctcctgcctcagcttcctgagtagctgggactataggtgcttgccaccatacctagctgattttttgtaggggtgggtagagacagggtctagctctgttgctcaggctggtcttgaactcctggcctcaagcaattctcttgccttgacctcccaaaatgttgggattacagacatgagccaccatgcctggccaattgagcatttctttaaactggaaactagcacctttataataatttcacacataccattattgttgaaaatagtcagattttcagaggaaatctctattaacctaagttgtataaccttttgaggttgtaccagtgtagagcctgtttttccgagcatctacatgctcaatgctattttttcagttatccagcatccccccacttgtttctatcctatctcatatgcaagagggtgtaaatgtttttgtgcattgcttttacatttttatttatctctcaagtgggcaagtaagacagtcatcaacagaggttgcatttggagatcatattctgttttttctttaaactatttgatcatttcagagaaactttattctcagttctgttttgtcttcagctgtcaatatccctgactccaggccctttatttagcttccattcttactgatgtggaaacatacttttaaatgaactgcctttaaaaagaaatattttagtaaagtgaaggatctttttgtaatgcaaataatgttttgttcaggattttcttgagaaatctgccatgttctctaagcctttgcctccatactggatgtggctttgccttttttgttgtgttgaagggcatgcacagatatagtttctgattatttttctcagtctgatttctccaattaggcatattatcattagaaaactcgcccattttcccatggtgtttaaaagtaaaccaggacttgtgacactatgctactcggcatttatgaaatgtaatttaattactttgtttccattgtgaagactcggtttccttatttcctatattcatttatttattcattattggtatacccaacaagataagtaaatacgatacagccttgcatttgacaattttatggtgtgtatgtatttatcatgcctgaactgtgactagacttaagatgaagatggtacctaaatcaagctcttttatattttgtctttcccataatctagtctgtcttttctttcccacaaaatagaatgggatactttttattataaatatatgacatgttcactataaaagagaggcagtaaaggaccagagaaaatgacctgtgatgccaccacctagaagtaatcactcttgttaacatcttgttatttacttgtacagtttttttctgtgttcataggctgacatttttccttgcagatgttctctctctatattcatacaaagctgcagttgttcaagtcccaccccagcctctggaggtccaggatgaatgcctccctctttctgtcctggtaccttacgtgacctccggacggcagtgtcagtgttggaaatggcaggctgctgcaaatatgctaaaacctcatcagttgtctctattcgtctgaccaaagtccgtgggaagagcaagatgctggtgatatcctggagctcttctgacacaaggctctggctagccttgatacattcctcaaattcttccttccaattctgaaaccttttgttttccagacaataaaaccctcccaaactcctacctagacattctctctaagcagtcctgggagaccacatgtgacttgacttttaactatctttacagcgtttacattttgctccttctttttgtcatgccattactagagggaggatgggccatccagagcagcgtgcgccctccacaggcaccttagcctgttcttcactccgccatgattgaaagaggagaaaatattctatagctgttccttttctgttcttggctttttcactcttactgaccttacaagttttatttttccatttctgaatctcaattattttcatttctcctattcagtatagtttttaatagatagcattgcattacatggatgtcccttatttaatcaactgtttggtatttcttttctgtttttcaaaatctaatgaacactccagtgaatatccttttgttcgggatttatctctagaaggaagattactggctaaaaatatatgtacatttaacattcatatacatatctatacacacttttttttgagacagcgtttcactctgtcacccagactgaaatgcagtggcatgatcattgttcactgcagcctctacctcctgggctcaagcaatcctcccacctaaacctcctgagtagctgggactatagacacgtgccatcatgccagctgagtttaaaatctcgttttgtagagacatggtcttactatgttgcccaggctggtttcagactccttgggctcaagtaatcctcccacctcagcctcccaaagtattgggattataggtgtgaaccactgggcctggcctatgtatacataattaggctatactgtctataaaatttggctatctatagtcaaattattttatatgcatatatccaaatatacctataaatagccaaattatacatatacagccaaattttatatatatatatatataaatgttatatatatatagccaaattatataaagctgtatatatagtcacattatcctacaggaaatgatgtaaatgtaccaatttacattcctgtaacagggcattagaattccctttttccagagccttgccaacactggttatttataaccctttcaaactttgtatgaaagttgtatgtattttaagataaatgaaaacttatattgatttgtaattatttattggtataattgaacacctttccatatctttattgtactaatgtgtatgaattccatcttaatagttttgctaacttgtccattgaggggtttcctactgatttgtaatggctctctatataaaaaggatgttaatttttgcctattttacagtaatagtacaaatattctctcatgttttctattagtcttttaacctttgtttagttttttttcgttccttcataaatgctaaattttatgtcatcatatctttcagtccttttctatattatttctggctttgatggcatgcattgaaagcccttttccaccccagagttatcaactcgttggaaaatgatgttgaaatgtcacttttaatatttactaaacactcttgcctaatttgttctattttgaagccctttaattctgtttctttaatctgcctgtcttttttttgtgcctgttccttactgtcttgactactgcaggcaacatacttacatctaaagaacaagcacacctattctgcccttttgctaaacaaattttcagcctctttttcaatgattattttttcaaatcaatgttaaacatcacgtaaagtttcaagaaaacccctaggggtattagtatttagagtgcattaaatttttagctaattcatgggagaatttgaagtattatatcttctaatttaagttagagtacaggaattgtctgtctttatccctctaagtacattcagattctcaagaatagtaccaaaattctcagatccccctctaccagtatttttctcccactgatggctcttcaaccctaaaatgtcttagtggtatggtttggatctctgtccccaccaaatctcatgtccgatcgtggtccccactgctggcagtagggcctggtgggaggtgattagatcatggggaggcttcttatgaatggcttagcaccctccactttgtgctgttcttatgatagtgagttctcatgggatctggttgttaaaaagtgtgtggcacctccccaaaccccttgctcttgcaccggccatgtaaggtgaggatgcttcccctttgtcttttgccataattctaagtttcctgaggcctctccagaagcagaagccaccatacttcctgtacagcctgcagaaccatgagtcaattaaatcttcctttataaattacccagtctcaggtatttcttttcttttattcttttctttctttcttttttttttaagagatggagtcttgctctgtcgtccaggctagagtgcagtggcgccatctcagctcactgcaacctccgcctcccaggttcaagtgattctcccgcctcagcttcccaagtagctgggattacaggcgcccgtcaccacgcctagctaatttttgtatttttttagtagagacggggtttcactatacgttagccaggctggtctcgaattcctgacctcaggtgatccacctgccttggcctcccaaagtgctgggattacaggcgtgagccactgcgcccggccaggtatttctttatagcagtgtgagaatagcctaatacacctagcctgatgttacacttaggatcctcttcattattcttctgaatccaagcctccaactttatctacccatcacggttttagcttatattttgattttatttcttacatcttcccttatatttattattttaatattttgtttctcttttctccttctatacttgtactagatttatcagaatctgtaaatctcttttaaccctattaatttgttaactcagttaaatatatctattttgccaatgctcatcttcctatttttaacagtcatatatcaaactgtatttctcaactgatgtaccaaaattaaaggacacctagatgccctccctcagctaaagtgtttactactgcatccaaacccatgaattctccctaactgagagaggatatttagagggcctttgtgccttttttttttccccctatttcttccttgaaaattctggagctttttgaaataatttagaattttacttttaagatattattaaatttttttctacagcatgcctctgtttaaagaatcaaagctttttaaacatatcactagtcacatatattatctgtgtagacttagctatattatcatatatttatttttataaagatattgctcagcactattcttttacagttttatttatcttaactgacaaatgaaaattgtatatatttatgtatacaacatgatgctttgatatatgtaggcattgtgcactggctaaggtaagctaattaacacatgcctcacctcacagacttatcatttttttgtgagaacacctagtgagaacacctagaagtcacccacccagcaactttcaaatacattgttattaactgtagtcaccatggtgtataacggatcttttaactcattcttcatacctcactgaaattttttgtcctttacccaacatctcctcagtccccttacctcctctagactctggtaaccactgtttgaactctgttcctatgagttcaactttttttattctacatgagtgagatcatgtgatatttatctttctatgcctggttcctttttcacttaacattaatgtcctccaggttgaccatgttgtcataaatgacagatatccttcttttttaaggctgagtagtattctgttgtatacacataccacatttcctttacccatttgtttgtttttgaacacttaggtggatcccatactttgattattgtgactaatgctacaatgaacacgggagtgcaggcaactcttcagcacactgatttcaattcctttgggtatatactcagggattggattgctgtatcatatggtggttctgtttctcattttttgaaggaccttcagaccatttccataatagctgtactaatgtgcatttacatgagcagtgtacaaagattcccttttctctatatcctagccacacattatctttcgtctttttgataacagccattcgaacaggtgtgaagtgatatctcattgtggtcttaatttgcattttcctgattagtgttgttatttttttttcatatacctgttggccattcatatgtcttcttttgagaaatgtctattgaggtcctttgcccattttaaaaattgttatttactttcttgctattaagttgttcgcattccttatacattttgggtattaatccctatcagattatgatttgcaaatatattctcccattctatagattgtctactttgttgtttcctttgctgtgcagaagctttttagtttgatgtaatcccacttatctattttttgcttttgttgcctgtgcttttagaacctgatcaaaaaattattgcccagactagtgtcttggagcttttcccctgtgttttcttctagtaattttacagtttcgaatcttaggtttaagtctttaatccactttgagttagttcttgtatatggtatgagatgagggtccaattcatttttctgtatgtggatatccagttttcccaacaccatttatttaagagacagtcttttccccatgtgtgttcttggtacctttgtaaaaaaatctattgaccattgactatgtggatttatttctgggctttctaccttgttccattggcctaagtgtctgtttttatggcagtaccatgcattttgattactgtagctttgtagtagtttttgaaatcaggtagtgtgatgtctccacctttgttctttttgctcaagattgcttggctctttggggtcttttgtggttccatatgaattttaggattgctttttctatttctgtgaaaatatcattggaattttgataaagactttgaatctgtagattgctttaggtagtatggacattttaccaatgttaattattccagtccatgagtacaggatatctttccatacatgtgtgtcttcaagttcattcatcactgtcatatagttttcagtgtacagatttttcaattcctggttaaatttacccctaagtactttatttatttatttttttgctattgcgaatgggattgttttattaatttctttttcagatagtttgttgtatgtggaaatgctgcatcagcactaattcttacatattttatcttcttgagatcttttctgtttactttttatttgattgagatgctttcttagataccagtattggtatactttcttgagtttgtttctaaattatcttttcctcctcaaatatgtatttctgctgttctggtcttggattgcagttctctttattcagatgtgtgtgaacactgttctattgttatctgtggtcaagcattgcagacgagaagtctgatggtagactaattattttccctttttaacttacttctcttgtctgaatggaaggctgtagaatttttctctttgtctttgaagaaatttctctagaatatgtccagatgtcttttttatttagcctgactagaatgtctgagcctttttatgctaaaaatgcaagtctatcttcaactcagcaaaaacttcaaactgaaaaccgaagttttaaaaccagtgaagctttcttccacttttaaatattattaccacacctacttcttctcgtaattttttactttttttttcctaaaaaatgtagaaagtacagaaaataatgcggaaagttctcatttagcccaagcagagagttaaaaagataatcttttgtcatatttgttttagatctttttttaacagtatggttatattttaaaatgcctagaagactggagttaaagtcattcagttatttcttaatagtacttagagagttgctcatgaattggaggataatgaaatatgagacatgccagagcaggagaaggaaattctaggggctatttggggtcttttgtggttccatatgaattttaggatttaaaaaaaaatttctgtgaagcatgtcattggtattgtgataaagattaattgcatctttagatccctttgggtagtatggacattttgacaatattcttctaatttgtgaatatgggatatcttttcatttcttgtatcttcaattaatttcatccatgttttatagttttcattgtagagttcttttacctctttggttatattcattcttaggtattttttatttgtagctattgaaaaaagattgctttcttgatttctttttcaggtaattcattactggtgtatagaaacacctctgagttttgtatgttgattttgtatcctgcaactttactgaatttgtttattaaactattagatgatagtttaatgataaatgtttaaggtggcagatatactaattaccctaatttgataattacacaatttataaaagtattgaatcatcatgttgtaccccatacatatatatagttagttattatatgtcaattataaataaaaaattatatactacgttggttttcaaaattaaagtaataattaaaattcgcaaatgatgggaaaaaaaccggaagttcttgggggaaataagcatatttcacagtgtcatggaaattgagtcctgaatgtcaatattgtttcataaatacttgtaacatacaatgcaatagggatactacatcaggatgcttttggctccaagttacaaaaaaccccaactcaaattggcttaaagagggaagacatttgctcatctcacacaaaaggctactcagctttgcctcaatccaagccatcatgtaatcacatggtgggtatagaaatttgaggtgtacttacacctgtgtacatacctctagatgtaccagtgtcctcaagaataagaaatgccatttgccttttgtgtttcttatttagaagtgagaaagtcttttccagaatctccctagaaaacttgcctataaggtctcagccacaattcactcatacgctcattcttgtaccaactggtggaaagaaagaatagaattcacgggaattctattgaatctgacacagattgatctgacatagatcaacggttcccaaccaggtggagttttacctccagaagacatttagccaagtctggaaacatctttgtgctcgctggggtcccctactactggtatctagtgggtagaggccacagacactgctaagccttctacagtgcatgggatgcttcccacaatacagaatgatctgattcaaatgttaatagtgtcaaggttgagaagccttaacatagaccagttaggatctcacccttcagggccaaggaaagggctgtttttcactgaagcacagggctaaggaggggctatgtggatgttgtgtagcccactgggaatgcccactgccatgacgtccctcggatggagctggtcttctgagctgctcagaaagggaagctcggatttgtgggttttaggctactaaaaattaaccaaccacattgaatttcatgtttttctaattcattcctagtcttcttgcctgttaaactttctgctaaagataattctaatgaatttgagaaggtatttataaaagaatatctgtgaggctgtgtgttgcttgactggcagccaaaagaaatgttgcttggggaaaatggcacgaattaaacattgattgcccatcagtcttgtacttggggtctggggtagtctggaatacaggtagggagatcattcaagcttcacagagaggttcactagtacttataaatccaagcattgggagttgagaattgccagaaatagtcatgtaatgatattccatgttgtataggtgtttgcatttcttcctttctaaaaacacagtggttttggaaataataatatcctagaacagtggtcctcagctttttttggcactaaggacaagttttgtggaagacaatttttccctggatcttgaggggaggggaggatggtttcaggatgaaactgttcccctcggatcatcaggcattagattctcataaggagtgggcaacctagatcccttgcatgtgcagttcacaatatggtttgcgtttctatgagaatccaatgcccccactgatctgacaggaggtgaggctcaggtggtaatgctcactcacccaccgcccacctcctgctatgcagcccagttcctaacaggccacagactggtagcagtacatgacctggaggtttgggacacctgtcctagaacatcctggattaagcaattaaggatctctgcaaatcctagctccattgctcaactttgaaaagttgttggactgttttcagctttgggtacctcatttgtaaaataaagaaattgaattacaggcacttacaggtcctgcaattccccgtaactcagataaaaaatagatccctttctcccttcaggagaactcatgactttggtagcagctagagttagcatttgctcatgcttttattgtgtttagcaatcaatgggaagtgcatcaggtgaaatctctcaggcctgcatatgtctggtcaaagctcattcattgattttttttttttcctgctgaaacttgcacatatataaaaaacgaagacactaaatttaattttcaccagctcagtgtatagtattgtggctgctcatgttcctgaagagcgagttgttctcaaataataaactaagctgtataatctttaaaatatttgaccaggtgggaagcctttctgtgaggacaatgtgtttgtgcgtttggtgcttaagcttcaatcccctggccacagcttggatttatttgcaggggaaatctgctacgtaagaagacaaccactttgggcaacattatcttcatcatcagcatgcacgtgtggtaatgacctgttatgagcctgacttggaataactttcttcctcacagaatggtggatactccatatgtgtagaattactgagagtaattatctttgcaacagtaaggcgtgagggtaagaaatcaataaagcagaagggaaagatattaacatttatcgaccactttctgcatgacagcagaaggcggtcaataaatggcatactttattttaatcgtattaggtgattattgcagtattatcttaatttatgtgtgaagaaattgtggtccagcgaggttaagtcacttgctcagtgtccctcagtattaagtgataaagcagaggtatcaacctaggataccctacaaggtttggcttccatctggaagcactgagtacctgggcccagatatgagacagggtcccagcccagagatttgttggtttatcattccttcagcaaacacagcttacttccaagagtgtagaaattggggctgtgcttcatagcaagataataagcatcagaagggctgggtgtggtggcttatgcctgtaatcccagcactttgggaggccaaggcggttggatcatttgaggtcaggagttcaagaccagcctggccaacatggcgaaacctcatctctactaaaaatacaaaaattagctgggtgtggtggtgcacacttgtaatcccagctacttaggaggctgaggcaggagaatcgcttgaacccaggaggcggaggctgcagtgagcccagattgccccactgtactccagccagggagacagagtgagacaccatctcaaaaaaaaaaaaaaaaaaaaaaagccatcagaggagctacagtgatgctggtgaggcagacatttcctgactcatagcaggttacctttgtttcctcgttataatgagaaaaagttgccttccctggacttcctcctattcatcttttttttcctgtcctcttcttgcttaggatgccaaggctgtgacatttatttctgctctcttccctttgagatatgctgaagtcatttaaaaaaatgtcaggaataaaatgcactaaatgatgactgtcttagaaaagactccagttaagctgtgtgcatccagaaatgcaactgtgctgaccagtttctgcctcccttgccctactgataacatgatgggagatgaagtcgtttttcaaaagtgttctgggtccagagacgtttgctcgacacctgtgccctccattggtctaaaggcattagagtttttctcccacaatatttgtctttgttattttgaatttatgacaccctggttgttggtgtttttctttgcattcatacctgactcttgacctccaaaagaaccagtacatacattttactttaagctgggcatttttgtaatactatgcaaccttgaaaataatcgcagtgatattttgcttttttataaggccttctatccttctttgctcttgcatctctctttcccctttatgacagtatagcagaacatatttcattcttccctgagccctctgcagagcaattttgtaactgatttgagccatgtttttgatggagtatctgctctctggacctttccatctcctggttgcaactgtgaaccaccctgcctccaataatctacatccaaaatgctgagcaggagatttatggaatttgtttgaagatattccctgaactctctgaagctaactagttcctttgcaagtaagtggctggaaacctaaagatcttgtgaactgggttctagaagcatgggataacaaatgtaagatttcagactggaagttaaaagcgagttttcctcttgattcagtttctaaccagtcagctaaatggtctctgaatagttgtagctaatgagcaccatcccccaaacagtcaattgtcttgactattaaatacttaaatccatgtattttcgctggagtgtttattactatgtgttcttaggaccataattataaaatgttaagttaggacgacacagaatatttttctctgagtatttttgcctctttcatcagataagatgaaattcatttttattttattttacattattatgattattattttgagatggagtctcactctgttgctcaagctggagtgcagtgccacgatcttagctcactgcaacttctgcctcctgggttcaagtgattctcttgcctcagcctcccaagtagctaggattacaggtgcatgctaccatgcccggctaatttttgtatttttagtagagacagggttttgccatattggccaggctggttttgaactccttacctcaagtgatctgcccgccttggcctcccaaagtgctggaattacaggtatgagccaccgcacctggccgaaatgcatatatatatatacttttttaatggaatgcaatggaatattgtgaagtagtaaaacatgaataaactatagatacatacaacatgggtcagtcttactaatgactgtgagtgaaaaaggaagctccagagaaatacgcgtattatagcttggttataaaatttggaaacttgcaaacttcaacaatatactttttttttttttaaggaagaaaacagacaaaattcagaatagtggttatagttggggtgaggtgagcccatgagtaaatactggtaatgttgtaatttttggactaaatcatggattcgcaattcttcattatattattaaaactaagttttaaaagacccacaaatgggccagtgatgatagtttttccagaattgatagccatcaattctgatcatccaggatccttggaaataaattgcatggatgagctcattcatcacaaatctggggtctttaaagtttctgctgttcccagttctttggattcatagctatgatccttagagggcaacagatctctcccttctcatggcagaaataaaggtcagatgagaatgggagagccatcagatagagaccactgtggaggagtttgcgctttgggctgagcaaagagaagaccagaatcttttggtaccatctccttctgcatttgagatgaaacttagtcttttaaaatacatgcagccccagtcctctgtgttgccagtcacctgagctacctttgggggtagggttttgattaaatggcacgctttgctcatgagtaaccttcggggcacattttgttggtaagaaataaatgcatcactcatttgaatcagagctgcaagtgccatctgtgatgcactcctccttcccattatcacacaaatgtgtttctgtgtgactggttcctggattttgcaggctctcttgccttgcgccgattgctggctgagaggtctcagctcagcgttcaccacgtatcactatatttctattaatacttctgctcttcttggcaaaacagaagtggggcttcatttgaaatgatgggctggggagaggggaagggaaccatctcactcatagttattgacatcaagctaccatcatctcttgttcggataactatgagatttttctgctccctttatgcccccgccccaccccttcccagccactttctgtcctctgccagagtgatcttgtgaaggcttcaatcagaccagatcattctcctgcttaaaaatccccccgtcgtttcccgttgctcttagaacaacatccacactttttatcctgcagtagggggctctccatgctctagcccctgcctatgttcccctcctcatcatgcctttctgccctttgttcactatattctagtcaccctggccttctttctgctcctcagtcactccaagctcattccctctgcaagaccttggcatatgccatttcccctgtcaagaacgttcctgctctaggtcttcgcaaagcttacatgttctcattgttcaccgaacagtcttccctggccacccaatctaaagtagtccagccccacctcgaaggacactgtctcattgcaccttttattatcatcactgcatttaccattctctgaaattattctattcacttgtgtgtttatggctgtcctgattagaattaattttcataaagagaacaagaatcttgactggttcacccttcaattccttgtgcccacaacagtgactggcacatggaaagcattcagggaataaaagcacaatggaaaattaaaacatactcactgcatgcctgccacctatagaaccaaattaaatcactgccaatatgcatggggaaaaccttcccatttttctggaataatgttacaaaggatggaaaataagtgcacatcacctggatggcatttaataaacgctgtgacccagtagtgtacatttcagtgaatattgccaaaggaagtaggccaacatcaggtaatctgagttaactttcctgtacattgtgtattcgtttcctgatgatcaaaactggattaattagtctacaatgtatctttcctgttagatacgaagattatctgctctatccaatttgtgttttcttagctgagaaatcactgttgaattttaaaagcagcttgcctggtcctcatttcctggtcttctgatggaaatggtttatggaaaaaaaaatatttactagagtcagataattagaacattttatgtattttgcatatgctaatgcgtttgagttcctttgagggagagccgcatggcataaagcagaatgaaaaggatgattcaaatttcttcacccagcctcctcccctggccagatttagcacttcctatataccaccacctcacagcttagcttggctgggagctcctcaggtttccaaaggacggtccttccttctccctcccccaattgccatccctacaccagggtgccaactcccaagtgggctgacaggaagggagattggaaacagctttatagtagatttgatgctgttataagacacgttgtaagacatcaggtaaatatagcacatcagattttattaatcataagaattctttaaaagccttcagcagagccgagatcatgccactgcactccagcccgggtgacagagcaagactccatctcaaaaaaaaaaaaaaaaataaagccttcaacagtggctaaacacaaaaccagaatccctttagatttcttaaaatgcctttgtagttcttttgtaatatgggtccttgttggacaaagttagtaatttgttttttatatcctttacattaggggtttctaacccccaggccatggaccagtaccggtccctggcctgttagaagccgagtggcacagccggaggtgagcagcagttgagcgagcgttactgcctgagctccgtccacctcctgtcagatcagcagcagcattggagtctcacaggagcgtgaaccctattgtgaactgcacatgcgagggatctaggttacctgctccttatgagaatctaatgcctggtggtctgtccctgtctcccatcacccccagaaataaagtttctatgattacaataaatgtaacacacttgaattattcatcccaaaatggtctctcccgactccccactatccatggacaaatcgtattccataaaaccagtccctggtgccaaaaaggttggagactgcttcttttaatgatcatgttcacatacggacagtgaaaaggtgggtcttcttagaggttaaagggaaagtaggacagttgccacaaagctccctttttggagagtgcccagccagggagtgttactagggcccaccttggccttgctgatgtcttcagtggtgtccttgaagtcagcatgggattggcgcaggctcctgttggggcactcggtgaaggtcctccctcctccccagtagctctcatttccagggcccttattttcttttggccatctgggactgaagtcttgctcctggtgggctatctctgttgccctatcacctttagtgatttccactaaataaccctcttttaagcatttaggggaagagggagtagcatgaacgtttattgtgcagtggggtgagaaagtcagtaccagtttcaacacgccctccagctgccttcctccagggaggggacttcacactggctgtctccacagatctgcagtgcccttgccatagctccaactcctggccttctcccactccccgctgcctgctggcacatagagcccttgggccattctctgtgtggtattggcccctgcctttgcttatgctctctgctgtaagcagctaggcttagacttccctaagaggagtcccggacaccactgaggatgcattttcccttcctcacgtgaagagagcattaggtgcccttagctttggagggagtggagctttggagcctggagacaggggaccaggaccagattacccagcctccctagattctgctgaactcatctttcagtaaagaggccagatgagctgagctccacttctctctggctccatgttcctgtgacttttgactcatctgaggttgactttgagaaggcaatcccttttaaatatattggaatccatgtagtatgaccctatccactgtggaatcttactccattttactttaaagagaatgtaaatggtttggctgcacatcactatgaaaatggcctaagtaagcagaacggagaagctgccaggagagcagaggtggagagtggaaggggccaagccggttctaaatcgttttctgcaggctcctgtcctcagatgtactcacttcatgggaaccaaatcacatttaactgctctccagctcttaaaacaggataacttgagccatctgatatttgagaagaatacagcaacccagaagatgtattaatactctattctctaattttccagaataagtcagatcattgacaaatgacatacttgggctgtattaccttcctacagaaagactttcactaggtttagtaattagctatagcttcagccttttgttttgttttgttttgttttgttttgttttgtttttgagacagtctctctctctctgctgcccaggctggagtgtgaaggtgccatctcggctcactgtaacctccgcctcctgaattcaatcaattctcctgcctcagcctcccaggtagctgggattacaggtgcacgccaccacacccagctaagttttgtatttttagtaggtatggggtttcaccatgttggccagtctggtctcaactcctgacctcaagtgatccacccacttcggcctcccaaagtgagcttatgtctttttgaaggatggctatgggaaaagtccacttgaaggatgttttgtcatttatttacttactgattaattaagatgggaaagtcttgctatgttgcccaggctggtctctcgctctgtcatccaggctggagtgcaatggcacaatctcagctcactgcaacctccgcctcccgggttcaagtgatgctcatgcctcagcctcccaagtagctggaattacaggcacctgccaccacgcccagctaatttttgtatttttagtagaaatggggtttcaccaggttggccaggctggtctcgaactcctgacctcaggtgatccacctgcctcagccccccaaattgctgggattacaggcgtgaaccattgcgcctggcctcagctccctttagtttttaaagatagacttcctatcttataacagttttagatttacagagcagttgcaaagatagttcaaggagttcctgtattctctgcatccagtttcccctattattagcaccttaaaatagaatagtacattggttacaatgaacaaaccaatgttgataaagtatgtcaactgaagtccatacgtttttcatttttcctagtttttacctagtttcctttttctattccaagatcccataccatattacttatagttgttgggtctctggatcctccacagcaatttcttagacttgccttgtttccattatgaaacacttcagacataccaaaagtgtgtgtgtgtgtgtgtgtgtgtgtgtataaagaataccaatataaccagcattcagccctggaagcagaacatgaccaacatgattgaagcctcatgtatatccctcttgatctctttctccttccctcttcaaggacgaccaatatcttaaatttggtgcttttgtcccaggcatgttttgaaacgactatatgtagtgttgctttgcatattttattttatcgagacaggatctcactctgtcacccaggctggaatgcagtggtgtgatcatggctcactgcagcctctacctccccgggctcaagtgatcctcctacctcagcctcttgagtagctgggactaaaggtgcatgccaccacgcccacctaattttgaaaaaaattttctacatatgaggtttcacatgtcgaccagggtggtcttgaactcctgggttcaagtggtcctccctccttggcctcctaaagtgctggcactacagcagtgagccactgcccccagcctgctttgcacattttaaaacaatataagtattataagcattgctctacagtttgcttttttccccccacataacatgttttaatctgcattgctctaatgtatctagtttctaagtcagactctgttgtatgaatcccctctcttgttgatggatatctaggtgttttcctttctgttgctgtcatggtcattgcaaacagtgctgaacagacacctttacaagtcaccttatgcacgtgagcaagcattctacttggggagaggaattttggggtttcaaattttatccttaacaaagcagtttattcattcattcagtaaatattgattgactatgtaaaaactgagccaggttctagaggtaaacagaacagaaataatccttcatttatcatgagtttacaatctaattgggaaaatgaacattaaagaagtaattaaagatatgtatgtactatacagctgtatcataaaaataaagaacaatgtattgtgtgccatgaaaaaaatataaggcttattaagggatgtttcttaatgtttcttgtatcataaattacctaaagaatttctggacaggaaaatgctactctcctactgaatttatgtgctttctttatcgaacaatggaagcaatgtaaagcaaagtgtttcttttttgccttagctactaggagtagctctcatgtagatgctgtgcccagctgcagtgcctggaacagcccagctacatttagtatgtttatattttggctttttaaataaatggttttcatattgttctatgtcttgttttgcatgctgaatcattttgaatgtaaatgaggtatagctcttggagagaggacaagatatcattgataagtggttggtgacccccacttttcttttcagagacaaatgaccttgcttttacttggtcttgctgtatttatatagggatcttactgtatttgcatgcttgcttaatttcaatataaatttatgaaatttattatccatcaagagtcaatttgtcctctaaatatttcacttagatgatgattttttttaatcaccaccaacacatacacaaacagaactccttagcaattccatttggctgtactgctatctttaggaacatttatcttgctttaactcctctcttttttacagacatttagttttctgtgacattgtttactttcgttataccttaattatgggattctgataaccatggaggagtaggagagacaataaatggggttttgtgggtgattaaatgctaaagcaaagctgagatctttgataagcacaacagttgtttctgccagtatattccaaaggcaagactattcttgcaattacacaacaagcaaggggggagaaacacctcccacaaatcactctgatatgtttcttaaccactgtgcttttgaaagcctaatgctctttcttctgatgtttttttgactgtcagcctgagtagttggctcttccttggtacgaggctatttaaatgacaggtcctttctcagtgtgaatgtgtcagctatctaaatgagtggttgaaaatgtacctccgcatcagccatgtggaccacggcatggtctgaagaaaattatgtttgagcagctatgattgagctcaattttgcaaaagcttactgagttttaacaaataatttagccctatcaagcagaagtgcatttggctgcaggtaatagaaaactgaatcattggtggttttagcaagtaggttttctttttctcacatgacacagattggcaatactgtcagagacccagtttcttttgtgctttctgctctattttttgtagtctttcagcctttatcgttgggcttattgtctcagggttgcaaaatgactggtctgactgcagattttctaggagggaagtgcaaagtggtggtgctggccacagctttccttctttgtcaggacagcaaaagtttcatcggaactccccagtggacttgctctcttaattcaaaatggctgtaacagtgtcacgttggctgcacctgtttcaaagaaagttcagaaaattgggtatttcacagacacattaagatttcaaacaaagacgagagcattcacaaggaacagagagggaacgtatgtggatggggcaagtaactgccagtcatcagcctgttatgtactgtacacatagagttttgctgtgcagcagcaaatataaaaatgaatgtcatcaccatgaaagtggaaaaccgtatttcaatgtcatgcaaatgccataattgaaatgaaaagataggaaatgctggtgcattgtctacattaatgtatttggttgttgactttattgcataaaaagtatcagtggggacgagatagttttgctttgtttcagaagattttgcttttgtttttcccagctaagaagggaaccttaaaaataatgaggagggccgggtgcagtggctcacgcctgtaatcccagcacttttggaggccgaggcaggtggatcacttgagattaggagttcaagaccagcctggccaacatggtgaaaccccatctctactaaaaaatacaaaaaaaattagctgagtgcggtggcacgcacctgtaatcctagctacttgggaggctgagggagggagaattgcttgaacctgggaggtggaggttgcagtgagctgagattgcaccactgcactctgcactccagcctgggttacagagtgagactctgtcttaaaaaaaaaaaaagaaaagaaaaacacacagatgtatgaaatagagcttattaattctgtatatattcacagaaaacgcatacttttatgccttgattatctttaggtgatcatggggaacaggagcccaaagataattaacaactgtgctaaaacaacaaaacctcaattgggctacaaatgtcaatatcatgtacacaggtggaaaagactcttctttgatttcatatttttcttttatttccttggcatccctgttctggttatgtcttgctgtgtactctagacataggttttgtgggttgactgagctcagccgggtggttctcactggggtctcttatgccctggctcttaaatggcagctggggctcctacacatggcatctccatatggcttaggcttgtcacagtctggtggctgggttctgaggctgaagtttccaagagaccaggggggctgctgcaaagcttttaacctgagcttgcaagtcatgaagcatccactttccgttggttgtgctggacagcccagatgaaggggcaagttcccaaggacgtggatacctagaggcatggttcattagggaccaactttggagacaaacaaccacagtctccttccttctcttcccttggggattgaaagggttatcaaaagctggccagaaagagaagcaaagggtgaggataccgctgctgcagcacgtctgtagtagggaatgaacccagaatgtgaagagttgccattctagtaccctcgagtgtccttttcatgccattggaaacttgacaatagtaattgggagtgagttgaaatcttcagctttctacctttgtattgtcctttcagagcaaaaagaagtaaacattaacttaaaaaatgcttttgatattaatagttacaaacaaaaaacaaaacatgcaacaattccaagctcaaatcaaaaccaacactgagctttgaggtgcaatttctattctatgtgtgtggccatctcctcttgtgttagtggctgagcagagaatgctccattccaaaataaatagaattaattttcttaacagcatctttctttgtgccaagaacacagggttacaggaagcacatctgaatgtaccattggcaggttaaatcattctctttactttggtctttggtgggtttttatgtttgttgcttttcatctgaatgaatggcaatagagcaagttttaaaaatccttagggatctccagagattcctgtcttgctaagaaacaggaaggccgcaattagcagagaccaagaatgaagaggaggagaagggggcgggtgtctttgttgctgtaaactactagttttcaccattctgcaccttgggctgtgttgctgctgctacctggaacacccttcctccccctcctctgccgggaagactcccacttagcccagatgcagcccagctgctggcttctgcatgcagcccacctcttcttgctggacagggtggcgtcttgtcccccacacccacaattcctgtgcctatcactttgtctctgtattccttcctcagattgtagctccttagtggcagggaccagctcttagcctgatatcatcagccaagcaacgtgtaggatgcagaggtttggcaaaactttgaaagcgggaatgtatagtcaactatgtcgatgtctgggtcatttttccaatgtctggtagcaattgtgttaggtggcttatacctctcctggacccacacatagcaaattctaaaaataacaaactggaccatataagcttttccaaaagcctggggtgggggagatgttataatatcctgacatagctgtgctgttgttcatttcacctctgtcacctagagcaaccccctccatgttttccaaaaccgcccccatcctcggggtctggtttgggacccctgtcctcctggaggtcctctttgaaccctctggacccttctctcagagccctctggtaccttgatgtcacagcatttcctgtaatttcatttccctggcctcttggctaagataataggctcctgtccttgctttttctctgtcccctgaaaggggtgaagtcgtgtggacatgtggcaggtgccactattgtttatctgctgaacactagcactccccgtgccttcatgccatcaggcagggggcatttgttcttttgacggtgtggacaggggcagagtttagtggcattgttcttttttagcttaatgagcacgaactgtcagagcttggaccaaatttttcttgcagatatattttgattgacaggcacaggatttttggagataattgaaagagttgccaacatttatcaggagactgtacataaaaatacagagttccagtttccctcaaaaatttggaagttttggcaaaattgagtcccaattaccaaaaattgcttctaaccaagcagtaactattcccttcacacagaatgagcctcccttccctcatttcctgtaaaatggtactgcatgttctcctctttcatttgtgtcacctgcctcattggtgggtaagttgttctagaaaatgtctatcatatgtgctgctgtactgctaagtgcgtagagccctagtacccacagggcacacacaaacaaacctggtatacaaagaacttctgtgcggatttctttcttattgtgcacattttaaggggcatcagtctctgtccatgcatccttagaattgtatggctttttcatgatttgatttattcaacaaggatcgaacagtctgtttgtattgagtatttactatatattagttactgttctaagtataaactcattgatctcacaactctgagatgggtgcttttactatctccatcttacagatgagcagcagtttttttgttgttttttgaaatggagtctctctgtcacccaggctggagtgcagtggtgcgatctcggctccctgcaagctctgcctcctgggttcatgccattctcctgcctcagcctcccgagtagctgggactacaggtaccagcctccatgcccggctaattttttatatttttagtagagacggggtttcaccgtgttagccaggatggtctcgacctcctgacctggtgatctgcctgcctcggcctcccaaagtactgagatgacaggcatgagccaccgcaccctgcctagaagcagctttaataccaggtcacacagccaggaagtagactagctaatgtttcaccttaggcacaggtggagggagtcacacatctgtaagatttgttcccaggacaatatcattttctttaaatgtctgttttgggaggacttcaatgagctctcagatagaaacacccatttccagggagcattcttaccctagaaaaagcttgggacagttgtattcagacagctctgctgttgaccatgtaaggaactctctgccactcttcctcatagctttggcggggattatttgtctttagacttgttcctttttgtgaaagtgacagtagtgatagtcattagtagttagtagtcatggttacttttgttgagcacttacagtgccaaatgtagtaagcactttcaaactgtattactctccccgtttctacttgggaaactgagtattactgtgtgagtgatggggacttcttgaaagatcctaaacatgggaatgtcgtaatcaggttgctgtttcatggatttggttccgaaagccaagcagagagcgggtcaccagcacagtagtaagagtcaggaaaattggttgagactgttgtgtacaggggagagttgcttggggcttgaactaaagggacggtgaagagaggggtaggtttgagagagacttagaagatagtaatggcaaggcctggtaaaagacgggagtgatttccagttttacagtttggacggcagcatggataagaaagaatataaggggctgggtgtggtggctcaggcctgtaatcccagcacattgggaggcttaggtggccagatcacttgaggttaggagttcaagaccagcctggccaacatggtgaaacctcctctctcctaaattagctaggcgtggtggtgcacacctgtaatcccagctactcgggaggctgaggcaggagaatcgcttgaacctgggaggcagaggttacagtgagccaagattgcacgactgcactccagcctgggcaatagagcaagactctcaaaaacaaaaccaaaaaaaggtagaaagaaagactgtaagaaggctaagaaggcatcgtgcggacaggggagtgaagtgtcacaaactgtcagtttgatgtactctgtgactttcagttgaagatgtcacaagattacgacaaggagctcccagtgtcttcacgtagttttcccagcttactcagtaaatatttgttccctaaatgaattcatgatttccatagttactcagtaaatatttgttttctaaatgaatctatctgtaagcaactcaagtaatatcccctcctaccatttatcttaatgtttgaatttcatctccaaccacttaaatcatagtctctgggagatgggagctaggcattgacatttaaaaatgtatgttcggccaggcacagtgactcatgcctgtaatcccaatactttgggatgccaaggcaggtggattgtttgagttcaggagttcaagaccagcctgggcaacatgacaaaaccctgtctctaccaaaaatacaaacattagctgggcttagtggcatgcatctgtaatcccagctacttgggaggctgaggtgggaggatcacctgagcctgggaggatcatctgagcccaggaggttgaggctgcagtgagccgtgattatgctactgcactctaacttgggcagcagagtgagaccctgtctcaaaaacaaacaaacaaaaacctttgtgtccacagatattctaatttgtggccaggtctgacagccactgcttcagttttaatgaaacaacagatgaaacaggtctactgagatgttcttttactcatccatcaatttcatttttgagtgtctaccactgttttgagctccatgaaactcaaaagtaagcattgatgtgttcacctctgtgttcctagtaccagaactgtgcctggcacagaataggtgctcaatagatagttgtagaataaatgaatgttttatgattctgagcacttagagaatactgcgctctagtaacatacaaccatcagtgtctgtagctgtggcaggaggctttctgcttctgaggtctctctgtctggactgttgtgctattatcctctcatgtttcttcaaggcagaggggttgctgcctgggaaaggtgtacactttggagagtgaagtcagactttgctaagtgaacgcttggatacgtgttgtgcatctctgttcccaagtaccttctctgctatggactgaattgtgtatctccaaaacttgcatgttgaatctctacccccagtgtgatgttatttggaaatggggcctttggaagataatcaggcttagatgggtccacaaggctaaggccctcataggggaattactgcttttaaaagactaggacattctctgatcctttggaagtatatttcctttccatcctcttctctattacctgccttccacctgcatcattggagttggcttcttggtgttgacaaaccttacaatactcaggttgaagacaagagcagccgagaaggagcttttgtagggagtggttgtcagtgtctggtgctttaatatttccttccgttgggatttggaaaaggcagtcccacatagaaaattgttccagccgaggaacagcaagtctgtctgtcaatctctgggtatattgaagacatctctctgagtatattccaaatgtactcatcagtgacgtactgcttctccagaaggtccccttaggaagttgaaaaagattctaattcctaacacagtagctcctgctattttcctatgtatgtttttttctcgcttttatcttctgctttaccaaaatacatttacataaacaatattagtatgtgtacagaaaatatgaataaagaaataaagattaaaaaccttagaagaaatgaaaataaaaacttaagaattggaaaagaattctaaaatctcaaggttgaccaagctggagggtttttttgtgcatatttattgcagttctaccttgtgccaggttttagatactttcttttaatcacagaactttacaagatacgtattatctctattttatggattagaacatttaggctctgaaactcaagggcatgtagctgctacatggtagagtcaagattttaatttagcatgcctaactgtaaagcacctttccttggtctaaaggccagtgacagttcctaatgaaagttttcacacgtacacaatgaaacaagaaaatgaagacagtgtagaagatttttgataaagcaaaatacaattaactttaagaaacctgttcattattttaaaatacctatattggctaaagtttggcaatctaacgtcagacccctaatcattatatatatatttttttcttaaaagtctactcgttcgtgaaatcacaagttcacactcagggttcgtgatttaatggtggaacaaaacagaatatttaaagttgggaatgttccagaaaagctagatttacaagattgtcttaaggccccaaagaggaaacaaagatttggcttgctgatcagagttaaacattgtgtacaaaataccttaggaggaatttgagacctccgttatttcagacttaggaaatagccctttcttatctctcatataatggtacctgtctctcaggaagctaggcctcccttgcagtggtaatagctggcctgtggagccccttcacattgcattacggcaattccagtgcctccctttcccgttaggaatctaagcttgtactaccttttaaaatatcttcaagagtcaatatgtggatatctgagtgtcaaatctggcatgcactgtatttaagtatcacttaggaagaaaagcaaaaccctcagccccttgaaatgatttttaaattaactttttggtggaaaagtcccattttatctgtgcaacttaataccctttgtgcaattttagccaacttcttgaaaacacaggaggaaaacaacaactttcattatctcttttgctctgaatagcagcaatcatcaaaccaacatccaccaccttcttgttctcctgaacttacgtatttttgtatatgcaacaacttagggaaaaacataatggcaggaaagaaaaccttttcccctaagtaagaaaaatcacagaaaatcattagtgtgctaattaaggaacaaaaatcaaattgtgaaaggtttcttacccagattgaaatgaataggcctgggcttgttcccacagtggagacagggctcccggaagtatgctggaagcatgcaaggccacttgccgcctagactcagaaatgacacatcgtcacttccaccatgttccattgattaaagaaagccattcaggccagcccagattcaaagggtggaggaaacagaggttgcctataaaagaaggattttgaccatttttacaatttaccaaaggagtgacttggtcgaggatattaactaatttaaaggagttaatgtaggtgaagctcttagaatgcctagtgcatgacaattgttgttttgctattttttattattattactgtattctctctaggcgtttcccccaggagcttattgaacgtcctttaatcttttgttttgtttttaaaaatgatgttggaggaacaacggtgacttttcaggccctggaaatgctacatatgggatggtatcgtagaggtgtttctttgcctcccatgggcgcccccggttttgctctctccccctctaggtggcgctgtcggggatccccagctgtcccacgttgtcttgcttttcctttcctctctgtcaaaacgaattctcattcttgattcttaccactgcagtgtttaccaactttgagtgatatatttcccttttaaagaaaagcagtcttgtgaatttagttgttgttttatatttttattatgttacttaaatatgtacaaacataaagctatgtataaactaattatgcttgctcataacttttatgcatttataaaataaaggaaatgaaacttgaacagaacagatttaaaaattaaaacttcagaatttcaaaatagcagcattaacctaacatgacagatgatattatttttactaaaactacatccagacgcaaagccaccgtggcctttgatgcctcagttaccccacaccttctctgtttggactcctgcaagctcttcgaatacagtgtgctgtgaaattattatcaagttgattataaacacaaatatgagaactgaagttacctgacagtgcttggttataagatggctgtttaacttagtgctctcaaattttactgtgcaggtaactcaccagggatcttgttaaattgctcactttggtacagaggggcaggggtagggtacagaattctgtgttttaaataagctctcaggttatgcctgttggctgatctgggaatgacactttgagtacaaggatctgactatggttccatcatttgtttagattattaaacacacaaatatttaagaatcagtcgaaaacatgtttctggataggtccttggtctctagtctagtcactgcactaaaacatacaagcagttaggttgttagagcattatactagccctatgggaatcagatccagacaccaagcatgaagttgcatgtattgagtatcaggcatcagccagtaatatagggagggaatgatgattgtacaaagacctccctggacattccagatgcaactcacagatgatgactccttgaccagtgggacaggcctgatgtggttttgcctctaataaatcaaatctttccatttttacccaagtaaaattttatttgtactttccttatgatcaccactcacattttgcctggtcttacagtttaaaatgtggtacagctttctttttctatgttaatattctgagggcaaggatcatgttctattcctttttgtacttttcatacagcaggcatacagacatttgtggaattgaatgtattagctagataaatcttgagggtgccctctgctatttgcataaccaagtttttttctgaaaattccaggaattttgctctttctgttatatttcagactcgttattttatttactactgctgcttttttttcttcctaggaaagattcctaagatttaaatgactaaagcttagtctctgatatttgaacataaaccacatttttattgctcttggctctcaggtgcgctttgcttttaatttttatctgagaataaatgttgagaagattagaaacgcttatttagttgataatctgtgtgaccagaatttatcctttctaaatagttccatagcagtcttcgagagagaagttctggtagaagaggaggtagagtgagttgttctttaaaaaggaaatgcaagtttgtagagagatacccaggtgtgggctttatgcatgaaatatttttcctatgagaaaaaggaaaacagtgcctgaccttatcaataaaccattgtaagacgtcttcagcgtaggtcccaaggacattccaactgttcttttggactgagaaactctcaggtagtggttgggagaaaaagatccagaggtcgcagtgggatatttaacaaacatatgaatcagctgtatagcacatcagagaacagagagaccagacataaatgcataataaggcaatattctcatgatattgataagaactttttttctaagttctgttgatctgtctttctacccattcaatcattaatttaacattgtattgagaaattaaacacagactcaaactacacaaaataagcatagtttaatgcaaagattcccaaaatatggtctccagatcagcattgccttggaagttgtgaaaaaagcaaatgtttgcactccagtggagatttactaaatcagaaactatggaggtggggtgtttattttaacaggctcttccgaagcttcccatgcatgcttgagtttgagaaccagtggcttagcatgaactagtatgaggtggacactttgaaaccagcacctagctaaagaaatagacctgccagtcacttcagaagcccctccatgtgtcccttcccagccataattcctttctccttccaaattacccactctcttgagttttccagtaattactcccttgcctttttatagttgtgtcactgaattgcatatccctagccgcaatcatttagtcttttccatggatattaacttatctttcagtctatgcattcccccattgtcccctccttttccatacagtgtatctgatgaagaacttggactgttagacctgttggaggttctcagagtggattttgctggttgtgtactcatggtgcagtgtaacatgttcctctgaacttcctgagtatcagcagctggatataggggtttcatcaaatcttagtcctgtccttttgctaagactataggtgggactgcgttttttgtttttttcttttctttttttcatcaggaggcgcaggaagtctagttctcactgtattttgatgttaacagccatagatactcaatacttagatcgattgagagaagcataatggtgacagtctgtcatttcattttcatttattagctggaaagtcttagatggaataaatttagatcactatatggctaccttgtggtagatttcacacttgaaaagccggttgaatgctcagttttccttttatttacctaattttcaagatactgaattgcttccctgtcatgttcagaaggggaccaattaaagaaaaaaacaaaaaaaaaacatgaactactaggtttaaacgtagtggaagagtaatcaaaccgtagcaaatcatccctattgaagctcaaattgtcccatttttggccagtgggagcctcttcaacttggctcttgattccttttggtataactctagcactatttgattccttccttttttattacaggctcatcttgtgtatttcctgccccagaccaagagtcagccatttctctgagaatgcaccctgctcccccagttctttttgataggaaaaaaatgtcaaaaccacaaaccagattctcataactactgacttgattcttttttactgagtcttttcaatgggcaaaactgggaaatatccacttctatatctatatagctttttctatacctatacatagatgttatatgtatttaaatatatttaaagttaaaatacctcatgagtttatactgatatttccaattcaggactacagggttttaacgtcttctgtatggcatctatatcttctttttcctgcccaaacaatcttgattctcaaggacatagagtatgctagattagaatatgtcataattactcatttgcatgcttccacattacacacacaatattaatactaccaccaccaattatgattactaaaaagaattaaaacatttttgtgcatatgctattctcattttcctctattattttatagttatacctaatctgtttttatcaggtaatagttattaatgctatactctcttccatttaacccccatttaatgttcttagtttcatatatttgatggtcatcaccattttcacgtcaatgacatgacacttggttgtccaaagctcattctgtagtagtcgccttaggaagaagttatgggaacagaataccttgtgttcttacatgttgaaagaatgttttctctacttaatgttcatttttgcttggatataaaatccttggcttatattttctttcattgagtaccctagatacattagatcatatccttctggcataaaaccctgtcaaattctagtgataatccagtttttattttttcttacaagtcacattctctttttgcaagaagcccatagagattttttttctttaaagtcttgtcattttactagcatatgtcttgatgctgatagttatgggttgttattctcacataagtagtttctttttttgtatcttaggacagtttttcttgatttatagtttttaaaatttgttatgttttcttgttttactgtttctgccttctttagagactcctgttgtccttatgttgcatcttacttgtctgtcttcaaaatttatcaattcttgaaggcttcttatctttcttaagttcttttgatttttttaaaaaaatttaatttcccccttctacttttgaagttatttggttttattattcactcttaagtttcttctagttaagcctttttaagaacatttctaattcttttctaagctctgtcaccttatttctgaactttttctagttccaatttatattgttccttcatgtctagcgtgttttcttagtgtcttttggcaaatctggaaattgtatgttagaattgtgatctgattttggagccagttttcttggtgtgctttcattatctgtggaaatgttgttttattcgttttcctcttttatccttaagcaataatgtgtggaattttctctccatgcttttctgttgctcattttcctcacgttttagaaagagactttgttcagatggatttttctaacttcatagagctctgtcttctattgtttttatgtaattttttttaaaaaacttgctttgtaaatttttatgttgttttttccttttccactgttacctgaatcttctctttttttttctttctgttttgctcaattttatttttttcccagcagcttctctccagtgtggtaccttgttttgagagcaggtgctggctaattgtgtaacaatttgtgatttatccttacctatttgtatcttgatgtttgtgaggataccttgtctcccagttttgttgtaaatgtccattaatttttgaacattctgtttgatttcattgctctgtctttcgacatgtagggattctaggagttccaaaaactgtgtcactgctaccactgccatctcctcaggaattcctcagtttttcaaatgatgatttttgaaattttagagtctataacttgagagatatagcatttttggagctgggacaaaaaagtttttaacttaattatgggaagtaatgaaaagaattggcttctaaaatgcaatgcagagatgcataaatgtattctctttatcttgcccaattacagagcaaaatagatgacaatacagaaataaacatggtctggagtagaagtaggttaatccgcatgctttagattgacttacagtatatacactttatttcttcattcagtgaataaatttatatagtgccttacaatggacagatactgtacaacataaaaaatatgttgacccttgcctgtctggcctaccttgaaatgctgtgtataacaaaattacacacagaagacctcagatgtggcaaagtgaagtgagagggaagtgactttcccaataccacacagtactttgagaattagaccacaagcctggatatctgtaactcccaatccaagacttcttccaccccaatattcaatctcattactaagtgtcaagaaagtggatttgttaccaccaaaaaaagaaaactttctgacattgagtgtgtgctgttttttgaagaatgttgtgaattctctgttcttaaaaagtcagtagtgcagctttcaatgtagagttcttttgttcaggcttacacaactatcaccattcaccagataacttgctgtattccagacatcattggctgctttgtatacatattcttatttaaccctcaccacctggcaaagcattgtcctcatctctagtttacagaggaagagacttattttaactcagagtatgttgtccaaaattaccctgctaatagactggtgattctgtggaaacagacactttcttcttttatatgtaaagtgttctgggtaacaaataatacactctcttctcatcactgtgggcaccatggtctgggtgcctcattggcctctctatcccctcccaacacatacacagaagagaggagaggagagaagcatcctaaatgcttgactctctcggcagaaagtctactgtgtctaatggtcttgtaggagggaggcagcgacatctctctccctgccttcttcctttccattcccctctctactaaattagctccctgagcatcagagtgtaaatccagtttctcttacttgtgcaaacatggacattcttatgccactttgtgtgtaaaatttttacatgaagtctataacctgttgctttggtatgtaaggctgtagaatgagcaataacgaaaaccagaaatgtttgggggaaagaagtttttgtctgatcttctatattcattgacccagacaagtgtcacaaggaccatgagagtctggggagcctgggacattgcccacactctgctaatgaagaaactgaaccacacctacatctttgtctagtcacacctagcagcctctgaccttgctctccttgcctcactctgatccctctagaatccattgcacataccaaccaactcaggccctaaaactcttcttttgtgaggttactttccagtctttaacctattggctttttctcattgttcctcaaatcaaatctgaactccactgtctgcaagactctcccgttcttttcctgaccaccttggctgacagctcttggagaagagggcttagattgataataatctgtgatcctttccttccaccttgcctagctctgccagttcatggagtaacattttcttttccacagttactgtaaaaagaaatcgattctttttagctaaagtaaatgacatccaactctccttacatggaaaaaaggcactaaagtgctgacagataccatctcaggaatggatggatattcttgctgtttctcttccaggacaatcagaaacaaatttaactggtgaatggccattccatgtggaagggaagtggtaacatagggcactagattaacctagtgcacttctcagtaggattcatggtatttctatgtaatttccacttacaaattacacatctaatagaatcttaaatgggaagacaaggatgagtcatatgcccaatccacatttatgtcttcaaaatacgctttgaacaacaaagccacatatacatgttaaaaggcctagtaaacttctagaacactagaaaatcctgattgccaggatctgttagtcactccactccagacagggttttgacaaaatgccttttcccaacagaggttaccatcttcacaagaagaccacatttgtatatatgtggccagcagcattcgccagggtacgtacctcaaggaagcttcaaatggccattcagtgcgcactcaaaagggatcctcagaggagcattcagaccatttgcttaaatgattgtgtgctcattaaggtgggcagatctgcagtctcaactagagatctggtagttaatctgggtccaggatgtttcttaactaaacatgttaaaggagccggataggttgctctctactgccaatttatcggttttacttttctccttggctacagtgcaatttggctctttggtttaatccccttgagaagccagaatccattggcatgcggagctctgggtcttagagcaatatggctctaaaatgtacgaggtttattctgatggtccctgtcacattagcagatggtggcatttaccatgttgatgggagaggagtccttgtgctctcagccacagatggcccgggaggctgtcccagcagcagcacctcaccctctccaacacatgccatgtagttagttgttccctctctttgttcctataccacttacgtttgcatttctttcatgcagttcgttggtggtggttatagtcatctgttttgatgcgtgctccccatattaggctgctaaggttttaggggcaggtacctggcttctcctccagggattaagagatgcaacgctatgctcaaggtcacaaaggtgctgagtggcagcagggtaggattctaagcctcattcatcagtctccaaagttcaggcttttaattagaaggcctgtcatatcatagaaatcacaatggtcctcttagggcaaaataatgggtgtgaaatcgtggatggtccaacgataattacaataagaatcgtttatttgtttcttagaaactgaactaatcattttacaggcatcatttcagttagtcctcctaatagtcctatgcatgaggaatgtcatcaccattttcagatgagaaaattgagtgtcatagaggctaaatgacttgccaaccaggtcacacagctagtaagtagctccaagtctaacccagattgatgtgattccaaaaccctggtcttgggcatctgactgagaccccccaatgtatgggtgccttgctttatctaggctcagatcctggaggtcatttgttgttaccttgaatataagaaacacacagggggacaggcagactctgaaaatataaagttcattcccctgaatcaaatgcagaaaacagttctcttatgggttgtcccacttttcatttgaacttagtggggaccacgggaggggctgttgaaaatgaccagctctttcctctgccaggcttcctacacttacacacacacacacgcatgcacgcatgcatgcacacacatgcacacacacaccccacttcatgcttagacagtgataaagtgagtagctggggcaagccccccgacatgtggatgactatggtggtggtgatggtaggaatggtgccttatattagtgtaccttgtacgtttacacatatttatttgatctacctcaaggtaggtgaccaagtattatcagtccctttttcctcatgtaggaagaaactgagtgtcagagtaattgagatggagcagattcagactcaggactcctgtttcctgatggagtgcactttctgctaaagtaatagctttcaaactgtggtgggttgaggagccccagaagccatcataataagtgagggccaggggactcaaagacctacatcctgcttcaactggagcatctctgcttttatttgacgggtatagagggttctgcatgtggttttattttatagaagggtctgatgttctaacagtttgctactgctatgtaacaaaccactaccaaaagttagttaattattattgcccatgcctgtgtggcttggcagggctctgccagactgctctgctgcaggtggtggctgtggggcagctgggatggctctgttcctcaggcctgtcactctccttggacgggggatagatggtgcatgtcctgcacatctttcaggcttagacttggaactggtatactgtcacttccaaagcaagtcgcatggctgtgcccaaagtcaaggggtagggaagaacattgctcataatgaggctatggcaagggaatggacgcagagaggggtgaagaactggggacaataatgcaatctgcaagtccatgaaaaaattgtattatcactgctctgtttaaattaggctattaaagtccttcaagacttatttatccataaaatcaagaggaaatggctgttgtattgtaaaagacaaaggacttctacccagagataatcaggtctgaggactgttgcttctgaatggctgccagtttggattgtggtcagtgttctcatcttttcacagctttactcaggtagggtggatgtataagtgtgtgtgtcagacagagagagaggtgcaaaatagaagcacgcctctgtctatcagccttgtcagcttcgatccttgtttagtctgtgctttatcttctcccgtctgtcaatgatgtcccccaccatttactgcaggcgggtctatagatccagtctctcccctgccagtctctctttgtttgttgccctggtgtcactgcacctctgagctctaagtctttaccttctgaaagccattcctaggacaatcattaaaacctatggtagttgataatttctgaccctaggctggctaatttgccttcataaactgtcagattctgctaaggtcattgaatgctgtcatcttcataatgtggttcaagcaaaatggataagagaccaaacaaggagaaatctccctagaacacagtatgccagcattgctgtatctcaacaattaaaaaatggtgcgggagttacccagtagaatatttagtgaggtgtactctatgtggagttcataaatacaaatgcaaaatatttaatgcacagaatcagagttgcaaaataagatttaattctagaggattagggagacagaactgacttaaggctgtttttcccagtaagcttaattacttggatgacaatcattaaacattgcaagtcacctatcccaagtgatcgaagggcttttcaccaaatgtctgagtgagaaagtgattatcttatagaacaaacaagtatgataaagggaaacaatcagacaagtaattatgataaagaaaaacaagaaaaacggcacatccagcctgttttgtgggaagaatcacagaggcactatgtaagtacggctcctttatctaacagatcatttactaactatctggagtcaaagtcaagtttatctacatgctgaaatctatttccttctaataagattccatccacttggatctcagttatgtggcaatcttgacatggaacgtgtctcggaatatggaagggcatgagaaggcaccaaatcttcaaccctagcgctcgctcagggtttgattagagaagcagaatcacaggattattttacaggatttcttctctggatttgacttacgcagctgtgggctctaattaagcagacaatggaaagttgctgtgtctctctctgatgctgggacctgaggccagcagggtaggcagttgggaagggaaaatggacacgaagctggggaagcaaagacaaattagaacccatggggataagctggaatccatcaagatggactgaaacccacattggtctcttgctgcctttcaaggaacttccatgatggaggcgacttccaggagaagccgactgcccttctccatggaactcagcctgcatctgcccaggagtcagaggaggtgagggaggagatctgggaagggctggacaggcccatctgcttcctgccccctcagcctgctggtgagccagcagataacccacaaaagcctcaacagcccctggccccccatcaactttcaaaggcaccaatgcaaaagactatagctactgcttcagttccttcttccaaatgtcatatgaaatgcctcttaggggtctatactaacccagaactgtgcaggagagagaaatctgggaaacacagttccagcttagctaggttgacttgctataagtcaaccacacctagtctcactaagcccatttgtcatgtgtggcccactcagactgaaagaatctttgttggttcactgttttataagggccagcctttaccagtttgtccagctagggcactaagttcttagatgcagacatcagttctgtattccctgttaaggatctgcttccttaataggaatctttaaactcctgaatttgtaatgacacattcaaaagcattatttgagactaagcagtaatagtgtatggcaagctggacttacagtcctgtgtgatgtagagatacctaaacataaatgggcatggatattgtacacacatatgtgatgcaaataatatacaaatattgacataggatgatctagagttgataccagacagtcctcatcagtgcactgatgaaaccccagaagaaaagaggtttagccagcaagttaacccatgctgatgagcatctaccatgtggcaggtagcttctagaggtgcaggggatacaacagttaatggtacagtgtcagccgtgaggctcttacattgttttccaggttttctcaaccatgacatcattggcattttctgttgggtaattctctgttgtatgcatctgtcctgggcattttaggatgtttaacagtgttcctggcctttgcctactagatgctggtattcctccctctcttcatccccatccccgctgcagttgagatcataaaaaatgtcattaatcattgccaagtgtcacatggggcaaaatcatcctcagttgagaacctgtgtttcagaagagacagaaaaataccactgagatactttcagatgctaataggtgctcttaagaatataaagtaggctgggtgcagtggctcatgcctgtaaccctagcactttgggaggccgaggcaggcagatcacttgaggttaggagttcgaaaccagcctggccatcatggtgaaaccctgtctctactaaaaatacaaaaattaaccaggcttcatggtgggcacctgtcatcccagctacttgggaggctgaggcaggagaatcacttgaacctgggaggcggaggttgcagtgagctgagatcatgccactacactccagcctgggtgataaagcgagactccatctcaaaaaaaaaaaaaaaaaaaaaaaagagagtttaaagtagagtgatatggttacatgactaccaaggtggttgaggaagcccttgccgaggaagggcctttgatttgacatgcaggcagcccctcagagatctggggacaaaatgcatcaagcaaaatgaagagccagtgcccaggtcctggaggggaacaaatgtggcatgttgaaatagcaaaaaggctgggagacttgcagcatgggtgatatggtttgggtgtttgtcccctccaaatctcatattgaaatgtgattcccaacgttggaggtgggggctggtgggaggtgtttggatcatgagaggagatccctcatgaatgtcttggtgtcctccctgaggtcatgagttcacacagcatctggttgtttaaaagacctgggatctcccgttctctctcttgctccagctctccccatgtgatgcattggctcccccccacccttcacctttcaccatgattgtagcttcctgaggcctcaacagaagcagatattggcaccgtgctttgtgtacagcctgcagaactgtgagccaattaaacctcttttctttatagatgacccggtctcaggaattcctttataacaatgcaaaaggactaacacagcaggtgaggaagggaagagaggagggcatggggtagggaaggacagccacaacatgggggaccttgtgcatgggtcatggtgcacgatctacatttaactctggctactcagggcagtcatgggagagatgtgatcggggagtgatgcaatctgatttatgccttaaaaggaccacgctggctactatgtggtggatgcacaaacagctcttccccttctgcctcctttgccttgtgacccacaaggacccatgatacccacctgcagctggctgttgccatctattcggagttgtcaactaataacagacaatctcctctgccctgtgacccacagggacccatgatactcacctgcagctagctctttccatctatccaaagttatcaactaatagtagtctctgtgcctacaaatgattaaaattgggcttgaaaatatggcaccattatcatcagcatttcttgagcgctggccacttgtttctggtgctcgtgtgtgtacatgaacatccttgctgtgagtgctgggccccaccctcactgccatttaaaaaaaaaaacaacaaaaaacaggtgtctgcagcctctggtgaacatcagcttctccgtaaggctataatgggagacaccttcatagattttgagttcggctaaaataccctcctgtccagttactacctataatgctcttttcccttggatcagaaagccttttctctgtggattatttccctccatctataccccacattactaccccatgccttcataaggttttactctttactggcgttatgtccatttatatttgaattacacaagcatgaccattcatgctctttactcatagaagggcaccctgcccttcctggaaaaatgatttactttcatattggataccatttgaatatacccagctgtctgcgtggaaatagagaagtagacagaaagaagcctcctgctacagcctaggagcagaacagtaaacccaggtttccaaaatatctttctgaggtcattacagggtcatagccctggacagcactattcctaagtcatcctgaggcattctttgtgtgacaggcccaatggcatggcaatggatttcataatgaaaataatgaaacattgagataaaaagttaatttcttcctggaagagtctatttaataatgcaggaaaatgttacactttttagttatacttaattataaaatgctagaaaaataggagtggttttggtgttgaaagagttatttatctgagagaactatgaattatccagaatgcttctctaaagtttcctttttcccaaaattttattatttggcataatttcagtggaatcttccaaaagacattagtccattcttttgcttcagtgcatgtttttttggatagatattatctatttttgtgtagtgttgtaaggtttccaggatacgtaaaagttggaggatatatggttggtgcaaaataattccgtagagtaatgagattgaattgggggaggtggtttaaggaatacaaattcagtttgcctaaatagatgtaaaaaggaagggaaggaataacatctgaagctaaggaaggaaacttttgggctggagcatgactagataggagtcgggtagagctttttaacacagttgaagatagctgtggacgtagatcatgggcaaaactggtaatgtgaggatttaggaagcacgtttttaagctactgttgagtttcataggaaaccataccccactggtcataagagacattcaccaatagttttccatgggccttttgtgctagtggtagttttgttgggggcaggatttacaaaaatgaccatgcatttgaaaggtcaatgatgaaggtaagtttgagaatgaattttccatgaatgtcctgcaagttttattctttctgtgaacagcttgaattttcatttggtttgaagattaggaaaataacagtcatatatactcacagatcaaattcaagtactgattttagccatctatgagcaaaggccattcttggtgttagacatgaaacaaacgagagagaaagaaggaaagagagagagaaagatgtgatggactgccttggttctcataatttagaagtgagactataggtatatgcacaaggagctctgatgtgaaacatggatatcatatatgtcctaatggaaatgcacaaatatcctaatgggcttaggaagatttctagaaggatagggattccaatctggtttaaaagaaaagcctgaaaccttggcaaatgaagtcagcaaggatattccggtagcagaatgagcctgggcaaaggtgaggagtggagtgttgcctattttgttttgtgaggatgatagattcctgtaactggagctgcggaggaagtagatgtattggagattgtccttgaaagtatccagactgactcagacagcaattgtgaagttcttgctgatagatttgtactgtattttccatgcaatgcaagatccattagagggatttgagtaggagattgtcatggaatatttagaggatataattcagatttaaaccatggaatattttccttgatactattaaggaatgatagattctttgagctaaaaggagcactagagattatctattgaggtagtttccaaatattgttttagcacagtggaaaccttctttcaaatgacatcttacacaaatgccccagctacaaaacagatagaagagcagttcttgtggaatcatgatgggaagagtcttgatttgctgctttctgtttcttcattcctgtagcaatccctgaggtacctctgtagaaagcacaaaatcatggaacaacctgccgttttaaagatgagtaactcaaaagaaatgaaaacatattatgaaaccacacataccataacatcaccagcagccttattcataataactgaaaagcaggataccacccaaatgtttaacaggagaacggataaactgcgttgtgttcatacagtggaatagttctcagatgtgcaaagaacaacttactgattcatgcaatggcatacatgaatctcagaaatattaagtaaaagaagcatgacccttggatttcatttatatgatacacaagaacatgtaaaacgaatctagggggaaagaaattaggaagtgatggcctgggtggcagggaggagaactgattcaaaaggagcacaagagaactttctgggatgttggaaatcttctctatcttattttgcgggatggttacatttgtgtattccgttgtcaaaactcatcacgtggaacacctaaggtgtgtattttattgtatgttaattgtatcttaatgaataaaagttgagtttgaagattcttggagggagatttgctcagttcccatagctaggcatgagaaagactagcagctagaacttaggtttacaggattcctggtccagctcttttaaccgcatctctctccctcagagtcatcctcctcttcaccaacacagcatcaaggctggcttctccctccctggacatcctcttccctgctcaaaccccaccgtggctgtgaagtattaacttgacgacactgtgctctttgactcagcttttaaactttcctccagtgaaaccagaactggcaaacacagctacacttttcttgtaccatgctttacctgtattgccaacctgctgataaatggctccattccatagccttgagggtcttgaatagcttaaacattttatagttccatgggaatgagacaggggagaagacaccagtggcttccattgtaggcctgtctacactgaaggaatgccaactgcccacacacacttgttgttagatggcctggaggctcatctgcacagacgtgcagtttaactccattagggatcacagagtgatcacacactgtgctgtgctctttggtatatatatgaaaagcatcgctaagagaatgggagaggtggtgagagtttattgctgccttctttctcatggaagcattggacagcagggcagccctagtgaattgttgactgctccataagaatatcttgctcatttaacctcttctgtactaggtcttctgcctggagagtcctgggctacactgcccatccccagtatcccatgtattcatgtcagattcttgcagtctcctgaggatctttcaaggactggaactgcatcttcaccatctttgtgttcccagtgtctgcaacggtgccttattctagaaaagaacatcttaactgggagctgttttgccaggaccatcatcaaaaatgtctgaagatgtttttggttgtcaaaactggggacagggtgctactggcatctggtggataggggccagggatattgcttatcttcctacagtgtacaagacagttccccataacaaaaaattaccccacccaaaatgtcagtagtgccaagatcgagaagcccttctctagattatactttattgtatagaagataatagatcaaccacatcctcaaggctgggaccaatgctttgcattatgatgggtgtcttggtttcttttatttccactcttgattctctaagcatcatattcaagctctgagatgaggtgtatctgactgggtcaggtagccactgagcaaactggaataggcctttctgcagagtttgaacccaagtcaatgttgcctcgactcaagctcagatacctcatctaatcatcagtagccatagtaatagtagcccttagcacagaccactgatatctactgcttagaaggggtttgtgggggtagaaaatgaggttatattaagtttacttgcccaaagtcacacagccagtatgttttggagccagattcaaacccaggttgtctgaaggctccaaaagtcatcatttatcactgtatattttcttcttagctttcttgcatttcctttaatgttcccatctctccctagtgaaactgatttccctcaccaggaggttctctaggaattttggtccagggcttagattcttaaataagagcagggacatcaccatgtttgttatacgctgtcatttcacctcctctgttctgaatcagaatgaggccagcactctgggttctaagttatcgttttttttttttttttccattctatatactccctaagaatcttttttatgcttaaggtacaagtttaaatatggaaaaaaaaatctagattgaaatgaaaagccagacatttcctagttatatcactaattaactgtgttactagtgataagctgcttataaatctttcatcattaagataagattaccttctagatcttaacatttatgatcacagggataagttttttgttttgttttgtttgagacagagtctcactctaccacccaggctggagtgcagtgtcacaatctcagctcacttcaacctctgcctcctgggtttgagcgattctcatgcctcagcctcccaggtagctgggattataggtatgcaccaccacacctggctaattttgtattttttagtagagacacggttttgccatgctggccaggctggtctcgaattcctcctgcatcacctcccaaagtgctgggattacaggtgtgagtcacagtgtccagccaggatagttcctttttattgtaacatatccattttttcttcatttatacctccagtatccaacaagttaggatgcaggaattaagaaagaatcgtcctaaagtaggaaaggcaagatttgatgaagttggtagaaatcaagaagcacagttttgtaagctttgcttgggtgtggattgggaagctatttcttatttctccaagagtgtttagcttctcagacaatttctgcctcagtttccccatattttaatggggggaccaaacacagcatggtcatgcatgacatgtgaccgtaatgaaagtgtgactagcacattggaaacctggtgtggcagaaatcacacttagaatcaggtcaattaggagtcaccttagttttcttattgaaaattatgtgtaatgctgaaaaattaataagagagttccttaaaataacagactgaatttcgaagtttaggtgataattattttccgaagtctgacctgcccaagaccttatataagcacgttatggaaagcaagagtggtatatctttactaataaataagtatttctccaaactttgaaaaacattctgaagcttcaggttaaaaatatgtaaatggaaatgccctccacttgactgtatcacagctgttccctgtccctcatttgctgaaggactgagtacaccccaaactggtcagagcatgatgactttcagtaatgacctaaatgaccttaaaatatcagtaagtgacagagtattcgaagtcacagtctataacattcgcttagaatttccccttaagctgctggctgaagcactaattaagatctgaaatggaaggtaggtgacagatgctttgtgtcctgcagcagaggcacagaatgctgttctttcacttactgtttaataataataataacagccatttaatctgtttgctgatacagtctcctttgctttattatgttgtttattttgtgtgagctttcgatattagttataaaaatgtcactgtgtctgcagctgcatttttcattttagaaactcccagagatctcatcaatttaacctgccttgtacagttcgcaggaaaccactacaggcaaagataggcttaatcaaggttttttcttaataacgaacacaatacacaggaaagcagggcaacgaatgagcctttgattctaggtaaagacttattatgtgaaaatctatatttaaattaggggctttttgctaggattcttaactgcacaagacaaattactgtaggatgtctctaaacagcaagtgtgtcttaggcatttgaaatataatttaatctattaacagtttaccctagattttaagccattcattgttggcgaacacaatctagattctttaaaataaaaatagaaaagcatttgcagtaactggccattattatagctatagaaatcaaaggtatttcttgtataaattttgaattatatattgtttatctctccttaataactttcactatagaaagagctctctttcttgctcaatttacataaaagtatctggaacagttcagtgacaacagtgttggaaattaaggactgacttgagactgaagctccctccataactcccatgcccttctccagtactaagtagtataaaggccaaaagtcagataaacaacataagagaaggtggcagtgctagagatggggatgaggctgtttcatataatggaaggacaccagttgacattttccaaagattttccattataatcttttgcaaaggttctctttcactagttaacaaatataaaagatgccaactcccaccagactccagatgcttgtaatagaattagaaggccctccaacctttctttccaggggtcctgagggggacgtctttgttggcaccccaagcctgagtcactcctagcacctcaggaaagcatgtgttgtgtggcttcaaggataggcatcctaggagattttaccacctatccaggtgccctggctgggtgaaaactgtgcatcttatgcttcctcaatagtgctgtgagaatgctccactgccagtttgaggtatcaggtttgggttttcaggattgcaagactgctgtgctgtgcgtgtactggtgagttggctccctgcctttcccagcacccccatgcctccttcttcacatcccctttcaagtagaatagggaactgataacccaaccaggccccttattcccatcagatagcaagctaatcactgagacaacaagctttgcagtagagaaaagattttattcaccaggcagccaagcaaggagacaggagaatagatctcaaatctgcctcctcaaagatgaggtttaggaatatttatggaataaagaagcagtgtggtctattgtggggggaaaggtgattggaggtgggggaaaggtgattggaggtaagaaaaagggaggtaattggtgatctgcacagacatagtcaaaattcatggctcttcataggatgtatgttcatgaaatggcattgttagcatgatctgagggtggagtttttgtcctctgatgtcaaaagtcaaccaacagacattcatacaggcctagttgatgggttggtggtctcagccagtttgaactgggtaagaactgacctcaagttcctataaaacaatgtaagcaactgttaccatgatgacctatacattagagatgttacctatgaggaagctagtgagagtttagatacttttaggtatataggttttaagatcaactagaagtaagcaactaaaagcaagtgaggcaggttaagtttgtcaggcctaatcaggttagccctcgctttcagagtcatctgcccaagtacagtaaacagatccagctactacttagatactttgagaagtttagggttgggctctttcttcttagctttccccttcatagaggaaagtccacatttacttcacatgctaacttgtttgctgttagtagaaatctgcgggaagtttgccagagaagggtagcctttggggattggccaaccagctagcagggacctctgctgtgagtggcccatgctgtctgggcagctctgttaggtaaaggagaaagccatttggcttgtgtagactgcagctctgcaggaacctctccccaccatctctagccaccacctccagagtacagtaaattgtagacttagatttgctgtttccagcatagatgtcttacactttctagagggttccctctgctcacatagagccgttggttaagtggtggtgctcattttccatgccctgctggctagtccttggacattgtgagcatttttgtctccaatgccactgaattccttaaggccttttgggtgggtgctaaatatttaggcaactcttactaagaaaatagaaaacacttgagttctctgttttgcatgtggctatctttacatcagagccttggaagtggtcaactgtatgtagccaatttcatgaggctgttttaactgggaggacattgtcacctggctgggcttatacagctgagtcaataaggaaaacgcagcttttgttggcttgcttaccttttaaatcagtaagtaatgcacaaaatgggtccctcaccaccactacttcctttaaacctcatccccaactccacatcccatcatcatctctcatctcatctcgcagctttagctgatcccatggtggggaactggggaggcatgaggttgggggtatatgtgtgtatcatatattacttgggagaaaaaaaattgttttaggttttattacaaagcacccaagttaaaagagcagtgttaaaattgtcttatcaaaatatcccgtaccattgcattttcctgtttaaagagactgccataaactctaggggctacccaagtgaggagacgagattatgattaacaatcaaagtgatggggaaagttataaaaataggaaaaaaatatttagatataaagtcactgacctatgaaaccaccttgcaaatggtaggcaaaagaagtagtattactgaaaaagtatgaattgttacctttactctgaaattagtatgtaaaggagcactttgtttactgcactaaatctttgtctccagtttttaaattatgagatttatattgcctaagtatagactgaatacattttaatatttaattgttttttctcaaactatggtttgaaaaacaagataattcttaagctgggtttcattactttgaaaactaacagtgttttctaagagaacacgttactgatttaaaaatgtaaagtaataaaaatagtattcacataaagtttcagtagagttttagcacagaacacaattaaccagggcttaaaaaaaaccatttaattttgaggcaattgtagttatttcttgcagttgcaagaaataacacagagttctagcgttagcatttaccctgttccctcaatggtactatcttgtaaagctatagtacaatatcccaaccagaatattgacattttatagttaagatacaggacagttccattaacacaaagatcctctgttacccctttataactacaacccctcattcccatccctgacccctggcaactcctaatttgttctctgtttctataacttatcacttaaagaatgccacataaatgggatcatataatatgtaacctttgagatttttttttccctcagcataattgcccaagattcatccaagttgttgcacgtatcaagggcttgttcctttttattactgagtagcgttctgtggtatggatagaccacagtttaaacatttgaatgacatctgtgctgtttccaaatttttgcttattataaaaaagcaagcaggacttttaaaaaacacacttatagaaatgcttatggctgtgtcttattacagaatatttataaggagagtaagattaaagagttagagtcacttaggattaaaacaaatgttataaactatgacagtccagctcaaagtagcttgatttcataaatatattctctttatggtatttcataaatgccataaatcaaagtagcttgatttcataaatgtattctcttttgattaaataatcaaacttaagtaaattattggccagtgtccacaatagaatttgtaaatagttacattgtgttcatgtttgcatttctgttctcaacctgaatgactgctcaatatagtacactatattcacttttattaagcactgctctcacatctcattgtgtttgttgaacctggaaatgtgatagcatttgattgtgttgattttttttttttagctgccaagacgaattgttagatgtttttaaaacattatatacccttatgcccttggtgtctctgatgaagcagattcattaaataaacactcacttatgaatagcagagccagcacagtcatagtggatgaagtttataggttattgacggacggtaggaaatcagttgaaagatgcccggaaacatgtggttatgttggtaggaagtagaaaacgcctgcctggagtccttcagatcccacaacgtatgcgtgtgcatcttctcaggctccgtattagccctggtacgcacagagacacacagcgaccagcctattagttgcctggcagatgccgtcagtactggtcattttgtgaatgcttttaatatgattcacagaatgtctgtagtcagtcacgttttagcactgacagtaaaatgtcacctcttcagcagttttcttttaaaaaaggtgtaaagcctcttaaaaatttttgctttaaactcctatcgatcgtttagaaatcttattagcttgctttgggctttcttttagagttggagaaattaaaatttagagaccaggttgggctgagaaaactgcgtggagaaggggaacttgagttgaatcttacttacaccagacagtagggacactaaagaaggcaatactgctggaagataaaagttgacagctttatgaaagaaggaaacaagtgaatgagataattcggctgagagctcccggaaagcaagaattctttttcatctgtgccctcagtccctagttggagtacagcccaaagtaaggttcaataaatatttgtttaatgaataaacaaatggatgaacaaactgaaataagtgttgatatttgttatgaaatatgcctttctcagactgttccacacacctcaccctggctgtgccaagtttctatggctgcacaacaaactactccaacacttagtggcttataacagcagatggaggttcacaggcttccactggacagttctccttgacatctgttctgcagtcagaaggcaactggaactgaggtttccggtggctccgcttgactacagggatgttgggctgtctccttctcagggcctctgctctttgtgtggcttttccagcagagccgctgaacttctaacatagtgtggctcagggcttccaaaaagcacaaagggagaagcttccaggcctcccaaaggctaagacctggaactgtcactgtgttgctccctcttttagttaagcagacaagggggccagaccagattcaaagggagggaaaagaaaccccacctcatgatgaggcaccactgttttcccatcgataactggtatcaacccagcatcctacagctcaattcagttctgacactcaccatcccgacttagtacagaccctacaggttaagggctcagtccccttagactgcccccacttcagatgccagctgaaagtggaatatgcccaagttacccacacttcttcctggctgactacaaatgtgggggttgggagaacccccaggtttggcaattcactagaatgactcacagaactaaggaaagtgctatacttacaattacagtttattataaatgatacaattgaacaaccagctgagaatttatgtagggtgagggccagaagggtcttgagtgcaggaacttctgtccccatgaatgggacatatcactgtcctggtacatcatattttcaccaaccagaaagttcctgaaccccattgttcaagagtgaacaatgcaggcttcattgcacaggcatgattgaggaaataattggccattgatggttaactcaatctccagtccctgtcatttccccagaggtcagggacaaggttgaaagttcctctaattatgtatccatgtggctggcaccttcctggaaactatctaagggcacaccttgagtcaccttgatagcataaagatacagctcaaaggggttcattatgaacaacaaaagatgttcctgtcactcaggaatttcaaatggtttttgaagctctgtgcctcgggaactagggacaaagacaaaatagattttgctgttctatcacagggttgatgacaaagaatgtgtggccatctttaatctgtgacactggtcctctgcagactcaagcaaaatagatgaaattttacaaaggactgttttcctatcatttgcttagaaaattaccctacatgtttatcccactttcccctagagcaggtttctggaaagctaatgctatgtcttacgtatacataaacggatgaatgagacaaagtttgttgcattggtatgtgtgttggggggataggagggtgatgggagagcctcctggaatagtcttagagttggacactgtttccccttgtgactccttttgcagctactgccttgatcccctcttgtgcctgctaggctctgccttggggaaagctcaactcttctgtttccctacacttgaccgactgtctccatcgttgccttgcccatcttgtgttgtgtccacccaaacctgactcagatctactagttttcatctttcgctcacggactattctcttgagccagattcctagtcccctaactcaatcatcttattctggcttctccagtgttctttcaacccaatcttgctaaaaagctattttaatgcccgactgtggatttttggcatcgttatctcagcaggcctagcttggaggttcctctgggatttcctgctggagtcttctttttaggatttcccagtctacttgggatacttaaggaaaattatcaccttgtcttaggaagaatcttattatctcaaatcaaatatttaaaattgcaatgctcccttatctggaattttattttgtaagggacattttctgataagctgccaatgacagcctatgatatgaaattctgtatgtccctttgggttcaacagtaaccttaatgggatagttttgtctccctgtctcacctcaggtaacagaaattgtcaagtgcaaagaaacttttgtatccttcccacatccagagctagcttggagtttgaccttaggcaacaaccaactaactgtgccttgaagataactctctggggagttaattaggatagactgaataattcaaggggcagttttggtgaattaaattgggaaaagattttcgagtgttaaaggttgaagcattcccttcctattatttcagctcttacctctactttctcaatatacattaaagaaaagcaaatctgttcaatagatttgagataatctattaatttagaatgcttactagaagcccaccatggggctaggctccacaaagtttgaattgtggttatactgtcggttgttttttaaaaatgtacagcaaaatcctaggcgatcttcatgaactactccagaggccaccatcctagaaatctaaactcagctctcctttaagattagtcattttcttatccaaacaccacagagctttttacatagctttattacagtgcttcagatattgtcttgtaattatttgtttctcaacctgtcttacctattggacctgattaatttagaggtgggaggctgctggcttcatttccttatccaatcatttaaattaagcatctgacaggtaccaggcactatatttggttctagtgttccaaaggaagtagacaatcctcattttgtatgtattcttcttcttcttcttttttttttttttttaggtggagtctcactctgttgcccaggctggagcgcagtgacatgatctcggctcactgaaacctccacctcctgggttcaggtgattctccttgaactcggcctcccacgtagctgggactacaggcatacgccaccatgcccggctagcttttctatttttagtagagacagggtttcaccatgttggccaggccagtctcaaactcctgacctcaagtgatccacccaccttggcctcccaaagtgctgggattacacacatgagccaccacgcctggccccattttatatacatgctgtatgtttgttgcatgtgtcaatcattttgaagttgcatttccacttcacacactctttttttttaaacggataattaggaaattcagccattttgaagttacttgactctggttatggttgttttctaagctctgttaacacacctggtcaaaagtttggaagtcagacatgttttgtttgtcgtttttttttttttttctctgtcagacatggcctgcaccataagcttctgaaaaactctttgaggccagagacttggcttcattgatcttagtatctttggcaatgttttgttcgtagggaagattcagtaaaaggacatttggcatcagactaaaggaaatgtgttccattagatgtttaaatcacggtggtttattttcaaagccatagttttgtagtgtttctttacaacgtgattgaatttaaatgcactgggatgacttcctccaagaagaaggaaactggggggccgagaagatgtggcaaaagcagaaacatgtccatctctcattgggtagggacatcattcatttatttgttcccgtatcattttgcagattccttttcaacctgtacactggctgtctttctctcatccccaagtttcaagatctctggtggtatttcttttccatatcctttacctaccttgccttgctcctccacattcccaattccttcaatttttttttcctctctaatctgctgttttatggatgtcaagatatactctagttactcagctcttaccttagaattgagacttcagagtttcccactaagttccctttgcgatacacaggaaagggaacattaagaggagcacactgagactttaagcaggaaaatcggtaaacgctgaccatactgaacaattaagtctactattacttactggttttcttcttcagagcataaaccgggcttccctttccccagacttggctactgtcccctggcttgcaataacccctggctcctcaaaactctatgccttatacatatgcctttccaagtactcttgccatttggaggatgggaagatactatgtcagagaatcccaggatctgattggatggatataattgtgactgcctcttcctccactgtcaggtaagtctctgaatgtgcctggctgctctgctttctctgagtgccttctgccatgagccaagcttttctgtcaccataagcaatccactcatctcttcaagcagggacacgcatctacgtgattggtggccagatcaaatttctgccttctagaaggcatctttcatatccagtctttcacccttaccagtaatgttatggtctagacttcattgacatggttcctccatggaagatcataatactgtttcccaacccagacatagcatctttctcaacacagaactctaggcaactgctttcattgattggagttgtcattcaaattcaaaatgaagcctacttggcatccctagcagctagtcttctcttgcctagatcattcctcttcatttatttctagccacttgcctcaaccccctcgagtttaaccattgccagttttgattggaaaacctatttattgaacatctctggtgatttttctgctgtacccagttacctctgaatgtgttgcccatctctggaagaagaggtattcctatatacacaccccacattcactgagggcttctctgtggttagttcataactctctttcatatgtggtagccaatgctccattaattaggaatgatgttgaccattctttcttctaaagtctgcacatattccttctggagttgtctgtcatgatagtgtcacacttcaacaatgttgaggctcctggtaaattctacagaaacatttccattttcctttgttttatgtacagaaatatagttattaattaggtccttgggcacaaaaatggaggcaggcatgtgccatttaacatgtgtgttagggttctccagagaaacagagctaataggagagagaaagagagatagacagataagaggagacttattatgggaattggctcatgtgatgatgaaagctgagaaactccataatctgcagtctgcaagctggagaaccagaagagctggtggtttaactcagtctgaaggcctgagaaccaggggagttgatggtgtaactaactcccaagaaccaggagctccaatatcccaggggaggaggaggtggatgtccttgctcaagaagagagagagtgaattccccctttccccatctttttgtcatattcaccttttcattgtattcaggcaggccctcaacagattgggtggtgtccgcccacattggtgagggcagatgtacttgactcagtctaccaattcaaatgccagtttcttctgaatacaccctgaaagactcatccagaaataaagttttaatagacatttgggtatcccttaacccagttcaactgacacataaaattaaccatcacaatatgcttcacatatgtttttaaaatagcttaattttttgtctataagtcttgtacatgggtagtggttgagttagtatcttatcccttgagtttgccaaccccttggatagggtcagtgtcttgggttctctgaatggcatttaacacatggtcacaaaaaccttggtctgaagaactttataatgataaagttcaaggtactttggtgtcttgaggaactccctggactgtgaggcagagactcgcttggctctagtcctggtgctggatctaactggctgccattgtggggctcccctaaagataaaggaactcagtttcctcatctgtgaaatgtgaggatggaattcatcaccatgtcccctcccagctctaaacttctctgagtcttgtttttccctgctctgtatcctccactttctggcatgttttttatatttactattataaatgtgtccctattttataagttgttacagcacgagagagaggtaaggaatagttaacaaaattgtattctgagtagcctaatattcttttttttttcctgctaaacttctttttcctcaccttctcctaacatttttgtgggggtgggtggactggtgggtgactgtagtgatattgatattcagagaggagtgaaaaatgcaaaattgcaaggttaacaacagatggttatatggtgccattttaggagtgttattaaaagaacaaatctattttcctgaatagtaggatgtcttaagtgtttaggcttaaatctactgttgaaatagaaaaagaggaggaagaggaggaggagaggaggaggggaaggaggaggagggggaggaaaagtcaaggaaacacttagaacatttttgcatgatctcaattttcttcttgttccaaggtttttaatttggacagtggtatgtgcttcagattgaatgcaaggaaatttgttgcaccatttgcctgacagttatcattttccttgacgaaaagtttttctgaatcttgctttgctggagctacctcttcccttgccctgaataacctcacttgcttaagtcatcgatgcagtggactgacaccacctttctcttaaggaattaccctgttctctgggtaggtctaatttacactcccactatcacccaaagaagagacactctctatattgataactagaaagaaggaactgagactgttgtccaaggacatcttatctttagcatagagcgaatatgtggtttatggtaggtgttcaacaaacttaaaaaaaaaaacttgtattagtctgctctcatgctgctgaataaagacatatcgaagactgggtaatttaaaaggaaagaggtttaatggattcacagttccacatggctggggaggcctcacagtcatgacagaaggcaaaagtcacgtcttatatggcagcaggcaagagagaatgagagccaagtaaaaggagaaaccccttataaaaccgtaagatttcacgagacttactcatttccatgagaacagtattggggaaatcactccccatgactcagttacctcccactgggtccctcccacaagacgtgggaattatgagagctacaattcaagatgagatttgggtagggacacagccaaaccatatcaaaacttaatcaaaaataattgaaatgtcaggaaatagagaaacttattgagcttttttagggaagtggtctttgaacctgttttgctctgcccactggagtatgctgtccatcaaattgttagttcagtgaattatggtacaaacactcagttacattaatatgactattttcttgtatgctaatttgagaacctactccctggagatatgttatcccatgtaatttccaagtgaaatggagagaggatgccttagactgttacttctcatgtttttcattccaatcttcctcagtgcccctctctataatcccaatcctatacatttttaaacaaaggaaagccactcagatcacagtagctcatggacattggtgagaaacgtgaggaaatgtagaggatccccaaattctcacacataaactaaggtgcagccactgggtatcaagcaaggtttcctcactggtttaatgactccagttttccacattgacatttgtgctgggagccttacatatatgattttgtaaaaccctttctgcagcccttcatggtaggtagcagaatatttaaccctattgtaagagacaggagaaaccaaactgctttttctattctcacccgccattctacacagttctccagcagaatcccactggatgtcctatagtttggcccggttctaacactgtctacctggagatagcctcagatctcacaggtaaagggctcagccccacaagactgcccttcacttaaaatgccaatcgcaagtcccagattgtggtctgtacttctgagcaactggccataaattgggggttcccccaggccctttgtcatgtttgattaatttgctagagtggctcacagaactcagggaaatgctttacttgctactgcccatttatcacaaaggattttttaaagatacaagtggacagccagatgaagagatagatgcatagaacatggtttggaagcatcctgagtgcaggagcttctgtccccatggaattggggaacactaccctttgggcacatggatgacatgcatgtgtttttgttcacaaactgagaagctctctgaacccagtccttttgggtttttatggaggcttcatcacataggcacaattgtttaaatcatttacataaatatgattgatcaactcttccctctcagatgttgaaggtgggactgagagtcccagccctctaatcatatggttggttcccctggcaaccaacccccatcctgaggctatccaggagcccccagccacaagtcaccctaatactatacaaaaggacgcttattttggagattccaagggttttaggagttgtgtgccagggatgaagaccaaatatatcttattataaatcacaatatcacacctattataaagcactacatataaagtttacactccaagaataaaagatacaaatatggaatcttcaaatgccaagggcctactggatactgtgaatgacaatataagctacatcacctgttattgaaaaccagaatgcaagtgtaaacttgaccagggaacctgcggagatggagaagtttgacacctctccagcagcatcatagaaatgaacatcatgagcgcattgagggggagggttaatgtcttcatcgttcttcctctggtagaattatatttgcatccttcctggtggaaacttgatacttcactgtagtgcacctgtacctgtttttttttttttttttttttttttactttcttggagggagagttcttctatctcagaagatagaagaaatagctggaaactctatattcctgtgccctagcacaggagaccaggggtctccaactggtctgtggccttttaggaactggaccacacagcaggaggtgagcagtgggcgagtaagcaaagcttcatctgtatttacagtgactccccatcactcatatttccacctgagttctgcgtcctatcagatcagcagcagcattagattctcattggagcacaagccctgttgtgaactgcatatgtgaggaatctaggatgtgtgctccttatgagaatctaatgcctgatgatctgtcactgtctcccatcacccccagatgggactgtctacagatgggactgtctagttgcagaaaaacaagctcagggctaccaccgatttgatactatggtgagtatgtaatgataataaagcgtacaataaatgtaatgtatttgaatcagcccaaagtcacccccaccgacccacccagtccatggaaaaattgtcttccatgaaaccagtccctgctgccaaaaaagttggggactgttgccctagcaggtagagcaagggtatttcacttaggcttgaccaatcgaatgccttcattctggattttggatctgggagaagtcttgcagagacgaagcaacatttgagaagggttttaaggctagtttgagtttagtgtgctggtcctggctgccatgcattgagcagatagttcctgtggtaagacctgctgcccaagccacccttggtttctgcctagttttctaacacttctgtcaattctccattcttgaatagtcttctaatataggccttttctgctttaggtagccagacagaactgttccttgcaaccagtgactgtctaattcagtcacttaatgttttgtagctttgttcagttactgggcacaacccactttctgctcaggcggcttggagacagccatgggccatatgaatcgctattattttaactttcatagtaagaacttgctccatgtgggaaagcataattattttggtttctgagtttaataagcagaaagcaaagaagaaaaaaaatactgtttgcactgagcattaaaatataaggaagtaaagttgtttatagatagagtttcagctaagcaccaaaggtttatttatattttttgccatttatattttctgcctagttctgcctaggaaccagggaaatccatggcaaggagaaaataaagcatcaaagaggatgaaaatgttgaataaagtattagaacccagaacacttaaatctttaacatccatagtaagagtccttcacattactcaggcagactttttttttttccacctcttggtattctgtgcctacacttgcatgtttaaataacgatttaaaaatcacatgagaaatgatcaggctttctttttcccacttgactctcagttatttcaattctttgagacttgttaaagaaaccgtttagtgttgtaaatgccaccaagtctctacctagtagagattagaaatcctctcaccaattccaagttaaaaaggtcctgacatattttgatggaattggcccatgttctcatttaccagtgaccagctcatctccatgctatgatgctccccaggaaatgtgcatggtttttgtagaaggtggcgagaagcttcatgggcaccagcatccacaacccacttcttgaaaaacaaaatcagatttatatttagctgaccacctggcaagatctcctgtaggaagagaaggaactatacccctattactatttcagcttttattcacaaagtctttatatttgaaaaatgctttataatcattttaattagtggtttctcaccaaagccctggatgtggtattattggcaccattttctgagaagaccgtgtgccattgagatggaattgacacaagatgttaatgggttagaagctggtactagaatcagaatgataggccataggactcagcaagccatgctatttactgtcatcttagagggctaggtagggtggagggaaggagttgatgactgattgttataagtgaaaagggcagcagtgacccaaaacaccattgcaaatgttaacagaggcctgttacagagttaaagctgggttttccaaaacaacacatctgagtaaaagcgcccttggtacattagccagtatggagccagcacctgagatcacactgtgtttgcccctttctgcaatggctattggtgctggttgcttgtcttggcctaagagttttcagctgggcttttgagcaagctgcatcttgaatctgaggatgcgggcaagccaggcacagaactgtgagggtccttgcaatgggctgctggtgttcctgtcattcataagcttggacttggtccccactgtgtttgatttgggagaggttctttgaccatacaactcttaccgtgtaaatgtgctacaatccttgtcaagacatagcaaactatatttgaacattgttttaccatttactgttgtgtgcatgtgggccatattttcctagtcagatggtgagttctgtgagggcaaaggctgagtcattctctatttacattttaagtaggcatccagagacttggttatattctgagtctgtattattgatcaaagccctcacctggagtttctggggccattcactgacccagaatctggtgacattgacacagggagggaataacatccagctacagatggttaacacaggtctttagtgccccaatccccattttgctgactcatctatgcctcaagaactccaatcttcatgcagattctgttgcccttgagtactcagttctgtctcttctgcatacctctgtggagccttggatcctgtcagactcttcgtgttgctgaagttctcagtcctctctctcagccgagtgtaatagtgccccagtgggcactgtagggacagaactgagtttcttcttttcttttaggagttgattctctccgggtaatatctggagctctctaaagtttcagagagaaatacgttccttataaaccttgtggttgtcatgctggtgactccttgagcctgtcctgtgctggaccgtgaggaaggacacaaggccatccagactcctggactcacagtgatttcttgtcctccccaaagatgcctttgcctggtgcactctttaatagcccatcacttcttgctggctgtgtccccagctgagttcctccaggatatggcatcaactctgaacacatctctgtatattccctcttaggaccataagattcatgttaaacttagtgccagaaataaccttgggtagccatgttccttatggttccttagattacattcctagattacacattttacattaaaaaaaaaaaaacaaaacccaaagcacctagaaccgtgctggattcttgataaatgcttgtatccattaaatacatattgaagtaacttctactccagtgacccctctcttgaggcttactgtttacctcctcactttggggagctacccagccaggaccttctgagagagaaaagtggtatatttagtagtcaccagatagttactgttaacggtgctgagttcttaaaaaaacctgttaattgtactagcttaagactaaagtatatgttcctctcctcgtagagtgatgatgatggttttataaatactggttggatagcactgtaattaatgggcacaccagcttttattttggtaacaatgtattcttataccacatttaagaggtttctctttcctgtggtcataaagtgattaaaaaaaaaaaagagaggagagagatgacatcctttttaataaggcatcccaagcagtctaagtacctatgaattataaatgaaaacttttcagtgattaaaataaatataccaatgcagtccccttctctgcgtcattgcttcgccaggcctgcatgaaaatcactcagaggaagtcccaaggggccctgagatcatttgcatctgttccatgtgtttctctgatttatatcagagtgcatcaagggcagtggccttccagctggtttgggaagagggattcttttatccagaggaggcatcagctgatggtcagttagggctctggagtgcagctccatgtaaacaactagcctttgtagtaatggccatataatataacctagtccatgttttgttccctcaagaaccaatttacaacatttaatgttcaaggatggttccattcctttctttgtttacacaggtgaggctttatttagtagtgggaagtgaagggcagatggtttaaggggttcttaatgctgcaggagaggcccataaactgaagtatccaagaaaatccattctaaataagaggcaaacagagtctcagatggatataaattagtattattcttaggaatccttccttcccatttctcagacttatagcaaagctcttactgatatcagtggccattgtgcaagtgggtagcagggaaatcaccctcaatgaccaaatggaagtacatgaggaaaaagatggagaatcctggataaagaagacaactggctgggctccatggctcacatctataatcccagcgctttgggaggctgatgcgggtggatcacttgatgttaggtgtttgagaccagcctgaccaacatgacaaaaccccatctctactaaaaataaaatacgtaaattagtcaggcgtggtggtgggcgtctgtaatcccagctgctcgggaggctgatgcaggagaatcgcttgaacccaagaggcagaggttgcagtgagccaagattgcaccactgcactccagcctgggcaacagagtgagactccatctcaaaaaaaaacacaaaaaactgtctttttctagccctatttatttcaccctacactccatttaccttttatttgttgttaattaaataacattaatttttgttgtaggattatacgtaagaaactattggccttttgctgattgtgctggaatttaaaagttgtagggattgtgggccattgttctaaaatggctcattttgccaaacatgattaatggcttttggggtgcagtttatgtcaaggcaaaattagtggacacttcagcaaactggaatgtggttctgagctaaggggatattcacttagccattcctagacctttcttctatcagaacacgtctttaaggttgaatatccaacattttcaaacattttagtcttaaattctacctttagagtattattgatggtctgattagataatgaaataaattttctctcagcaatgtctgtaataaaacataatgcaggaaagatagcatttaataaaatatttgtttaatgttaataatatttattaccatcagattagaatcaagttaacatcaaattagtaagagatatgtcagtcacaggacttgtagggatgcgagaaaaagaccaccagagaaactgaagaaacaactggaatcatctttgaagaatttcaaactcatcattgagacattggcgagactgggaaaattatttctgaatcttgaaagaatgatgccccaagaccagatcatttaaccattatgtgtctggagagccatcatgcttcctggtatatttactgtggaaaaccctgactctcaaaaattaaaggaaaattacaactgtaataaattggcctgaattgcatggattcataagaccactctctttccatttcttcctacttaatgttgttttcacatagtgatcacttagcagagtttgggaataataactggcaaaaaagctaaaattcttagtccctaaaggaaaagtttgcaaacttattatttaatgttttaaaacccctttcccccgatgaatgttaccctgtccctaggagaagcttctctttcatgagttcatagatcaacagtggaaagatgattgtatttttgagccttgaggttcaactttttctcttctaagtcttttattctgcaagagcccttttgaatgatttaaaatggcattctccatttattcgtatttatcgaaaatctatttggagcaaggtattacatttaaagacagagaagaaatggttcatccactcagctaatatttattgtgtgtacactatgtagctacaagctgggaacagagtggagagcaaaagaagacaccattcctgctcttctacagttgagtctggtagaggagacattcatgattcattttttttttttttttgaagcggtataaccacccagtgggttcacattgcctgctgccttcacagagccaatgtatcgagacaggggaattgcagtgaagaaagagtaattcacacagagccagctgtgcaggaatgagagttttattattactgaaatcagtctcctgaagcattcagggatcagagtttttaaagataatttggcaggtaggggctcaggaagcgaggagtgatgattggtcaggttggagatggaatcatagaggggtcgaagtgagtttttcttgctgtctatgttcctgggtggaatggcagaattggttgagccacattactggtctgggtggtgtcagctgatccatggagtgcagagtctgcaaaatatctcaagaactgatgttaggttttacaatagtgatgttatccccaggagcaatttggggaggttcagactcttggagccagaggctgcatgacccctaaactgtaatttctaatcttgtagctaatttgttagtactgcaaaggcagactggtccctaggcaagaagggggtctacgtgggaaagggctgctagcaattttgcttcagagtcaaaccatggacagaattccttcccaaagttagttcagcctacgcccaagaatgaacaaggacagcttaaaggatagaaacaagatggagtaggttaggtctgatttctttcaccatcataatttcctcagttaaaattttgtaaaggtggtttcaatggagcctcactctgttgcccaggttggagcgtactggttccatctcagcttactgcaacctctacctcctgggttcaagcgattcttgtgtctcagcctcccaagtaggtaggattacaggcatctgccaccacactgggctaatttttttgtggatttttagtagagatggggtttcaccatgttggccaggctgatctcaaacttctgacctcaagtgatccacctgccttggcctcccaaaatgctgggattacaggtgtgaaccaccacgcccagccatgaatctttagattactcaagtaaatgtaaaattataagtgtggtaaatgacaggagatgtatagtagaggaatctcatctgtctagggataaagggctcccctgtggaagtgatatttaagggaagattaaaggattaagaacaattaatttgggaagggatggtgtcttagtctgttctctgttacctgagactgagtaatttattttaaaaactcagaaatttattttttacggttccagaggctaagaagtccaaagttaatgggctgtcatttggcaagaaccttcttgctctatcatctcatggtggagggcaggaaagcaagagagcacacatgccacagagagcaacagagggccaaactcacttttataacaagcccagtcttatgatacaaacctactctcacaataatgacatcaatccattcatgagggctctgccctcatgacctaaccacctctaagttctacctctcaacactcttgcattgggggttaagtttccaactcatgaacttcagaggacacattcaaatcatagcattctgcctctggtattcaaaattcacattcttctcacatgtaaaatatatttatttcataccaattgctctaaaaatcttaactcattccaacatcagcttaaaagtccaaagtccatagtctcatctaaatcagatatgtgtgagactcaaggcatgattcaccctgaggcaaattcccctccagctgtgagcctgtgaaattaaacaatttatctatttttgatacaatggtgagacaggcataggatagccattcttattccaaaatggagaaataggcaagaaaaaaagagtaactagtcccaagtgagttcaaaacccaacaggaaaaacaacataaagtcgtaaatctggagaataatctccacacccttaatattgtctcccaaacatgcttttttcattctttacatggccaggctgaaaattttcaaaacttttactttcttcttcccttttagttacaaatttgtctttaaatcatttccttcttattttactgtaagtggctgaaagaagccatgcagcaccttcaactttgctacttaggcatttgctacttagcctagttcatcactcttaagttctgccttccataaagtcctaggacatagacacaattccaccaagtttgtaactgtatcacaaggatggcctttactccagtttccaatacactgttcctcagatccatctgagacttcatcaggatggccattactgtccatgtttctaccaacatactgatcatgacgtcttaagtaacctctaggaaatcccagtttctctgcagttcttttcttcctctgagttctcaccagaatcacccttaatgccccattcatgacaatctatgcttcttaaaatcttgctcctccaaattcttccagcctctacctattactaaattccaaagcttcttccgtgttttcaggtatttgttactgtaataaaccctcttctcgataccaattttttgtcttagtttattttgtgctgtttataacagaataccagagactgggtaatttataaagaaaagaaagccagcgtctggcaagaaccttcttgctgcatgatcctgtggcagaaggcagaagggcaagagaacatgtgcacaagagagaacaaaagagggccgaactcacttttataacaaaccactcttgcaataatgacattaatctattcatgagccctcatgacctaattgcctgttaaaggtcccacttcccaacactgttgcatggggattaggtttccagcacataaactttggagaacacattcaaatcgtagcacatggggtacagaattatattgcagatacagacagcagctcatgccaatgctgtgtggtaagagaaagcacagggctattgaaagaatgaacaagggtaagggcactggcacccagagggcaaggaagagtacaggtgggatgaatccagagtgggaggtggagactaccaccaggctatgcaggaccttataaccactttaaaaatttgagaagtctgggtgcagtggctcatgcctgtaatcccagcactttgggaggccaaggcgggcagatcacgaagtcaggagattgagaccatcctggctaacatggtgaaaccccatctctactaaaaatacaaaaaattagctgggcatggtggcaggcgtctgtagtcccagctattcaggagactaaggcaggagaatggcatgaacctgggaggcagagcttgcagtgagccgagattgcaccactgcactccagcctgggtgacagagcaagactccatctaaaaaaaaaaaaaaaaaaaaaaaaaattgagagataggagggtcacttgaggccaggagttcaagaccagcctgggcaacatagcaagaacccatctctacaaaaaaatagaaaaaaattatttgggtatggtgatgcaaacctgtagtctcagctactcaggaggctgagggtgggaagatcacttgtgtccatgagttcgaggctgcagtaagctggtattgtgccactgcactccagcctgggcaacagagtgagaccctgtcttttaaaaaaatgagggttttattcaaagaacaatggaaaatcattgatgggttttaagcagtaaacatgaagggaacacatttgtggtttgcaaagattgctttagtgcctttggagaggagtggtagtaagatcatccagggtgctattgttcccaggtgaaagatgcaataattcaggtggaccccttaaagaaagagatatggatgagttctagagatgtggaagaggcagaatcaatagaacttggtattgattgaatatggtgtgggggcagggttattagcatggcccctagatttctagcctgctgagtaggatgaatggtcacaccattcactgagatagaaagctgagataaaacaagatttaggaggaaagttgacttttactttggacaggttgaattcaaagtatagtatggtgtcataaagtaagctgttgttacatagcctaaaaatgagtggatttttaaaaggtcaagatgggcagaagtagagcattccagttatctaacattgcatgataaagtcccaacagttatggcttaaaacaacatttactgtgctcattaatctgaattttggcaaggcttggtggatagcttatctccgcaccacttggtgtcagctgggggagcctgaggctggggttggaatcataagacagcttgctcactcaaatgtatggcagttgatgctggctgttggccgaacttgagcaggggttgtggctggagcacctactcgtgtcctttacatgtggctgcttagcttcttcagagcttggtctgctgggtttcaaggtgagtgtcacaagaataaagtgagagccagacagagactatcacctttcatgacctcgcctcagaagtcatctagcatcacttccatggcattctgttcattagacatggcccagccatattcagggtaaggggaattagagttcactcttcaatggggggagtgttgaagaatttgacaacatgttttaaaaccaccacatggcggggcagagaagaaatcagttatcattccagctggaaggaacaggttgaaacgggaaggtagaaattatattcaatagaagtggagtggttgctgttggctggcctggagcatgtatgaagggttatgaacagtgtgaaatataggttaaaggaacgtttgggaccaaattatggtggagcccaaatttcctgaaacccattattttgaatctggaaacaaattgtcagagaggaatacaaatcagatttattaaataaagataaaaagtagaagcaaacagtgactggcatgggataggaataattctacttgctgataaaataattcatgccaattttggggtgtctagtctacagatttggggtcatatatctccaaatttaaattgtagacatattcaaatgtctttagttgggctttgtaccttatgccagtcaaaaacatgagtcaaaaaaatcatgcctgtatggttcccttcggaggtatctctcctttatcctttagcagattaagataagaatcttggtctttttgatcctggctgtggcttcaaatttttcccatcttactattgggctacccaaaaggactgcatcagacaagactggtgagttgaatagtgttcctcccaaattcacgtctacctggaacctcagaatgttactttatatggaaataggaactttgtagatgtaattagttaaggttcttgagatgaaatcatcctggatttagggtgggccctgaatccaattattgttgtcattaagaaattgagaaggcacagagacaaagcaaagaagcccatggggagatgcagaagctgaccttggagttatgcatctagaaccaaggaatgccaggagcaccagaagctggaagaggcaagaaaggattcttccctagagccttcagagggagcgtgaccctgtcaacaccttgattccagacttcgggcctctaaaactcagagagaataaatttctgttttaagccacgtagtttgtggcaacttcttatggcagtcctaggaaattatacacgaagttagagccaggcatgatgtattagtccattctcacactgctataaaaaattacctgagactgggtaatttgtaaagaaaagaggatccccaggctctatggaaagcatgcctggggagacttcaggaaacttacaatcatggcagaaggttaaggggaagcaggcacgtcttacatagcccaagcagaaggaagagaaattgctgcgaggtgctacatacttctaaacaaccagatctcgtaagaactcactcactgccaagagaacagcaagggggaaatccacccctaccacccagtcacctcccaccaggccctcctccacattgatccaatcacctcctaccaggcccctctttcaaccttggggattacaatttgacatgagatttgggtagggacgcaaatccaatccatgtcacgtggaaaatatgggtgttggtttgccagatgccaaacagaaacaacatttgatctgttgataattgtgtatcctctttatcaggtctatcttaaggaaatcagagagtagagcatattttcttcatggaatggtgagacacatattagcctgagacaggagctaaggagagtgagtggtgggctccaccaaagtgccttcatacaactacactggtaggtgatcagaacaaagggacacgtagaacgaagacccgggtgtgtaacccaaatgcctaacaaagtccattcaatgtatgaggtgttgctgctgtgtgctgaaggaggaaacctgggtcttagtctctgttatggtaaatagagaagaaatcaagccttcctacgacaataggggatttttaatgaagtaaaggagacagaagaaatgtcccaaaggagaatgaagtatgtcaaaaacagattgcgcatgtaattactttctcaggccttcctgacattatcagcaggacttgtgttttgatgaaaaaacttaattaaaacttaatttttttaagtggaaaatattcagcatggttacaggaagactgaaatcagggcactgtgtaattttaattgccttcgagagatgcacttcacgtgaagactagcatgggggaaaaaagctagaggcacaaagtctgaggggagtggccacgctgaatctctagctgtgtgcttgggcgccattttccccactcttacagttgacgggatggcatctcaggtttcacgtgtaggggaggagagtgggtctgttctggagtgtgccggtcaggccatacttggcatacacattgtagaaagtgtcttgatttttattctcctaaaaagggtaaaaagagattgaggagattacatatcccatgaggcagcagtttttaaatgccactctctggatcagttctatcagaaccatctggttctgattcatttaatctgttttaggacctgtgcacagtgtttctattttaaaaataaacctgtcctactcattcttggagtcaggtgtgggaactacaggtttttaatggaagaaacatgaacttgaaaatgagtaaatatgggctacgtcctttacttcccaaggagatttgggttgactgcttagtttcctccatcaaatggggataatatgcttatttgatggggttttgtgaaaataaaagataacacaggtaaagtgactgacacatacagttaagtggtctaaaaatgataaaactgtagaagaagagttggatcaggctgcttgctaaattgggaagggataaggtagtgttcttcagatatttcaagggcagctgcatgagagagagagagagagagagagagtgtgtgtgtgtgtgtgtgtgtgtgtgcgcatgcagcctttagaggtcagactcaagtccagcaggtagaagttatagggagataaatttcaacgcaacagaaagtggaactgtctagtgaatggtccagggatgtcatcagtttgctccagagggtagtacgttccaaatcactggagcaattaaagcagctgccatattttgaggatgtacagggctgtggggcagcaattgaatgagaccacttggttcagctctgtaatagggtttctggcttcctgtggggctgtggctgacatacagttgttttgtaaactaacaacacttgaagaaggttttagcagaaaacgtttaccagtaagatatgtcaggtcaagtacactgttttaggtattctttactggggacattcttgtgaccttcatcccaggcctttcagaaaagggatggggcatatttagaagttattaatgactgagaagctcctctggcacttcaggggagggaactagagctataaaatgtcctgtgattgttctaggactttctccttagtttagctaacatctgggtccttgtcacacggctatgaaatattaggcttacagacactttgaagggtgagaaaaatggaatttattgggtaaaaaggaaaaaaagggaaacagggatgctctgcagagccagattcctgctagtgtgcttcctgcctcacagactgaatcccaggtaccacccaggaagaggaggggccaggctcctccccactgcaaatggcatgaacttcccaagacccctcccccagtgtgcaggccacttggaggttctctggtgacccctttatatttggctgtctcattatgaatgggacaggagtgcgaaattatcccacttcaaatgtcacttgctctctgttgggaaaccctatacctcactgaagcccagatgatctccctgaaccagcctttgagggtcctttttggagccctttggaaacctggtattggatgggttgggttacagggctgctcagcctgacagcctcgcattatctggtgaccacagagtttaaagcagaacattgggaagaaggtagactgggccagttgcacaaagcagagtgtgaagagtgatgggagatgaaggctgtttgcctgcttttcactggggaccagatttggatggatgctggtccaatatgagtgacacagttaacttatcagtgagatccctcattcttctcatcagtgagatagctgggtattgggggaacctgcccccagtatttcaatgtaggttctttctattttccataatatcagctggctgagaaataaagagaaagagtacaaagagaggaattttacacctgggccgccgggggtgacatcacatatcggtaggaccttgatgcctgcccaagccttgaaaccagcaagtttttattaaggatttcaaaaggggagggggtgtacgaccagggagtaggtacaaagatcacatgcttcaaagggcaaaaggtagaacaaagatcatatgcttctggggaaacagaacaaagggcaaaaggcagaactcctgataagggtctatgttcagtggtgcacgtattatcttgataaacatcttaaacaacagaaaacagagttcgagagcagagaactggtctgaccaaaaatttaccagggtggagtttcccaatcctagtaagcctgaagttactgcaggagaccagggcgtatctcagtccttatctcaaccgcataggacagacattcccagagcggccgtttatagacctcgccccaggaatgcattcgtttcctagcgtattaatattaatattccttgctaggaaaataatttagtgatatctctcctacttgcacaaccgtttataggctctcggcaagaagaaaaatatgtctctttttgcctgaccccgcaggcagtcagaccttatggttgtcttcccttgttccctaaaagtcgctgttattctgttctttttcaaggtacactgatttcatattgttcaaacacacgttttacaatcaatttgtgcagttaacacaattatcacagtgatcctgaggtgatgtacctcctcagcttatgaagataacggtattaagagattaaagtaaagacaggtatgaattataaaagtattaatttgggaactgatacatgtccatattaaaatgaaatcttcacaatttatgttcctctgctgtggctccagccagtccctctgtttggggggggtccctgacttccaacagctggggaccacttaatcagggtaagggcagtagtttgtgttcacagtttgatctccctgcatggtgctaaccaggctgcatggggatctaatgtctgactttggccacggcatcaggctccagccaactgacgtgaaagcaagtttccaaatcgtctctttctaaatagataaatgatactcagtgttcctttagccttccttattttttgcaaatgcctgtccccagtggttctgttgtttgctctgattgccgttttccccagtaagtgggaaaaccccacatcttttccccatcagtattccctaatgaggcttgttccctcaaggggaccttgatgagttacaacagcatgaccatgttcccaagcagcatgctaagaaaaacaatccccagtgatgccctgcaggcaccatttaggagcgggcggtaatgaatccctgagagaattcagtcctccgtatgaaggtgatccagagtgaagtaaacaatttcaccgttaggtggttcaccctgcatgcctcattgctggctttctggaaagccagtaaataaggcagaaaaaatgtatcattccctccagagtgcagggtcccctgtcacccacacaggactcctgcctgtcactttgagtcacagctgggctttctggaacccggattcttgtctctggttagctcaggtcttgcagccatgccaaatccaaactgtgacattgtctgaacagtagggcatcctgttccctggtttggctgagctctgcggagcagaacagtggccgaggttaacatcagataatttcctccaccattcctgagtaccctgagggcttgttacctggaatcaaagacttgtcagaactcaagatgaccttaaaggccagcttattcaacctcccacccaggatatgacttccagaactaaccacccacaatgcagattagtaatatcatacgtggttactcaatgcaattgtgtcatttcaggagaaatgacctgttaccaaagtgtcatgaaacccacattaatgagctgggctgtagtggaggtttactttgatttctgaccttaattattagtggtttggattctttacgtttatgatggattttctgattaccaattatgattcactgtaagccatttttaaaaatatgacatgaagctctgacccacttttaacaacacagtggcaaatgccaaacaattggcaatttccccttctaatatcagctgtttgaatcatcacatctactgtggtggctggggaccactttatcttcattctctggcttcagtattcttttctggtattgtcattactgacctaggtgcatatctgtactaggctgggacctcagctctatgccagtgagaaaatgaggttcaactgggaaaacggcctggagcagttgctctcaggcttgtctgcagattagaatcacctgtagacttttaaaaaatactgacacttgggttccgctcttggaaattctaatggatctggggtgcagcctgggcatctggaattttacagtctacctgagtaattccaatgagcaggtgggtggccttgcaaaccggggtctgaaggggctggtcagcaaggagtatgggcaaaatagtgctggctggctgggcgcagtggcttacgcctgtgatcccagcatttgggaggctgaggcaggaggatcatgaggtcaagagttcgagaacagcctggccaacatggtgaaaccttgtctctactaaagatacaaaaaattagctgggcgtggtggcacgggcctgtaatcccagctacttgggaagctgaggcaggagaatcacttgaacccaggaggcagaggttgcagtgagccaagatcccacttggctgccactgcactccagcctgggtgacagggtgagactccatctcaaaaaaaaaaaaaaaaaaaaaaaaatagtggtggccaaggggtgtttataaaacagagttgtgatacatgttcatacattcacctttgaggtctgatttggtggtagcaggagtttcaggggaaatgtttactgatcaggttgatgagtgtccagggacaagatgtgtctgctaagagttagattgatggcaaagattgggcagattgatagttctctagcaaataagatgagatctgctatttcagcaggaaacaagtaaggaagttgaacaaaaagctagtggtatgggccatgtccacaagctgtggttaaaggcaaaggctgaagcctgattggcgtgcccacactgggctgggcactgtcagggacagccaggctgactccagagcctgccttctggttggcttctcccggcttaagtctggccctgcaggaaaaccgacaggagttttcatgccaaccaagactgagacaatcagagactggcaggtttggaaccaggaggtctggatggggaggttggctctgaatctgttgtcattatcaggtgagtcattaggaccacctggaaaagtgaagctgttcttcaccttctcttcttgtgaaagtgattcaatctcccaaacccaggttgatcataccctttaggtctaatataggaagtgttgaattaggtgatgtctctaaagaactctctctgggttccttagagaaaaatagcatttgaacattgtgcctcagcaggaaagaagatgcaatttaagtcctgcaccaaggcattcagggctcacctcaaagtggactcctaggaacaagaagcaaatgattccgtggagagggttagatgtctggccaatggaaacggggatgtagttcaggttttctagccccagaagttcagaacctttgggttcctcggtggacatgtctgttactcgcttgaaactagggaaagtctcttgtgtagaaaacctgttgcatgtcccttgactaccagtagcagcagaggtgctatgtgtggctgaagaattttcctcctttttctgagagatgatttcccaggtttccttctccacaattctgtgggcgtgtactgctgtgataagatgtttgttctctggcttataaattacaagatattttcaggaccacttggaagaaattggaacattttcctggaggcagtgggggagctgctggaggttttcggacaggcgggccacatgctgagagaggtattttgggaaaatgcacttggcagtcatgtgtgggtgaggataataatattaatacttaaccactggcttgttgggaagagtaaggggaacaatgtaagtgagtgtaaagatgcaggaccaccattcctttgttcattctttttttttctttttctttttttatactttacattctgggatacatgtgcagaacgtgcaggtttgttacataggtatacatgtgccatggtggtttgctgcacccatcaacctgccatctacattaggtatttctcctaatgctatccctcccttagccccgcactttgtccattcttttagtttctctgagacctggtgccccaaggataccatcttctcctgaccagtgtatcagtttgcgagagttgccataaaaaaatagcacagactgggtggcttcaacaacagaaatatattttctcatagttctgtaggtgggaagcctgagaatgaaaggcatcggtagggctggtccctcctcagggccgcgagggcagggtctattccaggccttcctccttggcttgtagatggtcaccctcttccctgtctcttcatgtcatcatctctctttgtgtccgaatttcttcttctcgtgaggacaccagtcatattggattagggcccaccctaatgactgcattttaacttaattacctctgaaaagatcctgtctccaaagatggtcatatgtgagatactggggttaggacttccacatataattttttgaggggatacaattcagtccataacagccagtctttttgaagactttctcttttgggggctttacacttaggtaattacaggatattttaaggggtatttcaagacccagcaacccccttctccacccaccatctcccccaaattatgttcgtcacctcctggtacctgttatatcatcactagaattgcttggttgaatcaagtaatgtttcaagataatttccgtaaacatgcactctttttatgtaagaggggtaataatagagccagtgaaatactggatgaattcatttaccaaactacgtaaaagtactgatatatgacaactacttagggaacctaagatttgggacatagagcagcctatttagaatatccggtataacattgcagggaatagcaagggctctagagctttccgcctgggttgaaatctcagctccacccttttctttctgtgtggcattcagcaagttacttaacccacctgtgattcttccttcatctgaacaagcagcataacaatagcatttacctcatgattctttagaaggtgaatgagctaatacctaatatagtgcttagagtagtgtcttgtctgtggttggctttcaataaatgttagctgctattgttgttgttaaactatttaacaaactacgaagcacattcctatctgctttcttctttgcccttgtaacagccctgtggagtagaaggagttagttacattttacagatgaagagactgaggctctaagacattatgcgaaccatctcagggcatatggcagtgttattcagaacatctatcggtaaagaacaagaattccaaaaatataggattttccccaggaaggagggccagagtgtgggctactgtgggatggcctccgggcagagtgtgagggtaggcgctccaaagagtaaggcatctggagaagagaaacaatgaaagaggcaaacgctggatgagaaggacctcaaagcagaactttgcctctcggcctctcagtcaattgtgatctgactgacatccagattgtgatcttgttcaggtggctgaactttgaacccttcttggccatttgatgctaaaggcagtctttgaatgtgatgttttcctagatcgtactggtggaatttagttgcctcagatttcccagtcatgtgccagcactgccaagtgatctccatgtgtgggttttatgatgtgtttccagtgctccacatatggcctgtgatttttttttcctatggctcctaatgaaacactcagaacactgcactgaatagaagtttctccctattctccagagtggggatccttattgcatcgtcaagcatggacaccaaaaataaatggggagaaatctctattctcttagtgatgaggcactcttggaggaagatattattaacatgactacgtcttgccaatttgaaactttgcaaatatctgtaaggttgaccagtttttataatttcaagattttaagttcaacttaaggtactttacaaaattatttttatcataataaattacagttctttacacctgtgtcttttaccgattagattgtgagctactttatgggtgagcaccagtatctacttaactttgtactaaatggctcaatattgcctggaaaatagtaggtgcccaataaatagtaaatgttgttcgatcaaatcataaatgtagatataagctaaacctcttccctgggcaactggaaatgcccatgttatgtcttaaaacacattgaattcaggtgggagaataaaaatgattttaacaaatccagtgtgctttttgaaggcagaactacaattacttcttttttccctcataatcaaatcaacctgtgaaattggaagccaataaatatgtaaaaaagtcatcaaatgtcataggagaggactactatttgattcacacgtgatctttgtcgtttaattgcgtgtggcaagaatgaatggaagtgatattaagtggagaaaaactcagtcccattggtgagttatttaccttgaccactgtgatgggctgaattgtgttcccctaaaattcctatgttgaagtcctaacccccagtatctcagaatgtgactgtatttggagatacagtctttcaaaaggtgattaagttaaagtgaaaatgaggcctttgggatgggtcctaatccaatatggttgttgtctttacaagaagaaaacatttggccacatggagagatacaagggatgcacatgcatggaggaaagaacatgtgaagacatttacaagccataaaaagagccctttcagagactaaccgtgctgacaccttgactttgaacttccagccctccaggactgtgagaaaataaatttctgttgcttaagtcacacagtctgtggtattttattatgatagccctaccaaactaatacaaccacctactttttagaatttgtagaatccaagcacttaagattacaaaaatgcatgtttattgtggcactattcacaatagtgaagacttggaaccaatccaaatgcacatcaatgatagactggataaagaaaatgtggcacatatacaccatggaatgctatgcagccataaaagaggatgagttcgtgtcctttgcagagacttggatgaagctggaaaccatcattctcagcaaactaacacgagaacagaaaaccaaacaccgcatgttctcactcataagttgaacaatgagaacacatgagcacaaggaggggaacatcacataccagggcctgttgggggctggggagctacaggagggatagcattagaagaaatacctaatgtagatgacgggttgatgggtgcaccaaaccaccatggcacgtgtatacctatgtaagaaacctgcatgttctgcacatgtatcccagaactttaaagtataataataaaaaaaagcaataaagaggaggtgatggtaataggcacagacttttgcttgcgttgaggaaatattctaagtttcacaatggggtgtggaagaatctgtgcgaatctccttctgacctctcgtggtaccatttcctcattactcagtgatgaccccagagccagtcttggatgaggcggggtggaattttccacacaggtgccatgagctagggggctcaaaacagacactgtggtgaggttattactgaaatattctgtttctatgaagtttctaacgtaattctgggccctctttctacaaccttagcaagttgctgaactacaggagtgcggagtaacaatgcctttcatgtcaattctgtttacagccaggcttgcttgcattaaactggacacatccatcaactagagtgctggataacagatgagaaaaagctaagtttgagttgtcttttatattgtataatggtgcttctattttctttgttttcttcttgttcttaagttctgtgggaaacccacgggaagaggagtctatccagggtatttgacttcaaatcatttcatctcttctgttcttcctctcatctagtcctctgtgttcttgtaatatacgcaagggcaagattaatagtagaacagaattctgctatgaaatttaagtgatgtgaattctttctcaaaattccaagaatgaaaactttgactatgatatagccaataatttgcacttgtttgcatttgacattgctcatttacattaactagcgtaaaatacctaattagtacagcagaaaaaaaaaaactatatgaggaaaaaaagaaatgattgctcttttactcactggagggaaaggttggatttatttcagctctgtgtttagaaaaatacctttgctgggcttcttggagtgtgaaaagagtggaccctgacccacctctattccctgctgggccatctggaaggattttcacaacaaagataaggctaaaccactctgcaaaatgaaaccagaggaatttcatgagttctggggagtagaaagaagtagggtgagctctgacaaggatgatggggttgggcatgtgatgtctggagttggggctaaggaggccagtccaggagatggtccctgaggtaggatgggagtggggccaggcaactgtaagacagcgatgtctcatgttattgagctttgctatttcgtaacctctatctgccacactttctaaaacctttgcataactactgggtatctaccgagaggaaaagaagtcattatacgaaaaagatacttgtatatgcatatttatggcagcacaattcgcaattgcaaaaatatgtaaccagtccaaatgcccatcaatcaatgagtggataaagacactgtgagatacacatatatatatacacacacacacatatatatacatatacatatgtgtgtatatatatatgatggaacaccacacagccataaaaaggaatgaataatggcatttgcagcaacctggatggaactggagaccattattctaagtgaagtaactcaggaatggaaacccaaacatcatatgttctcactcataagtgggagctaagctatgaggatgcaaaggcataagaataatacaatgaacttcggggacttgggagaaagaatgggaggtgggtgaggaataaaagactacaaattgggttcagtgtatactgctcaggtgatggatgcaccacggtctcacaaatcaccactaaaatacttactcatgtaaccaaataccacctgtttcccaaaaaccaatggaaataaaaaattaaaaaataataaaaataaaataaaatctttataagactactgtacctgttagagcctcctttctgggaaattaaaactctaattgtttccacattagcttatgaggtggttggtaaaagagaatgactacaggaaatgaaatgccaatgaggttgataattcagtgggaccaacaagtcacagtcaaccagtgatggagatggtaaacctactaggaatccacagaaattttgaggcaggtaccggactctcaagagtgtgtgagattggtgaggctttggcctgagccattgaaaataaatgcataaatagcaacacttagcagaccggaaaacatgggggaaaacccagacaagagacacttgggatttgtcagtaaaaaatggagttgtgaggctgggtgcagtggctcacgcctgtaatcccagtactttgggaggctgaggtgggcggatcacgaggtcaggcgttcgagaccagcctggccaacgtggtgaaaccccatctccactaaaaatacaaaaattagccaggtgtggtggcactcacctgtaatcgcaactactcaggaggctgaggtaggagaatcacttgaatctgggaggcaatggttgcagtgagccaagattgcaccactgcactccagcctgggcaacagagtgagactccatctcaaaaaaaaaaaaaaaaatgcagttgtggaagctttgaaatccctgctgtgaggttatggaaggagaatgtttctgttcaagtatgaatcttttttgggaggggtggcaagaggaaggtatgcaaagggaatggtgaataaaatgaaaaggttcgactttttggtggttagtcacctaagaaggttttgtgggggaaataatgtgttttagccagcaaggggattgtttaacctgccctctaccagtctgccgtgcctcacccacttgtctacagctgtcctgttagttgtagcattttgttttcttttatgcaaagggattttcttatgacactcaaggagaacccaggagagggaaggcatctctgccttccagggacaaagtttcagaactgtactgctctacagtggtaaaaagacaacaaagtctttgatttgcaggttgcttgtttcacttaccctgtgaagtggagctcagttggaatatttcatctggccactctttagatgttcacggcagccctgcctggccagccatgaggtcgggcggagaaaggaagcaaggatgagtgaggagggagagaaatggccctggagtttgttgttggagatcttctctgtgtcaaacatcttaagggaatcacctcatggaatcttcgccacaacccattgatatggggattattttccattttataatgaggaaatgaaaccttagaataacagcaagaagctcagacaactatgaagtggcagggtgcagttatgtgactcaaaaccagtgttattttcagaagtgggaaatgtcatgactttgccctcccctccccttctctctcttccttcctttttgttggctatcttgagctgaatggtgataacgcttaactagtggaggtacattttgaataaacagcgactgacttaaatttataatcataattttattctagagttttaacaaatggtaaaacatttagagttatttttccgcagacttgacaaaggtgatgcctgactgtgcctgccgtcatttttttctatttataaaatcagggtaaatttgcaaacttctaaagaagcagacatggcttcagcaaccagtcagggtggaggtgagaccaggaaggttggagctcatgaaaggtcctcctcttctgtctaaggggcacttacttcattggtagctcagctgatactttgggaattccaagaaagagccaggaaccctgctaggaatagagaagcaaagaatccagggctctcactttgaattgctcaccacgtctagaacatgagtcaggcacagacacagaaaagtcagcataatgcgtatgtgcagtgattatgagatgcccatgcagcgtctttacaccagccagggatgcaaggaagaatctccggagaacatctacccaacaggtggatttgcttgtggggaacagaatctgtcaaggagaaacaaagcagtgcagtagttgcatcatcatgaggaaggatgatgtgcagagttagtttcctaagtggcatcgcctataatgagcagcgtgttctcctaccaccttagctgcaagcagttatgctgtatagccaacatctttctcctagctcacaattcaaaagcacattgctgggattccttgggggctttgcgtttatttgttgtggtctagtggtttattctggcaaaatacactgcatggatttttacagtttgctttgtgcttggacatctttccacccaagcaaaatgtttacaaatgccagcacgtcgttttctgaaaatattgctgaaaagaacaaatgtgttgtgatgtgccatgtgtttgaagagaccaggcaaccaaacactaagattgcctcttcctgtcagtgtttttgctcggaatcattctttattgtgcctgtttctccagaactctgtaatccaaaatggtcctgttctctgtggacatgtgtttattctgcaagttaaaaccctttcaagcaattcttgctgtgttaaatataacaatgcactgataaaattctgtcatacattctagaaaatacctttgtataaagtactcatattactgaatttaccaaaacagcataggtaacagattctaagatatcttagagttaattgataatatgtatctgaatgttgtaaaatttatctttcctatgcaaatcccttcaaaccatcccttctagtcccatttttgagacacacacacacacacacacacacacacacacacacacacacacagactgactttgttattccttactggtttttactgatggtcatagacgtctttcttctctgctacttccattatcttcctgccttcaaaatctccactttagttgcagttttgttttactatatttcttatttttaaaaatatataggtaaatagaaattgaaaagctcccattttttgttagattcatgaattcctttatgtaattatttttccaaaattaatcctgaatacagactagtaaatttatatgacaaagaaaatttctatgacaaagcaaaattaatgctgaatacagactagaacatttatatgacaaagaaaatagggaactgtgttgtttcacatactcaggagcttctgaattcaggaattttctagatggagaagatctcattatatggtgacaccagctagccaggtgtactactgaggtctgtctgtgttagactttagaaatagaccaaggatggagggaggtttgagaaatctaagtaaggaagcataggagaccttcttgtttgaggtcaaagaataattggaaggagtggttccatctcacaatttgaaaatgttctaaggaacaaaacgtacttttttatagacctattgatctcagaagatataacacagctggtggagggtaatgatcaatcgccagactaccaccattctattttcttctctgtcaaacgtactcactatattgtgagtgttttcactgcctaatttttcatggcaatttttgaggactggtagctgaactaatttaattctcattctctcacttgttcaccaaatcatttcatgtgtgtttttgccaggtattgttttaaatattgggcactattttcggttcagtaattcaacctattttaatcccttactagcccagttgtaaatttcaaataagtcattttttttcataccagttccctgctttcgagtctctgatgaggctacgctcaagtattacccaggattaggtcctatctgaaagctcaactggggaaggatccacatttgagcttgtttatgcagttgttggtagaattcagttcccttaggacggttggactggggggcctcagctcctagctgactgtgggccagagatcacccttggttccttgacagatgggcctgcccattagggcaaattgaagcatctaagtcagtgagggagagactctactggcaagacagaagtcacaattatatataatggaatcactgaagtgacatctcattatctttgtcatattccattggttagaagcaagttacagcacccacccacatacattcaggagggtgtgtattacacaagcacgtaaacaccaagagatgggatctttggagaccatcatagactctttcctccataccatctgaacatttaatattaatgtagtctgtatttctacataacagttctctgaaaggaaactttgctgtgtgccagataatactttttgatcttcttattttacctttccttaccccacccatgattattactatcaaagctttagggcataacatagtgctaaaatagaacacttactccaaaaatttaattaacaagcaacatgaaataaaaggccatttgcatattgtaggcaaataaaaacattatcaccaggagaagtgagtcagaatatatcaaatataatagctaatattaaatagctgggggtgagagttggaataatgagcagcctctgtacagagggcatgtcaatcaattactctggccctattggagcacctgcctagaagtccttgctgtgcctggttaacccatcagttgctgaatagtggggaggtctctggtggggattctgggaagaggggctgagcagtaattgcggagaaccctaggggatcccagcagtcactatttactaagacatttttattacctaatactctatggctaaatagttaaaagaattaaaaattctcaaatgctttcaaggttggagccagttcatggggtcaggagagctatctccaggcctgcattctactccccttctttttccatccctgccccatccctttcaggcagcacctggtgcacactcaggtgacccagcctacatgtcgaggatccacgtaaacacccctcaaacagatggtcccccgcaggcctcggaatgtggcaaggtctaccattaggaatgtaggctcaggaaaggctccttcaggccctgagagtggacgtggaatcctgatggcggggaatcccagggtcctgtgacccagagcatggtctagaactgtgctgggcagcacagcagccgcacattggctccagagcactggtcgagatgttccttaaatgtaaagtacacaaccaatttcgaagacttaatacaaaaaataaagggcgtaagatatctcatcaataatttttatgttgattatgtgctgacacggtagtgttttggatatactattgggttaaataaaatatataattaaattagttctaactgtttttttctaatatagctactaacaagtttaaagttctatgtgtagcttccatttgtggctcccataacatttctgtggaacagcactgctctagaagggagaagtacggctctgctaggacacatctcctgctaccttggaccccttgccctgtgaggaggaggagctagagcagagccctctaaagcgtggagtcccaggcaggagcctttcttgccccagggtggttttgctttaaggtgatatttatagtctatttggtctcactctgtcatggctaaatgactccaaatctctctcctttgcctacttctgggttttgcccaaggcaagaaaatagtcttcctcaccttccacctgcccacccccactgccactgccaccaccaccgcttttgaatcaatataaccaggcacagaaagtaaaattgttctgtattgacatgtatctttcaagaagctgttattctttgggtgaaacagaatctaatcactaagcaatttttctacagagagagggagacttttcactccccttccccttggtttgtagagtacattcatctttgataattgattcttcgggtggagtaatgatgtaggctcaggaatacgttttttgattcaaagggtataaaaagtgctatgtgtgttaggggttaatgtaagctctgtggaattacaatacggatgtcttctaaagaaaattcactaatctaatctctagagaaggaaacttttagagagtcccttatgactcccttaagaaattattgtggatagtatgttgctgtatgatggctttaagaatttatggtgaatgcttcagaccatggctttagtgtttcaacagaaacagtggcttacttagggtggtggtgcatcttgctcttgaataaatctgatctgagcttacaagtaggaaggagtaatgatttagatgtctgaaatctctttagtttattgtttcttttcttatcgtggcagagagtgactgttaaaactttttcctcctgggcacgtagctggcctacatttcccagcatcccttacagatggctgtggccatgtgactgagactggccaatgggatgctagtggaggtgatatattcttgtccaatcatctactctttctccttttcttctgcctatgagatgcagagtataggggcacatgggcaccacctgagaactctttaggaatgcagaatctttaaccttctcctaggtgtagggaatcagaatctgcattttaccaagattcccaggtaatacctatgctcattaacatttgagaaatattgccctttgagatgacagagccagtagatggaaagatcttgggtccctgccttgtggcttagaggagagccacccaggagtgtggcttcttgaagcagcctgtttagattggtacataaacaggaagtccaattttatcatgatgaggtcactgagattttggagttgtttgttatagcagttagtcttccctggataatatactcacaaagtatttaaacaatgccatgtacctacaatgtatccccttcttaccaataaattctgccaaccaaaatgatcatattgtacctacaatgtccaaaatgtttaatacagactgaggtagaccttataaatggtattggtgaagcctagtggacaattttaagaaatcaccaacattacaaaacgttgactggcaaacttgcgttcaccctatatatgctctgtaaatgttcctagctccctcacttttttgtctttttcttcttcaacggcctccttcacttttcagtagcagcaagattaagaggtgaaaactgccattactccagtgaatgggtgaggtcactgatttgcacaattcctatgagagcccaattaaaagaagatacagagataagcatgtacgttttcatctctcttaactccattatcttattgtcatttggctatgatttatttaggtcaacattgatttctgtagcttatttagatagctagaatgataaaaatatctttttgttatcacaaggagtacaattatttacatatttacctattcatccattcattcttagtatacagaacagtccaatcaggaacaatctgtagtacctatgacaggtacagaaaagcccttaaagattagcctctaaggtgttaatgggagagatttactgatttatatttttccctatggatctggagatacagggtattaacaagatggatgagttattgggggtgcatttgtatgtctcagggtgcatgctgtctctgataattgctgtctgtgtttgattgggcagagccagtatcttaaaaccttcactagaatttcctatattgagacatctaaagttaagaaatctaggtaatttttgcttatcggtttaaattgtgcatagaactaaattattaaataaccagcatgtctaagccttacccttttctttaattacacacatatccatgcatgcacacacatacatgcacacacatacatgcacacgtgctgaggaggaaaaaaaagctgaagggattttgtctgtgcatacatgcgtacatatgcacagacacacacaagaggcacatgtacacatgtatggacctgtgcatgaacacacaaatcccatcaacttctttttttcagccagtcattatagagaggaatgacagcttttatttgctgcaaaaattcaagtggaagaacgtcatatacaagaactaccagcctagtggtagagaaaagaggattctttgaagctctttttagtcagtctgtactagcaatagtccagtgtttcccaacttgagggtgccctcaaggcgttgaaaacataaggtaccactgtgatcgaggttttaccaaattttaactttccttcacttctcacctaaaatatcttgagggtgatctgtgctcagatttgttttaagggttggggggagtattcaccttctgaagtaaaagaaggaacaatttgtcctctgtctggcttctatcatgaaacttcataacccaagagcacatcttgacttcagctttgttatttttagtggtagaggagaggaaacagtaatctgcaaagtgtgagttcaattaccctgacctttcatattgaaatctgaattcttaataagtgttttatgtgcattttatcatttaacccttacaacaaccctatgagataggtagtgttattataccactttgctgaggaggcaactgagacacagaaattaagtaacttgcccagcatttcttgggattctaacctaggccatctggctccagaagctgaactcttaaccacactgctctcctgcagggtcgatgagcttgccatgcctcttggtcattccctaaggtgtggcattttgtgattcgggatctggctaactcatttaaatatggaagtttcacaaagattcaggctgctcagggatacaaaatggctcattggcagggtggggcttccaaggaaatcgatttcattcctttcctaatgggctgcgctagtttgcaaaaatcaagaactgtgacgatttaagatgcatctgaactcttttagatttccatagaacctcactcagcagtcctttcgagatgatgtcatagttcttttgtgtaatctagtaatgccttttaggggaggaagccggtgtattttacaaatgttatcttatccttacaacacccttgaagcttagtaagtgatattagttactgtttgggggattacaaaaattaggttgtggtttttaatgtttatttttatagcaatgagaagtggtacacacacacccatacttatatgcatatttgtaaacatgtgttatgtatattattatatacacgtatgcatcctccccccagcattgatgtgtgtaattcaggtggtatttggttgactccctcctaatattttgcaactgccactaattgtgatggttgttgcactttaaaatgttaaacttttagaatatgtgagaagtgagcaatttggcattggatctagcactgtgtcctcaagtccctttcatgtgctcagtggatttttattgagtgccaattgtgtgccaggcagtggcattacaacagtgaccgaaacaaagtcactccacttgaggacctgaatgtctagtcaaggagctagagagaaaacaaatatatcctctgtcaggtgggggtaaagcgcttctgatgacaaataatgttggctgagctatggtgacatttcagcagaggactgcacgagctctcccaggcttttcttgctctaaagcagtagttctgaaccaggggtgagtttgcagtaactggagatatttttctgccctacctggggcagggctgctgccaggatttcccattcagagtgatttgagaggatctcagtccacctgtaaagaggaaaataccctcttagatttgtagggccacagcctcttttgctgtgcctggaacatactggcagacacctttcctgctggggattttgcaaaatctggggacgtttttggtggttatgcttcggggaagggtgctgctagcatctagtgtgtgaggctggaagtgctgctaacatcctgcagtgtacagggcagctgcccacaacagaatgatctggctcagaatgtcagtagtgccaaagtggataaacctctagaaccacactccccaggggttcagtagactttcccgagtgggcatggaaaggtaaactcaactccctttctgcacgacccctttttctggcccatgagagcctatgctgtggccagtcgctgtgacagaatggttttctgcagggcatccatgctcacagcaggatcagatgccatcttcatgctttgacttgccaaggacattcaccaataaaatgcgcgttcagggagacagctgtcatgacacaacacgtttttcccatgacacacatttcttccgtccctctccaataacctcgactcttgaatgggtgagggacatttcctcaagagctgtttatctgggctttggggctgtcttgtgaattctatttaaaaatactcaaagtccctgagatctttggatctaaataacatactggaaccttcccgtcccctcctctccttggggctatggtaccaacagaagatgaaagctttatttcattttcaaaagtattttatatttctttattttgtaccctcttgataattgatcctcagctgccaggatttcccattcagagtgattcgagaggatgcccaggccacctgtaaagaggataatacactcttagatgtgtagggacacagcctcttatgctgtgcctggaacacactggcagacccctttcctgctccgagtatgcggtaagggggcaagaagctgtatggtggcttctccctggagaagcagcttcagccccttgtgctcctgcactcctgtgctttaagggcgagaacacattggattctttttttttgaggtggggtttcactcttgttgcccaggctcaagtgcaaggcacgatctcagctcactgcgacctctgcctcccaggttcaagcaattctcctgcctcagcctcctgagtagctgggattacaggcataggccaccatgcccagctaattttgtagagatggggtttctccatgttggtcaggctggtctcgaactcctgacctcaggtgatctgcccgccttggccacccaaagtgctgggattacagttatgagccactgcgcccggtgaccacatctgatgctgaaccaaaggcagctcttgggaggtggctctgagcctcccagccgcaaggtaggggagctcaaagatgttttaggagtaagcttgacaagagggtatcaggaaaaattgtttttctttgaatctccccggaatatatcatgtaattcacctcttgaggggtcctagaaagaccacttgccatcccaatatctagccagtcctggagtggacccagtcagagtgcatgaactgtgatacaaggcctatgtcttggtttttttcacctcctgcaagctaggagcctcccaactacccacagattggaagggacttggtgcagggatatggcttcgggtgacaacccacctatcagagctattcaaccattgaacagcatggctgtcagtctgaggtcgcagtgatgtcaggaggtggcagttttggcagctgacagccctcacagatgcccttgtgcagaatgaacctatcaagcattttctctactggctatgaaatggaaagtgaggcaagacattcagttgctgcacaggaaggaaagcagtcagggtggttgcctgagcgtccaggtcccagacaggtctgttctccatggaatacattaagggattgatttacctgtcttggagctgcttcacattgcagtagagggactgtgccgagtgtcatgcaatggccagttatcttgcagaacttgtttgtttctgcaattattaaaagttttcctggcagtttttttgttttgaccgagagtctttcctccaaaaatcattctctccatcctctcagaaccctggataattctctcctgtttgtcgtttgcataccatgtacctggaactcttatgttctggttaagtattctagcataagagagaggaagcaaaataagtcagcagaggatactttcagcatactgtgacttttagaatgttcagttagtgatactaacgtttcatagcctgtaccaataatcaacttttctttcccctgaagacaaagtagcatggttgtgacctatctatactgacttgttttcttcatgcatgcattcaacaaatcttaattgagtgcatgttatgttctaggcgtggggctgggctgaccctctgggaaatgacaagatgaaatgagacacattcctcctttcaagaaagtttgtgtggaatgtagaagatcattcattggttgaggagattgtaaactatcctggaacacagtggtttaggatgaaacaaagcagtgcacaaatgaacgctctagtcagtgaggctccattagaggttcctcaagggtggggactgcgttgagtgtcacgagactcctagggtcagcacagtgcccagcggctggtacgtgctttctaagtatcagctgaaatgctacagcagcacggcctagtggggagggagagagaaagggaggaagagaggggaagggattgaggaaactgacctagattatgggcagtgctggtcccccactctcagcccatgtggcttgggagaatgagcctgtctcttgatgctgtgaactatcaccaagagatcccctaccttgctccccaagttcaccaccaggcttctctccatctcagagcttattgaaaggacatggaatcctctggagggagttctccattgaaaacaaagacaataaattccaagtggcaaatctcataggtggccctgagtccctgtgatttttccagtccaccccttagttgaagtaaggcaaaatttgttttggggtttcataacagtgatgtaagtgcattgctttgaagcagtttttgagggagaggggaaaagcctgagttttggagaactacatttgtggaacccaagaaagtgatacatcttccctcctcccacccctcattgggggagatgacatggggcatacttccctatgtgctttagggggtctctacagaaagggggaaatgggattttgctccttgagtttgctgagggtaggacctgcagacttgctgtggtgccttcagagcaagagggaaagaacacagaaatagataccaccaaaagggatgaggatttcagatggcacacagagcctgctgagcgcatagccatgcaccgctgtgctgtgccttttcctctgacatccctttgcccacatataggagacaatccccttacaaagagccaagagcaagcctgaaggcttctgggagtccagtcggcttggaagtgagggaggaagctgggaaagagtgagcttaggtccgtgaacagtgatgagttcatgaaaatatttgaatctacctgaatagaaagattattttaaactagggaaaatttattttaaactggaagaggctgaaaatataaagtccactaatcttgtctgtctccatgagcttttacacatacgcacatgtgcacacacacgctcgcccatgtaatgttcacttaggtcaagatacagaccaacccaccaccccagaaggagctcttgtgcccctttccaatctctccccaagataaccattattctgacttccatcaattaatcaattttgcctattctttaacttaacataaatgaaatgatatgtgtacttttttgtgtctgactttcttctcctcaatataacgtttatgaaatttatccaagattttgcatgtatcatttttttaatgctgtgtataattccacagcatgaataaaccacaatttgtttatccattcacctgttgatggaaatttgagttatttctaatttttgtttttttcaaatgaaactgccgtgaacatcttgtgcatatcttttggtggacataggcacccatgtctctcagatggataagattcgaattataggttccataggccacatataggtaggcctatttgtatctttatatttgatttgttctattcttctgcccatgacaaaggtagtaaacagggtgtctttgagcagggaggctgaaaatgctctcttgtgagcagggtaagtagatggcttgtgctggtgcagaaaggcaggatgctggagaaatcccaggggaagcatggcaccagtccaaccagagactagggaagactcattaagaataactttttactacatgtaggtccagggaaagctgacatgggaataatgattaaaaggaatcaagtaaaggggcagagaggtagatttaagtaatggaaagatttttggtctgctttctagttttgtcctctagcacaatacgaaataattggctgtgggtatattacaggatcccttagatcttattgtctcatttataaaatataaaggctgtacagggtagttcctaaatggcctttgagctttcatcttctcataattgcatcaataatggcttagttgtaaatgaccaattctagtaataggagaaaatcgcatggaaattactgagaaaagcccagtttacttcatgctgttatcttaacatccacaactacatgtcgagagaatacgaaaatgtgttcttaggcttttccttgttcaaccagtctagccatgtgccattggtccttcaagggcagtggctgagcctcttttcttcctcccccactttttgctccctaccagacaaccttctcccataggtgctagtctgtttcctccctgactcgcattcctgcagccaatgcacctgctggtctgctggctgttgtttctcactcactgaaaaccagatctcaggatggacataggttggtggaccattttcttccagtcattcattcattcacttacagattaactccagttacagtcactgtagctagcatcacatacactaagctatctctcatactcttccagacattgcctaaggctgtggccacccagcccctgccctactgggtggagcccacacttgtgatatctcagagtgcttcctccaaccaaagaacccagccttctgcaggagggacacccctttccccctcagacagtcctgattctggcatattaccagaggccagtctttcctgatctcctcctatcctgagacgttctaggcctccttgagttccagttcgctctttcaagagctgcaccaaaacatctttacaacttgtgtttattatttgctgaagtttagctatcttaataaagaattatacttgtgatgaagtcagggccaggtcagtttgtctttctattcttggttcttagcttgttatctggtatatacaaaatgtttcatgaaaattcttcgtattgaagaaagggaagggttttgccaaaagccctactcaaggctgggaggtactgacgcattactgacacctagggataggctacctaaattgcagggtcatggactatgacaaaacagagtgttagtagtgaacatctcaggtaataccacataactttttaaaggggaaaggtcttcctaatttctataaatagttcaaactttcagacttagaatagtcctgcacttgtggcagtgccctcatagatccagaaagaactgatgttatctgatcttggggaaagtccccgccttgggtttgtaaatatccttactgacggtttctagacatttatgcacgacgttttgtcatgtgggatccagcacatatttctgacctggcgaaaactaagaatatctcaatcataaaaataaccagaaaatcataaaacagaaatctggcccaagattttctctggaaaagtaagaagctgctttgaaaggtgaaaatagaccagtgagcccccgcattggaacagattattccaaaaattgtgagcaaaggtctttttctgtattgtgcaagttaatctcctttgcccctttttgtggctgaaatgcatgcctaatctgcatatgagtgcctgccccaggtgggatggggcatgctgggattcctaaaattcagctggcttgcttgaagagggctatcaggctagatttcatgtctcaacaatttctagccggtctccctgagctggcaagcaccgctcagtttataatagtgcctggcacatggtaggtccagtgtttattaaactaacagatattcccaacaggtgtgggcagcagtgctgctaattagcagtaacatagccgcatggcagggacaggaaaggggagccttctgtgtgtccctactatatgcaatgtatgactccaatctcaaaagaagcagagaatactcagccaaatatttgcattgattcctgccaacaccatttttttgtgatttgtatgttcccttccccaccccccaccccctgtactgttaacttcatatttgaagggggttatacttttaggttatttgtgaattgagtcagctcatgtaacagtgattctcaaagtgtggtcccaaaaccagtgggatgggcatcacctgggaacttgttacaaatgcagattattgggtcccaccccagacctactgaatcaaaaatcctggaggtgggtccagcaatcagtgttataatgagcctaccagatgattctaatgcacattgaagtttgaaaaccaccattgtttaaggatcacaacaaatccaacagcactgtcagaagaacaactccttattctaatgggtcaggtgctttctgtgttggctgtcctgcagagcatctctagtgatagttgtattttcaggattagaggtgcaaaactaatgggagtttaagaaggaagtttgagcctttactgctgggagaatcacaagccaagtttatttctcttccattatttgtatggtagctaaaactgccaaggactactgtgatccattgaaacatcagtgtatcacatctcttcttacatctgagctggcattttgggtgtagtgcttcagtaacagttgtattcccaagcaaataaaatcttagccaccagaaatcttgagttggactagacaaaggcacctctccagatagcagctgttgttggaattgaatataagagatgcttaatcaatgtttgtgtaattgaatagaatgggaaatgaatggctcactccaaactttatacaagacagatgaaggcaacttcgatcttaacctttatgatacatagcattttgtactacccttgagaaaatctcagtctcgggttatcatagactcaattggctatcatgggaaattctgtctcagtgatgctccatatctatttaattgaggtttattatcaatttgaaaaatggaaaattcacctcacatattttaaatagccaagatagccagagtgtatgttgtggtttcaatatgtccccaagagttcttgtgttaggagcttggttgcctttgcagtagtgttgagacgtggggcccttgggaggtgattgaatcgatgctgttatcatgggaatgagtttgctatcttgggagtggggtcctgatataaatgatacatttggctgccattttctcttgtttcatgtgcttgcttccaccttcccccttccaccatgggacaatcctctccagatgcctgtgccatgctcttggacttcccagcctccagaactgtgagaaataaatttctttataaattactgagcattctattatagcagcacagactaagacagtgtaagaaagctcttatattataactctctccttctatttgtattcaggttttctcttaattctggaaagtttgggcagcagctgggaatgggaatttattataagacatcccttcagtgtctctacagaattgctttaattaaagtactttgttttatttgtccccatttaattataattcacatcagagaaagctattgttaaaatattttggttagttcagtgtggggaatgggattttccatcccttgaccttcatgactcagtaaggagcagataaaataattttctttgctgggtgattattatgcctcagggacaagtcatatttaagacctgatagtttgattcaagctctcataattgctgtgcagacagtgttcaaagccaaagtcttcctgatcataaggtgctgagaggacattcattttttgccatcattcagagctctgcaagagagcaaattgcttgttacttaaatgtgttacctttgaagaataaaaatctgaattgacactgctgttatttgagccttcaggtgtagggacttggagcacctatgtataccatggaatgtggcttaacaggactaaactgattccttctgcataatgtgctatatactgatttgcactgtatggagtaaaacctcttcaaccatatttgaaagattgatatttactctaaaaagcctataccttgatgatatggtaaaataatcaggttctctataaccttgaatactagtaagctgtttctttgccttcctaataacatgagggtttttagtttttgtttttaaccagcatttgagtacctactatgtgcctaatagagtcagagtgactcacattaaaattaactagagttaccaaaaatttgtccttcttacacaaatatgcaatgacaacagaatgattatcagtaataaatgtatgtgcacttgcagattactaagtgactgatttaccacaaaaaaggaaaggaacattacttagatttgttgctgtccactccttgtttttcattatggttcagtttggattttcaccacaattcagacatgaaaactattctttccataatgaaatcaggtgtgaggttttttttctcattcttttctttagaaaatgtatagcttaggccaggcgcagtggctcacgcctgtaatcccagcactttgggaggccgaggtgggcggatcatgcggtcaagagatcgagactatcctggctaacatggtgaaaccccatctctactaaaaatacaaacacattagccgggcctggtggcacacgcctgtagtcctagctactcagtggtacatgcctgtagtcccagctactcgggaggctgaggcaggagaatcgcttgaacccgggaggcggaggttgctgtgagtcgagatcgtgccaagagagactccatctcaaaaaaaaaaaaaaaaaaagcaagcaagaaagtaagaaagaatagcttatattttctattaactccaaccaagcaaaatttaaaatgctaggttgcactccttgcactccgtagtgcaacccaatagcaccatggctttttaattccctgagagagagatggtggacagggtgttctgggaaactgctgacagtaacatctgtccataccgaaagtcaagtgaaaacttggttcacatgagagcaaatgaaaatatgatgtttttaaagaggctgggaaaaagtcagagaagtgctcccactattttagatgagctcagcagcaagtttctagtaggtaagagggaaaatccattgtggggaaatgtgccaatgactgtttttggttaaaggtttgaatgggcacgatttagcagaactttacaaagctgtgtcttgaagagctttggaaaaacatttagtgttgttgtcgttgatgattttttttcatactctctgttgttcaggttatatgtgactgaaagaaagaatgatgtagtttcagttacttccatgacccaccccgggctagcacctccttcagccacatggtaaggtcccagaaacatttgatagagaccacatgaaagtagatgcttatgcagatgtgacttttgaaatacattcttcctggctttcagatgtgctattaattgcaggtttaaaagcccttttttgtttgatctgataaggtaggcttactttatgtcaccttaaaatgaggttaagccaagaattgcaagatataaagtattcaatgactactctccatttctgctgggaaaaagaccatctgcttaggtaattgcattgtaatactcaaacctggctgaattgcttctgtccctgcaaacgtctcttctgtcttttacattcacagtcatatatctctcctgcatgtagatccaagacccagtgtagccttttgtataatttgtaggattaatagactctgggtctggcctagtacttatattgtaggtctataaattatcataataacataggtataattgcaggtagagttttatatctgggtctgcagtggtttgatcattgactcactgagaacaattattaatcttcaactccaaggtaggacacacagttccaattggtacataaatagtacatacatttacattacagcagggggacattgtctttgaaagaacatgaataatacgttaaacctggaagctgggagggggacatacagtaagtgggaaaagagatattgcagaaagtttaaaaacagagaagaagaaaataaaataaataccaaagcaagcatgctgatatcttaaattaggtgcaaggaattctttttccttctgtgcctcagagctgcctctatgtggccatatgtgccttgagggggaaggagtatagtaagctttgggaatgatgattcttcatcttgcaggatgtagttgctcgtgttggctcaactcagggtaaatattctagatgattgatgtatgaaatcctaatagtatgccatttaggagtttgtttaccatcagtctccacattcagactttttcttgtgggtttgaatgttctgtagtttctgtaatattgaattcaaaggtttgcttttgattggactttcctaattaaaagcaaatttattgtccctacaccttgcctctacttagcccaatctcacacaccctgtgaggctttttcccagatgttatttctccttcttgaagcttcttataggcagaaactggacctcattcatctttttatcttttacagtgctctcgcaaatatttattgaataaataaatgacataatttatacagtctgtgaggcttacaaataccttctttaagctattagtaaaacaaaagtactggcacaaagtgatttcttgttcatataacagaagtattttactttcaaacacacacacacacacacacacacacacacacacacacacacagaaagagggagagaaagagagagaagcccaacccaacaaaccacttaagggaaaccatgaaaatggtatctttgttgagagttaatgagtttatagttaatttatgctttccctggaatacatattatactcattatgtacaagtaaactatgactgtttttacacctatcacagatattccagatcttaaaatgctctgtttgaaataaaaggcagaaggggggacttgggcatattcccttatagttattcttgtgtctcttatggaatagatgcaaaaaagtctaatttgcctttctgtcacttggcaaagtttattatttgcttaagcacaagaagataaatgttttatcctactggcaaaaagtattgtttgcacaaatgtaaaattctgttaaatgtatttatatgtattgtcttagtcagggttctctagagggacaggactaataggatagatagatgtacatatgaaagggagtttattaaggagtattgactcacatcatcacaaggtcaagtcccacagtaggccatctgcaagctgaggagcaaggaagccagtccgagtcccaaaacctcaaaagtagggaagccaacagtgtgcccgaaggcccaagagcccctggcaaaccactggtgtaaatccaagagtccaaaagccgaagaacttggagtctgatgttcaagggcaggaagcatccagcgtgggagaaaaataaagaccagaagactcggcaagtctagtccttccatgttcttctgcttgctttattctggctgtgctggcagttgattagatggtgcccacccagattgagagtgggtctgcctctcccagtccactgactcaaatgttaatctcctttggcaagaacctcacagacacccccagtgacaatactttgcattcttcaatctaatcaaggtgacactcagtattaaccatcacatgtatgtttctatttgagtgtttctgtaaatgacatgctttagtttttgacaagtcaaatcctaccaaaataccctcatagaaaactcttgatgagagtaatggttatatccaagtcctctcaataacaaatttatttcaatcaatatttaatatcacaaaataacagtatgacaaatgaaggatagaatgtggttaactagtgtagagtgtgaattatttggactggattgtgaagtagatgtaactgatactcatggatgaacttgcagtaattatagataataaaaaattaccagccaagtgctgtggctcatgcctgtaatcccaacactttgggaggctgaggtgagcggattactgagcccaggagttccaaaccagcctgggcaacatggggagaccccatctctacaaaaaatgtaaaaagccaggtgtggtagtgtgtacttttatgtaatcccagctactcaggaggctgaaattggaggattgcttgagcttgagtcaaggccgcaatgagctcaggccactgtacttgagcctgggtgacaaagaccctgtctcaaaaaaaattataatgcgtacataattttttcacacatcaaccactttcctaacaagtcattgatcctcaaaataatcctgtgagtattattctcttctatgtaaatggaggaactgagtatctaataggtgattgccacatctaggcagctggcgtggagggtgttgaagatttgagtccggtgcctttgaccccaaagcctatggctggagatgcctgccaaggcaaaactgcccttaccaaagcagattttatcagctgatcccatttctctctcactaaactgagtccatgaatccttctcaatgtagacaaaatctatctgctatcctgacctatgttatttctaagtgtattttgctgggcattaacgcagatggaatacagccgagtttgcgtaagttctgtatagtacaccaccaagcaccttaacaggagcctgcaaattgccgttgagggaggtaacttttagcatctgaggctttgatgtgtttatcttctccaggaattttgttttgcctcctttgggaggggagaggtcttctgctaagcatctacttcctttatttcttactgcacaagaacttcggtctaattggccaactttgagtgtgctgaggtgacctatttctgtctgggataataaaaacattccagatgactgacgccttttactggggacaatttgacctgattctaaccctcctgctctgcctgccaaggaagatgattactacaggccttagtaccgacctctatttacttcatctactttttttttttcattttcttgcaaaaatagcaggcttgtccaagtgcctagctactatggcaataagtgctatttaaacagatgccgatgccgaatacatgtgtcccagcttaaatgagtcagtgggagcagttgtaggatctgattgcataaatgcatgggaataatgtctgtctctggggcaacagaacttcttttgagcccttgagaggaccagttcagttgcagaaaggctgatgtaatgatcacacaccttcaggtgaaagggtcagtttctccctgaatggaaagtgtcaaaaaatggccatttagactttctgctttgtaactagagcaaatgcctcaagaaagagaaaatgaacaggaaagccctcaaaagctttaaagggcttagaaaatgtaaagccattattgttggttattcaaatatccctctgattcaaatagatgcattgattttttaaaaaaatctacagttaacatcaagaaacttgagcctcagtaaatgagcactgccttatagaatattgctgaatatgtcttgaataagttgagaaagcacttggctgtgtataactactcatgtaaaatgctattggcacaaagatgacatttttttcaaagatgcctctatcatgtggctacaagtagattgtgctgattctattcctctacaaagctcagggtcacaggtggtctattagtagttgttggttgttagctctgccataagaagatggcatggttccttaggttagatgcattcagagttggtggtggacttgagtgtctacttatgcgcagagattttcagtcttttatttccatcttgacagtagacagagaagcaggggacaggcttgaaatttcagtcaaatatcaatccagcatgaaggaggacaccctgattttaaacacccactaatatttccttggaaaaaaaaagagcctaacacatctctggctccagctcttctctcctcccctcccttccctcagcccccaattctcttttcttttcctgtcttcagaatatgtgaaatgggggaaatcataaaacagtcaatcttcattattcacagtttccatatttgtgaattcactacttgctaaaatgtcttcgtaacggcaaaatcaatgctcactgtgcttttgtggttatttgcagacatgtgtggaacagtgaaaaactggagttgttccccatgcatgtttctagttgaagttaaaccaggtgacagccctttttgtttcagccctcatactgtaaacaactctcctttttgtggtcagcttagtgccacattttaaaacatttttctgcttttttttttggtgattttactatttgaaatggtccaaggatagtgccagcctactgtccagtgttcctaagtgcaagaaggctgtgatgtgccttgggaagaaatatgagtgttagataagcttcgtccaggcctgagttgtagtgctgttgctgtgagtccaatgttagtgaatcaacaatatatactcaataaacagtctttaagtagaaacacatgttaaacaaagttatgtatttatcagttgatgaaaatgtgaccagaggctcacagacacctagccctgtatctctccccagagcaatgcttcagtatttgctcagaaccaccacaagtaatgagaacaggctaacctaccccttggagttgacgtgaggatctcatgagctaatgcccctaaaatgcatggtgccttacagtgtgccccataggtgctaactatagcagttatcatcatcatcatcatcatcatcatcaatgaaaatacgggagaagaaaaaattaccaataatcccactattgtacctcaacaactctcttcattttgggtattcccttcagtcattgtttcgttgcattcacatctttgtataactgcattaaactgcatacaattttgaatatttctttgctatcattctgtcatgtgcatcaccctgtgttgcgacacagcctccatttctgtggtcttcttgatggaaagcggtaaaaactttgttcctgggctcatgtaagagcagctctcttcaagcatagggatgacttcattgctcacgacaccaatatgccttaaaattctgtgattaattgtaaaaaagaactctctctgaacactacagagaaaactctcacagagcagagaaatttattatgtgatcttcttctctccagaggaaaatggtgtgttttaagtcagaaggtttgggtcattattcagtagaacgaggtgctcgagggattacaaaagaagagtaactctaatctttgtgagagtgatggcctaatacaggtgttagcaaacatttcccgtacaggctcagatagtaaatgtgttagaccttgtgggccatatgatctccattgcagccactcaactctgccattgtagccaaaactatggataatattaatggataatattaaacaattgagtgtggctgtgttcctataaaaccttatttacaaataaggcacaattccaaacaaaatagatctgaacaccaaagtgggcagttcgtttattgctttattcttccacaaaacttctagtatgttaggccttgtcctggttggcagtaacatcagcaagagtagcaaaacatttttctatgcctcatgaagtttatagtctgaagggggagagagcgatcttaataaaataattgtataaatgaatatataattgcatgtgttgataaatactgcaaaggaagaaaacagtgggaaataggactgtgtcagatattcaggcacgaagtttagggaaggggctgcactttgaggtggccgccagacactcattgaaataagagggccttgatcattgtgcagtaagtgatttttattaacaagaacttagtcattacatacctagctgtaagtagatgctagctctgaagaatagattttcggtggtcagtttggcattcaaccaggaccaaaagagaatcccctcattcgctgacttggggctggatttatgagtgtcgtcactccctttgtattttctttttttgtcttattggtctttctaggcagaaatgaataccacatggttgagacacgcataagattcaggtccatcaggtcttgagcatctttctggtaacttaaacataagccaggatccacatatctaacggctacatgggatatagggcctcgttcataaaaacgcatacccatacttcttaatatgcccttgcctgttcctctttagttctctcaccccctgcaaatattcttcctttttaaaccctcagtttcttcaccaaactttcccagacaacctatccccaaggactttctttatccctctttgccagccaacctgtgtaccccttttcttctggaggtgcactgaggacttttccctcctgcctgatcatctgggcctctctgggctacccgggccttgcagcttcatggttcctccctgagcctctctccctagggagggaagcacaaggaactcactggagtgggcagttctgttcacaccctggtaaatgaaatcctctgcctcattacactctgcagacaatttcagcatccagtcatgcttatttcttgaaggaaaaggactgtttttccaccatttgggtctatgactccactggggattaaggaaagagacaacattgtggaatgtgtgtgtgtgtgttgttggagacagcttttgcttgggctggtatcatgtctactccaggattttctgaagtgactgtgggacaggaagaggcccattggtggctacttagcaacaccaggcccttcacgggcagtggaaagtcactggggtaatgccccagaccctcaccctcaacaggctacacctggacagagacagggcacccttatggggctttcagggatgagatgtgttcatccacaaataagggagaagcacagagacttctacaagtatgtagaggagaatctaggagatacaatgcaagggctgagaatttgggatatacacttattactgttggtgtggtcctagccttacaacaggttgtgcagcccaccaaagcatggattacagtgttaacatgcagaaattcctgattgtacctcttttccagctgttcaatcctacatgaggcctttcaaaacccctgtgatttcttacgattagagatgtaggctgtcccatctagtaaatttgtcaaaccactactgggtatcaggtagaaatagagttccctttcatcactagcaatatgtttcttttctcaatggtttgctctcctttgctcattttccatggaaggtcttcattactcctgtattttaaaagctatcttgtcaatattattccaagcgaatttctcagtatattttaaaagggaaaactaataatgtgatcctcttgcttaaaaccctttacagcttcccaagagtgttagaattaatggggctggtactagcatgcaaaatttaagggaatgtcaaaaaagtcagtagtcaagataaataatatttaatgcactattttaaaaatgttcttggcaaactttcgtccacacctgcgtttgtaaatgaggtttcaactcacaccgtgcatgtgacttgagaggccactgcagcacggccaggcctcagtgcactctctggcctcaacgtaactcccttgaccttccatgttgtattagtcctttctcatgctgctaataaagacataccccagattgggtaatttataaaggaaaaaggtttaatggactcacagttccacatggctggggaggcctcacaatcacggcagaagatgaaggaagagcaaagggacatcttacatggcagcaggcatgtgcaggggaactgctctttataaaaccatcagatctcatgatctgtgacttagtcactatcacgagaacagcatgggcaagacccgcctccatgattaaattacttcccactggttgcctcccacagcacatgggaattatgggaactacagttcaaaatgagatttgggtggggacacaagccaaactgtatcatgtaaccaaatatgttaagctccatccatgctgactttggtggtcatgtccatcccgggcctttatatgggttgtcccctttcttcacatctctgctgagctggcccctgctcatccttcagaactcgatcaagtgctccttccctcttgttggccaccctgagccccaaggtgggatcaggctcctctgctaggtgtcctcagggtggtgcgtgggggtcgttagtgtttgtccttagaatacctggcaagcagacatgcacgtgggtcattttgtttattaacaccaaactcctccagttgattataagctccatgagggcaggactgaatttgtcattcttatcgcacagtggcttacatgtcagtcatcactgaacagttaatggtcatttgatctgatatgcttctggtataatttcatgatatcagatctggagacatgaagtcattgttttcctggtggggagtgtgacaccaccatcttgttcaccatttgcagagttctttcctgtcttcgggcaagtagattaggttatatcgttatctctgtttatagctgtctcaaataaatcctttagaagagggagaaagatggtacaaagaaaaaagaagccaaggaggaaagtgactctcagagatgctaatgactttcccaggaaggctgtcacacagcaagaactcagatatgggttttacaactcagaaactcatcctgttctaggccccaacctcactctctcaggagaaggtcctggaggagattcccctctcactttccagaaaaaggacaaagggaattaggaatcttttcttaacattaacgccttgccaatttctagacctcccctcctgctcctcccttaagacatcctatttgcacgtctctgctcttagaggctattgggtttaagcgccacaataaataaaaggcaataaaataaataaaggcaataaaagatatctcctggtaggatataattttctttctttcgttcactgtctcagagttattttatccttttcaccacgagggactcaattggaactggctctcttattagccttcaggttcaactggcttccatggaggcattgtctcctcatagacctgttcacttgacagaccttcacagaagtttcatcagtataaggacccaaaacaccatctaaatggcttcatccagccatggcagatgccctttgctgctgggttgggtttttttttttttttctttcttttttttttgagatggagtctcactctgtcactcaggctggagtgcagtggcacaatctcagctcactgcaacctccgcctcctgagtttcaagtgattctcctgcctcagcctcccaagtagctgggactacagacatgcaccaccacacctggctaatttttgtgtttttagtagaggtggggtttcgccatgttggccaggctggtctcgaactcctgacctcaggtgatccacctgccttggcctcccaaagttctgggatttcaggcatgagccactgtgcctggccctgctggttttacttctgcctgaaacccactggggtgaaaggacaggccttggaaatgttgcattagtagcaactgctccctctaatgggaggacacatcccttccccatagtcagtgcaggagtcacagaagcttgagcacgacctcaggaatcggcttccattcattcattcaacccatatttactgagccccagtgtgtgccgggtacttctggacccttgggatatgaggtgaacagctcacagatccctgccctcctggagtttacattcttatgagagaaacggtcaatgaatgagtagtcaaataagttttacttccagtaatatgtggtatggagaaaaagaaatgaaggagaacagagataaagtttggtgatggtggaaggtggcagacagggtagccaaggaaagccttgcaaacgaggtgacatttgagcagagacatgacatgaagttctgggagaaaagtttatcaggcaaggtatatggctggtagaaaactctgagtccaaggcaaagtgactatccacaatcagccagaggtcaccatggctgggaagcatggcaggaagtgggaccagggatgcatgcaaaggccaaaacaggagggagttcatgctgctcatatctgttctggaaggacactggagaaatgtgtgtgaagaggaacatgaactgacttatgctttaaagggaccattctgaccgtcatgtgcaatgaatggagttgaggggctagtcaggagtagggcagagagatcaggtgagaggctcctagaataatccaagtaaaagatggaggtgactggattggggtgttggcagtggaggtggtgaggaacggtcggtcagatcgtcatgtattttgaaggcggagttcattcaccattgttgctgtaccagttgtgggctaggaaagaaagcagtgtgggtcaagcatcactcattcattcattgacacatacttgttgaatacctatcatgaacctgcccttgttctgggtgatggctataccggtaaacagaatagtcaaagcttcctgcccttgtggaacttacactttattattttatttttatttattttgttgaaacgaggccttgctctgttgcccaggctggagtgcactaatgcaatcatagctcactgcagtctcaagctccttgggctcaagtgatcctctggccccagcctcccacgtagctggaactacaggtgatgccaccacacctggctagtttttgtagagacagggtctcactatgttgcccaggctgatcttgaactcctggcctcaaatgatcctcccaccttggccttccaaagtgctgggattacaggcgtgagctactgtgcccggcctggtttacattttagaaaaagaaacagaaaataaaggtaaaaaaacaataagtgaattataatacatgttcagaagatatttgttatggtaaaaagaaaaaaatagagcagaagagggaccctggggcaggggagcagctgcaattttaactagggcaaccaaggtgggtgttcttaaaaggtcgccaggttttgggccctaagtagttagatggaagctaatactactatttaatgagaggtctataaagattacacaaataggctgggtgcagtggctcacacctgtcaatcccagagctttgggaggccgaggcaggcggatcgcttgaggtcaggagttcaagaccagcctggccaacatagcgaaaccccgtgtctgctaaaaatacaaaaattagctaggtgtggtgacacacacctgtaatcacagttactcaggaggctaaggcaggaaaatcgcttgagcccagaagtcagaggttgcagtgagccgagatcgcaccactgcactccggcctgggcgacagagtgaaactccatctcaaaaaaaaaaaagaataaagaaataaaagtgggaagaggagcaggctggaggttagggtggggtaaacaagctgttgtcatacttgagtccttgagtattgaatttgagctgtctcttagtgacaataccaagtagatagttggatattcaaatctggggcttaggcagaggccagggctatgtatatacatttcaaagtatcagagtctagaaggtctttaaagccataagaccagatgaggtctacaaggatgagagtggagagagaaaaaagagggcccagggccaggggctactgagtcctcagagtagagagaagaaaagaggaattagcaaaggagatgcagaaggaatagccaggaaagtgggagaaaaatgaggcgcttgaacgaagagctgaagaggtagaaagcaagtcacagcgctcaaagcagcaggtgagatggtgagtgggttgggaaagtgactaggagaactttttataagcgacttcctgagcagcaagtgatcaagttaccctgttgttagctatttgacggtggtgtgtagagtcacagaaaggtggcctctccctgtgtgcccacggaaacaccagggctgagccctttgcgtttgccagtgttcatgtgttcacttaagaattaatattattctccaaggcaaggcagtgggtacagatcgcagaagagtcaataccacacacaagattttgaacttaaatttataggcaatggggatttagataaagtttttcagcaggagagtgacatatgtaacctgttccatgtaaatagtttggggagcagaagggaggatgagttggaggaaggagaggtgatagggaggccattttagtagtggagccatgaaatgggggagggggagactgaaccaaaggagatgcagcgagaattcgaaagcagagatgcgagagacacggagaaggtggacatacagcctctggtacgtgattgtgggagggtacaatgagaggaacattgaagaccactcttggggttctatcttgtgtgactgggggatggagcccactgtgggtttttgctgggagatggagaggagaggctgtcagattaaccagtttatggattaattattaagaaacagcagggacctgggatttcccctcctcactgattagttagctggtaattaggcagtggctgagaatgctactgtctgtcccccatcgggtgggaggagcagagctgagcctccccacagttgctgtggtgcatggagtggggacctagaatcactgctatcacgtgacatgccccctgttcctcctgggaacccaactctgaaggggtcttcttgacatccgattttctccttccagagctcttctgaagttcttgcctaatgaagaaaaagcaagaaaagggaaaatatgtgtaccacagaattttccttctctctggtggtgttttgcaaaaatgccatggcaactttcctcttcaaatacttgggatttgtttctcttgcatctgtcaagtgcacatcaaagttgaattttccactttggaattatgatttgtattctgcttctcccatctgggcttctgttctcctgaaaactgcctattctactgtgaaatgagcattccccaaggctgatgtagccgcttcatgctaagtgttgatgggaaacctgaagctgagttgggcaaatgtttttgagatctgtaaattccccagagacttaaattgcttgaattattgagggacattttgacctcttgttggaccaatgagaatgaaagaaaagattggttaaatagaagaaatgttcagaatccccctcagccctccaaattccaaatattttcttttttctttctttttgtttcttttgagacggagtcttgctctgttgcccaggctggagtgcagtggcacaatcttggctcacttctacctctgtctcctgggttcaagccattctcctgcctcagtctcctgagtagctgggattacaggtgcacgccaccatgcctggctgatttttgtatttttaatagagatggggttttactgtgttagccaggctagtctcaaactcctgacataaagtgatctgcctgccttggcctcccaaagtgctgggattacaggcatgagccactgcacccggccaaatgttttctagttaagttcatatacccatgccagagtgcctagctcacacttcattataaatgtctgcctcaaacagaagtcctgggtccatgtttccactgtcctgcgagggatacacaagaacacttggcaaacgaagaagggaaggcctggggctacagtgggtagggagtaccagagacccaggggacaatatatgggttaaatgaggactttatttaatagtatttttaaaaattaaaattgtgacaaaatttaggaatcagtaattatttaaaaatccaaatattctgcttctcttgaaaaatcagaagacatggcatctcggggcccaaatttctatttggcagttttcagctggaggtcagctggtgtccccctaaactcaaggcatgtggtccccagtgggtcacgcccaccagaatcctctgctgtcttgatagctctgaggtccttcagggatcactggggaatgatgttctcctagaagactttctggatcctccaggtccaggttagatgctaaccaatgctcttaaagtagctatagcaacttttattaatatagataatattttatatttttcatattatataatttttgttattatattttaattgcttcctgacttatctcagtcctcttcagtataatttagtctccataagaataagtacttgttgtgtttgttattaatctccaacatcttggctgggcgcagcggctcacacctgtaatcccagcattttgagaggctgaggtgggtggatcccttgagctcaggaatttaagaccagcctggtcaacatggcgaaaccccatctctacaaaaaataagctgggtgcgatgctgtgcacgtgtagtcccagctactcaggaggctgaagtgggaggctcacttgagcctcagaagtccaggcttcagtgagccaaaattatgccactgcactccagcctggcgacagagcaaaaccttgtctaaaaataaaaaattaacaaatctccaacatcttgcataaggcccaggccataagcagacattcaaataaattaatttactaaataaggacaatagactaaataatccctggggtccattttagttgtactattctattgctctgatgtttctctttaaagaaacagattcatgggttttctattagagtaagacactgtatttgtctctacacatacctgagtaagaatgctttgggttagatccctcttttttggttcgtaaaactagagaagagaacagatggaaaggaccttgaagttcagcttcctaatttgcaggtggagaaacaggctcagagaagatacgtggacttccttcgagtcatatagttgtaacccaggttaggacatgtgcctccagggcagagtccacctgccttggtctctagtctgaaggaacaaatgaccagtgtggtagataagaacaaagtatattcaaagcctataaaagaaaagagacagagagaggaaagtggtactagctgacaaatgtcaccttagtggcaaaaacagtaaataccgtagaggtttataggacagaaattacttcagaaacgtaacaaggtttaagcaatccagtgtttattagcaatggttctctgactggggtgtccaaatgcattctaaggggactttgagttccctttgaaaacagtgaatgtacaatttcagggattttcatcatttctgtgagggagtatgacactttcctggccattgaaggggagaagggaattgatttgtaaatgatgtgtatacacaaagtgaaggcccagtgatggaatggtgatggtttgcagtagtttggggctgtggcaattagtgacattttgtttttacattataaacagtgatgtaattggagtgaaatgccattatccactgcgtcattttaatgcagtcaattgttactggcttcgtatttagtttttacacttatgttggtgtcagaattatagaagagttgtaagcaaaagcactttgcatctagttgtgttagttttgtgtacattgatgcaacattgcaatgaaagtaatctaaaacaatgccaacagtccaagagattttatctttcttttagaaagagtctatgcattattcaagcttgttgtgaatgctgacttcctatagcacttgcatttaagttatgagaagttattggcatgagagataatttaagtggcatgagctcatctgctgtcactgcatgaattacttgggaggaacttggtgtgggagatgtgatatgctctcccctcagtaggtggctgttcccacaggcaattctagattctaagataattctgactattgttttattgactttagaaccagatcctttgtaagatgttatgatgtacagggtctaagtggtggaaggatgtgtctttcctttaatgtgatataagccagagttcagcaaactatggcccatggaccaaacacagcccacagtctgtttttgttaataaaattgtattggaatttaggcacactcatttatatacagatggtctgtggctgctttcacactataaatccttagtccaatcatttcgatagagatcctatggcttgcagagtccaaagtctttattatctgacagtgccctaggacccagggtctaaatataaccatttctgcactgtgctttcagcttctgtgtattttatttgtttctctaaagtgacctaattaatctgtcctattgggataattagggaattctagatggttgttgctttgtggaagattccgtgatttctctaataagggaatctagtctattctcaacatagattcctactttcttaaaataggatgctagaagctagcaagatgctgtttgattcaggagccccacctgccagagctagcctcaggctgcactgtgaatgagccacttgtgtttccacccgtccgccctgcttttcggaacccgcttccttcatcatgtctttgcgtcactgccttttcactccatcctgcctctcagtaacatcagtgaaggctctgatatctcacttttaccaccatttaagttcacttcatttgtccacttcttgcttcttccaagggtgtttgcacttgaagctttttgtccccactgtgtataggaagctttgccttccctgaaaggtttgaccaactcagaggagtggagggagaagggatgagggggcagcacaggacggggagtggtagggacagggctgtccctggaaacacacagtcctcctcagtgactgcacggctcattgcacctcattcctgggttgctgtacagatcagagtctacctcacctcaaaagccccacagtatttgttaaatgtctgggggattccagatacttaacaaataatctttcaatgtggtcgacttatttagggaacaaacacaaaaagactcacacaaaaggcatgggagtcaaatgctctttgggatacttgactggagagggctttctacttacacgtgcctagggaaatagtcaaaggatgaggggggttggtatgatttagggacagttcctagaaggagatacttactcctgaatgtgctctgcttaaaaaaaaaaaaaaaaaaaaaaaaaagaagaagaaaagaaaagaaattgtgttgggcgtaaccacagccttcttagccagcctgagttggcattgctcaccctctgaggattaggtcagccacagtgagctttctcaaggaagtggtgccttggggagcccgcgttggaaagcaatagcagatggctgccgtgggatgtatatggtcctgcttttttaatatgtggagaaaagagacctgcgctctctgtatgttcacatatatcaggatcattatatgttaattgcttattatggcaactgatgatttgcctcctgtttcttatgtgttctgtcagttaacatttattgggcacctactatatgtcgatagaatctgcacagtggcaggtaaagttttccctgtctttaaagagctcaagtctgataagaatgacaactcatgaataattgcaatctaggatggagaaacgggggaattctcccttagaattatatccccctcattgacttcacactaaattcgactttttaaattcagcagtgattatctaaagcctgagctgttcagattgttaaataacagtactctaagttaatctacaagaatcttaattaaagaagtgaatttgggtatgttcaaattataactcagctgaaaaacagtttctctactatgcattcccctcaccaatcccacttcccaaataaactgactgaggtgggataaaagggtccagactagaggatggcaaactccagccccaaggtcaagttacacctgccacctgtttctataaatagttctcctggaacacagaaatgcccactcatttacataatgtctatcatctgtggctgctttcaagctacaaggcagaggtgagcagctgggacagaggttgtgtgtggccagcaaagcctaaaatatttactttttgtatcacaggaaaaaaaaattgccaacccttggtctagagtaaactgaacacccataaaaagtaaaaacaacattattcaccacctctgactggcaaaatgacttaagaaccagcacactggtacattttaatagcagttaaatctagacacatttggatttaaattgaaatccaatatcctcctcttcatgatgaagtattaacatggttagctagctaagaaatatttgaccctcacgtacttaaaatatctcttgttttggtgtttgtgtacacaaattagggaatacaaattatgttcatgaagtaagtcatcttcaccaacggaaagaaatattctccaaatcgctgagaccatgcatcaaccctactgcacagttagaagaagggccacattaattacccgaggatacagaatctcttaggaagaggagtggccacagagaacaagagcatatatagtgcatttcagagaagtttctcctgccctccagattcccctgtggacctactctgagtccattctgcaagggggcatttctgcatttgagcagctcccgttcttacccattacacatccctgtgtatagggggcttcaggaagaacttacacaaccaatcgatggcctcagtttaatataacatttaaaaatatctcgctctcctgattctgtagccaaactcagaatcatcaaggccacttcctctcccaggagagtaagcaaacttactgcccagatgtcccccaaagtgtctttgccttcaactttgctgcaggctggaaaggctgtttctctacaaggactggagatgcaaacccttggaggggagggtcctggggagggcaggcacgtgttaaaaagggcagtagatgaaagcaaatgtggctgcaattgtccgcttctgcttgaacagcaagtctgtcccatgctataacagggattctgtaggatggatcctgttttttgttttgttttgttttgttttttgaggcggagtctcgctctgtcgcccaggctggagtgcagtggcgccatctctgctcactgcaagctccgcaggagaatggttcacgccattctcctgcctcagcctcctgaatagctgagactacaggcgcccgccaccacacccggctaattttttgtattttttagtggagacagggtttcaccgtgttagccaggatggtctcgatctcctgacctcatgatctgcccgcctcggcctcccaaagtgctgggattataggcgtgagccactgcaccctgccctgatcctgttttttagagaaagtagattgttaatccgtcactttatgtattgtctctaagatagcatctatcatgtatataggcacaaatgcatactggagtgaattcataaattaatagatgaattaagacctcagactctggagacaagcaaaattgagtttaaatcccatctttgccagttaatagctgttagttatctatcgctgtataacaaattgtcccaaatttagtggcttaagttattatctcacagcactgtgggtaaaggatctgggtttggctttgctgggtaccaaggctgcagtcatctcaaagcttggccaggtggggaaggacctgctttcaagctcacacatgtggttgttggctggcctcaaatccgtcatggctgttggctgacctcaaatccatcatggctgttggctagagacatcagttccttgccacctgggcctctccaaagggctgctcacaacatggtggctggcttcccccagagaggggaatctgagagaaagatccaagatggaagctacagtgtttttgttttcactgggaatgtgggcaaggcattgaaaaagatttttgtgtgagtgataaaatatacacaacattatttgctattgtaacctttctttctttctttttttttttttttttttttgagacagagtcatgctgtgtcacccaggctggagtgcagtgatacttccttggctcactgcaacctccacctctcgagttcaagagattcttctgcctcagcctcccaagtagctgggactataagtgtgcaccaccacacctggctaattttttgtatttttagtagacggggttttgccatgttggccaggctggtctcaaactcctgacctccagtgatctgcccacctcggcctcccaaagtgctggggttacaggcatgagccaccacacctggcctattgtaaccacttttaggtgtgcaattaggtggcattaagtatattcactgtgttttacaaccatcaccactatttatttctaaaacttttcatcaccccaaacagaaacttgaagctacagtgtttttgcaacctaatctcagaagcaacataccaccattctgttatattctgtttcttggaagcaagtcaccaaacatagcccacaattccagggggagggtatcttgaaggacaagaagaccaggaggaagacatcctagaaggcagtcccagaagctgcctgccatacaggctatgtgaccttaggcaggtagtaacctgcctcagtttcaacctttgtaaaacaaggatgatatcttagtctgttcaggctgctataacaaaataccataaactgggtggcttatggacaacaggattttatgtctcacagttctagaggctggaaagtccaaaggcaaggcagagtctgtctggtgagggcctgcatcctcacaggtggcaccttcttgctgtgtcttcacatgatgaaaggggcaaggggtctctctcaggcttctttttaagggcacttatttcattcatgagggctctgttcccatgagctaatcacctcccaaaagccctacctcctaatgccatggcctaggggttaggatttcaacatatgaatttcggagggacagaaacattcagacctagcagatgattttgcctgcctcatagtgctgtacttatatccagggggagcacccccaagtttctactctttaatataagattaaatagatggccccaagccatgatgtttggccaccatggactccaggcagggttttcctgcacggcttctcagatcttcatggtgcttcagcagagatcacatctttagatctctgacagcatgagcagatagagggcagagcagaggcagaactgtggcaatacaaaatatgattcctacatcttcttcccagtacaatctttatggggagcagagcttcctgtaaggaaggagaagcctcccctggacagtgttgagctcccatgtcctcatcatatctcctctgggagtggatccacccctccctcagttgctcacattcaccaccaagatactatccttgtacccattatggtttattctctttcttccatgcacattcccagtatcactttaatgtgtccgccctctttcctggtgagctgtcctgtgcagtgaataagaaacagttacttcccctggagggcttgcatatgactatgcaacgtgcaagcaggctgcttttaaaactattatttaaaatttttcaaaatggtagtatctctttccatccttgtcccctctcacaggtcaaacctaaacaattcagggtctcattccaaacaccagctcatggatgtgttctgagccatcatatattccagccatatctttatacttctgtggtcctgtggaatagtaccaatccagatccttaattagctgaaaattaattcagatgattgcatatttaagccaaagaaataaattaatattgtgtgcaaaggtttctggtgatgagtattttggaaggactgttaaacacatttgaaataaaaatagtttactggctaaggctcagaaaaaaacaaaaattattactgatcagtgttttctaaagtgtgttctgcagaccgaaatgctgtttatttgcccactgaccaaaattacattgataatctgtactaatctcatcagggttgatgagaatatggtaaaacagtcatggactgttttctgctgggagtataaattggacatgcctctaggcaagcaattttgtactatttatcagaatttaaaatgtatatgccctttggcccagcaactctacttctagaagttaatcttaaatcattcttgcacatatatacaaggggctttattgcagtactgttcatagtaagaaaacgttggaaacaacttaaatgtatgtctataatagaccaggtaaatcaattataatatgcctctactcttgaatattgtacaacagtcaaaataatgagcaggcttggtacaggggcttatgcctgtaatcccagaacttcgggaggccaagatgggaggatcttttgaggccaggagttcaagaccagcctggtcaacacagtgagacccccatctctaaaaaaataaacagcccacctgtatgtattcacatggaaagatggacatagtattttgttacctggaagaagcaagtcgtagagcaatattttaatataattacttctataggaaaagatatatacatatggtattatatatataatttctgtgtgtatgcacaatattgtgtgtgtgtgtcacacacacacagcatgttttcatgctgctaatacctgagactgggcaatttacaaaagaaagaggtttaattgaacttacagttccacatcgctggggaggcctcacagtcatggcgggaggaaaggaggagcaagtcacttcttacatggatggcagcaggcagaaaaagagagtttgtccagggaaacacccatttttaaaaccattagatctcatgagactcattcgctatcatgagaacaatgcaggaaagacccatcccataattcaatcatctcccactgggttcctcccatgacacttgggaattgtaggagttacaattcaagatgagatttgagtggggacacagccaaaccatgtcatatatgtatatatataaaatacatgtacaaccacatagatttgtttggaaggatacacaccaaactgttaatagtggttattcttcctcttgagaaagaaatagaattttctagagggtaggagggttgcttcctgctttgctgtgtatccttgcatattgtttgaattttttataattagtatacattgcttctgtaatttatgaaacaatttaaacatctcttaaactcatagacataacatatttatttttaagcaaattaagaaaaagaaccatgtaatctctctgcccaaatgtaattactattaatcttccatacctttttctatagatgtattgtttgtttttaaaaaatgtaatttttccatttagaccattttgtaatctgctgcttttatttcacaatatgggataaatgtgattattccctgcatatttatgtgccagtagatattcagttatatttctaatgacttcaatgttatggtttttaggtatatgagattactggaaactaggcatttgaaatgggcaaggtaaattcctagtgcaatatcctgttacctggcttcttgctttcatcttgttcatccgtacatctagattgtccaccctttatgcctaatctctgtcattgtcttgaataaaattttccatggctgcccattgccctcaagataaatttctagtttccttagatagattgcaaggcccctcactttccagttcatgtttcctctggcacatctttggccaacacctttatcttcaactcccatcaacagctcacctcacccaggcttattctcactctgccttccggtttcagctccaatgactccatttctgattcagttacttctctgtttctcagagcatcttccacttcttccatctcttgtttttgccacccaataggcactctcccttttcctgacaaaacagttcattgtgtgtgagagacttcgggcaaggttattaagctgtccacgcttcaggcttatcatgattcatcatctattaataggacaataatagtaccgacctcctgagattgttaattggaggaagtgaatgaatatctctcagtggattagaagtgcctggggcataataagggctctatgtgtttgaggctgcagttgctgtaattggaatcatctctcttttactcagtccacctagtttggttgaagttggttctaccctctgctctaggggttgctaaggtaatcagtaaatctcatccttctagatcctgtgatgggttcagaagagaacacaaaacccgatttgagccagtgagagtcactatgaagactttactttctgaaggagagaaactctctatctctaggcatgtgcataatgcatgctaggcttactgctattggagctgagacattgcagatggaagcccatcagagcatggaaccaacacagagggaaacacagctgagcaaagagagagaagtcctgtcctggtgatactgggatgagcctttcatgaagcgatgcctgaccagctcttcctccaattcctcagtcgtttgagccaaaatacttccttgttgcttaaaccactaagggttaggttttctgtcacttacaacccagagtttcaagagatatataccatgtcttaccaacatcataccttagtataatggtctttctattgatctctctgctgcatgagaccttaaggtctgtgaggacaggcctgggtcctatttccctttgtatctccagcttccaacatagtgcttgactatattagatgcaagtatttgttgaatgaaaaaatgtctcagaggctaccttgactatttcagcataacttgttcaatgctactggtttatccaggtctaaaagtctgctaatcgtatcagcaaggcataataggatgggaaaagaattaatattattgaatgcctgtcagtaactaggtaatgtatatgatactttacatcatgtcttttaatcagaaagcataattgctttctcccttcctgctatcccatgataggtctattactatacttccaagtcagtaaaataagaataatgaaataagaatatcaatgaaataagaatatcaatgaaataagaacaaaagtcagatgtggtggcacacacctgtaatcccagaactttgggaggctaaggcaggtggattgcttgagctcaggagttcaagatcagcctggacaaaggtgaaaacccatttctacaaaaattagctgggtatggtggcacacgactgtggtcccagatacttgggaggctgaggtgggaggattgcttgagcctagaaggttaaggctgcagtgagctatgattgtgccactgcactccagcctaggtgacagagtgagaccctatctcaaaatatataatatatgcgtacgtttagtatctaacaagaaaaatgaaaggcagataaaaagtatacatattctattctttaaaaggcaataatcatttgaatcttttgagttcaaaatgctgtgttttataaatttataaatgtgtctataaatttttctttctatttcttctacttcttcttagcattgaagtgagcaattttattaaaatctgccattttggtagtaaaacatttaaattcaaagtcaccttaagtgagtgatgtgcttgttgccagccacttaattagctgggggatgtgacacagttgtctacatgcaggacaatttcaaggtcactggtggaaaccctctcacctccccatgctgccagcttattgtcccatacatggtaacattcagatttgggactagatggccaggagaaaagcactgagtagcctcactccagaaggattttttgtgcttggctccctgacttctcctttcgttcagggagcatgcagtggtgagaacacctaaatcatgatccttgtcctccatctataactaattcgtattgttttaggttagtttctcagagcataagaatgaagactgtagtatggcccggctctttcttaagaaagcactcttgatgaaacaatctacataagtagactgaccagttaaatatggttattaatcattcagttttatctgcgtaatggtcttatcaaaactaattattgccatattaggtagatatttagagagcacccttttatggaccaaactctttgcagaatacagatactcaggaagaggatctcttgtcttgaaggagctgaaaattgagttgagttatcccagaatcgcttttttcctttagagttggaattttgacagatggagaaaattatctaataaagtgttcaaaaacttggttggcccgtgtgggttgaggattaatccgttagagccacaggcagattgagcacactattcttagctcagaagaagcaagttattcagagaaggatgagagatggcacattccctctagttcctttttgctgctagagaggtgagcttccaggggctcctagttcaggttgcttgtatttttttcacctacatttggtctccacaagccttcctttcatcgtcagatttgtccaaaatttaacacctgtgtgtgtctaatcaaggaaggacatgatatcacattatgagtgtatttaggtgagaagtcattgaggaaaataatgtttgtcatttgaaagaaagaagagtgttttatttttgagtcacttcaggtctttgtcctgaagaacagattcactcttgtttaaactctgtctcagtgagaatgtttgcggggatgggaggtagcacttcccattgcatctaatcatctagaaaacaagagactacaccttaacagtgcaaatccttttggaattgatctacctggtcttctgctttttcctttctccactctgctttgtcctgaattcccagaaatgccatcttaaaactcttctaaaactgctggctactctttcccctgtttttttctaccagtttttttgtttttgtttttgtttttttttaaaccatcatataaagagacagcttccaaatggtactctgtaattgagcaataaacaacaaacttttgtctgtatgtatccatactaccagtcaaaatacttaataacaaaatatcaataaaaaatggccaatgtgacatttttcatcttgtgtcaaaatcagaaccctttgttttaccatttgcttttaaatctggggggtacataaattcctgagaaaatactaagcatatacatcaaagaaattcagacaaatatatgtgaacagagcaggtcactgacactaatcttggccataacctagagttattcagaaaagatgtccagagacaaatcttggaggttttgaagaatcagaaagataagaggaaaatctggatacagaggtatcacagaagccaaggaaagtgttttaaaaaggaagacgaggtcaacagtgtcaggtgcagctaaaatattaagtataaagaggactgaaaaatatgtcttgaatttagagacttgaaggttattagtgaccttaacaagcattgtttttggggagttatgcagctagaagtcaaactggtaggttgaggaaggagtggaagctaaggcagttgagctgtgggtacggacacttccttcagattagctgtaaagacagtagtaatagaacagtggctgtaggaggataggggactgaggactaggaaataatttattttagatgggagatatttgaataggttcaaagcttattggaaggattcagctgaagacagaagtccggtaacaagagagaaaatataatagaatagataatgttaagttcccaagatccacaatgacccccaaacgtaagaatcatcttagaatagacttgggatacgaagttcaactgcaaaataccctatttttagacagcctccgaatttaggaaaccatgtccagcccagaggaaaaaagaagagggctgagttactattttctccatgtttgattctaaggaatgtagcattatttggatattacataaaaccttggaaaataagggaaggggcaggccgtgaagatatgtgcaattaaaattagaaactagacatggccagtaaattgattacaagttaatctagctttgccataacctgagagaggtgatgtagtcaggaagttaggttttatctcaggttggctttctaaatattgaaagctgtcaccaaagaaactagcatagaaccagtacgttacctgggggagagcacctagagccacagatgttggtgtgcctgagaaagtccagaattttaaaaataaaattagaatagctgtgaccggcagtaccctccagactcctcaattgcacacagctccctttgtgtccattttgaggactcagcaccaagacttctaagacatgaagcactgggcaatgctttggggacatgacaatgctaattatgctaaatactcatgatatgttgtctaatattgatattgataacctaagcaaagacttactttagctaagctgaccttgctgaattgcctgtgttagctgccaacaatgtcaacagagaggagagtaatggtcaaactggaggcagatagtgttatgatttatgaggggccatgaaggcagtgtttttgtccatgggagctgtgattagatgctgtgggtagctgaatacagttgagatttttcaaaaattggcaggcatgttactttggaagttctccagtgacacatcagagatttaattattacagttttgtattcttgctttctgtgacatctctcccctttgtgcttaatcaatgtttgtttcccagtatgtgtttgtcactattattaattttggaagatacaaggaaatccccaaatcagtaaatgccctctaggagtgattctctagtcttgtagttggacacaaacccacaacataacctcctttgtaggctcatgcaagaggaaaggaattcagcatagtgatggagtaggcccagttccaaggatgccactgggtatcctgtacatccagagaggaacagggcaacttcctgactcttttacgtcactttctgaaaggaaagggaacgtttcaaagtaggaccatgcacagatacctgaccacctatccctttttaaagtcccacctgtcaagtctctacaccagttgtattgcattacctgggtaaaggagtcaagtgggaaggggtggagggtagtcccaagctaatgagaccagcattcccctgggttattttatagtttatcttattaatcctagaagcttgactatgaggcctgtgttaggaggtttctccttggggaaagataatcttaccaacatctttgggctgttttcctaattcttaacactactcctgtatatttcaaactgggagctatgaaatagacaggtttgcctctcgagactttctatgaaagcttttttgatgttactcctgggagcttctcagtgggccaggaaagaggccccaaagccacactgtatactaggctaagtcaccacatgacgtatgtaagattcacagaggatcctcttgttcacctatgacgaggccagacacaggccctccaaactccctttctctgtctcataaatgattagctgaacgtttacccccctgtgatcaatctggacaaaatacttactaatttgatttgaccgctgtagtgaagcttgtctcctcctccacagcctgtaaactttgactcattcctgaagctaagcaagtgttggaactgggaacaacccctccttaatggcccttcctgagactctccattggctgcaaacaaatctttcttgttcagctgtcacatcatcccacgtgtgcatcccccatgcctagctccttctagccatgtttattcctcttcattaaaagagaagccctttcagcctgaccatctggatgtttatagatcttatggtcagagtcttttccctattgcaaaaatgatcctgtccatttggcgtattctttaaaagtaaagtctgtccttacctaagtctaggtttgtttttatttgacactactctctatattttggtatttaatactgtgtacattgaacacgatcttttcttgatgacctagcttcatctttaagactattatcacattgtgctgaagaggtagttgtcagtgaggccaattctgggtgggatattggctgacctggcactaatgctggagccaacttatttctgggatagagcagctacttttgttttatgcattttgagttacattaaactcatttggatagagtataatggtgacctttcacttggccagaagaaaaaaaactacactgtttattttcttatttttttttttttttttcactggggtctcactctgtcacccaggctggagagcagtgggtgcaacctcggctcactgcagcctctgcttcctgggctcaagcgatcctcccacctcagcctcttgagtagctgggaccaaaggcacgtgccaccatgcccagctgattttttgcatttttgatggagatggagtttcaccatactgacactgttttaaaaataatcctagaattcgtaactttctagcgtgtgtatgtataaattacaatctgttatgtttagaaattaacaagaatcaaataatgaagctaattttccaaaacgtgattgagctacaatgcaggcgtctgaccatcttatttttagcccccaaggcatgcaaatgttagaagaaaaagaatctttaaaattgcaattgatagtaaaattgcttaattatatgtataatatgtggaagaatatgtatatacagccatttatcaaaaaagaggtcaggaaagttgggtgcagtgtcacacacctgtggtcttagctacttgggaggctgaggtaggagaattgcttgagcccaggagtttgagtccagcctgagcaacatagtgagacactgtctcttaaaaaaacatggggagtagggtaaggaaagaaccaggtaaggatggaagaaaaccatccagccatgaggacttacagagcaatatgatagagaaattattctcatttcttaatataaataagaaaaatgagatttgaagatttgcaatttgcataaatttacctgacttgtaagtgccagaaccagagttagaactctgttattctattttctggtctatgactgtcatcaggacactgtgaagcctttcctttagtgagttccaggtaacacagaccagaaaacagtcctaattgtattcgttgttgttcatgtcactgtcagactctacaacttgttgcttccattactgatttcaataccaggggctgctatccactcttctcttcctccttttctaggaagccttactgttcaaatgtgtaaaaactcattcttgacttccagccaatcagccagagacatgaccttcatgcagaccatcatctctttgaggctgtgtctatttctgagtgcttggaggctgctgctttgctgacggggtagagatagaaagaaagggactgtttctctgtttctccctgttagaaatgcttgttgcccagtgccataaagaaatagcacttgaacataaatttaatttcctcagcaaggccattttttttactttctgcagaaagggtacactcaccagcagttttgccatgaaagtacaccaaacaaaagaggcagggtcatttataacctgatgcgtccaccctactgctgtgtcccgtttccattggctggaacgggacctcacattctgtatttgtcctgattggctagcaacttagaactttttaaaagaggcaaaggcagaggagaacaaaggaaggaggaagtaacttgtggaatgccgagaaaggtaaaaacaccttcaaataaggaagaggaacaggctaagacctaatgcttgcttggaccagtgtaagcatgccagggcaaatatttaggctaaattgtgggagctaagaacataaagtacattgatttctttattatggctagcagatatttaagaatgttagcacaggtctttgaataatttttgcttctaagagaagttactatttattcctaattagatggggaggaaagtctttgaagaggaacccctactttattttctatactccctcaccttcctaggtcgtctgaaggtttcctgaggttctggaaaacggaaagtatcctaaatacttaaatagtattatatgctaccaattaattgtccactctatcatctaaagatctcacgacaaacagtatatggaagtatatgtttcaccttattctgtaggtccaaattctcttttgagaattatgtggacttcagagctagtttgtttcatggaggtagctagtttgtttcattgacatgctgcatgcctcacttggtaaggctcaggcctcgtccagagcagggtatagcctttggtctagccaaccttgctggatgttgtaaagtattttagctattggattatgctttctataaatgtaaagatgtcacgggacctcaggtgtattcatgcaggctttgccatttatcctagctccaattagttaccgcaggtacagcaaaacaaatgtaaggcaccgcaccaacacgaggaattatcagtcttgttactaagaggacagaggaatccctaccatgtagggtaaatttctttctaggccctttaaatgtgaaatgtaataaggcaatttaaagatcatttcactaacatgtaaaggaaaatacaaacatgtgcacatctaattgcaggtcttacaattttggttctaaggaaaataattaacataagctcaaaatgacacttcctgcctgggaacagttctggcgaaataatgaacctgtagaaataaaattgaagagctaatcagccttgaacggcgctgaggtgtgtgtttctctctctctggttgctgttcatctcttgcttgtctctctgctttcccctatgcctttgatgagacacataatttttatgttgggcgacaaggtgacagttctctctgataattacatagatgagaatatatttggttttggaggaaaaaaatttactttacaaatgtatatatagaaataactttgaccttttggtaaagataaccaagttcttcctcagcaacagaaaaacaggcacattcggaggtgtgtgtttcattttatagtggtagctcctcctaataaaaacctttgtaaggaaaaggacaaagttgttggttcagggggctagcggtagaccccttctcctaacagctcaaagataaggtaaatcaaagtgccccccaagagttaaatgagagaaaacccacatgcagtggatagcattagccgtctgtggtgggaaaggaacagattgtcaatgaatgcatggttaaagagtttgagaacacccaaaactttaatcaaggtgatatgggagcaatctcatgaaagtagaatgggaggatggttgcatttagccattacaacctcatcagttgcattcccacaggaagactgcctggatattaagatgatgtcatcacagagctgggattctcacagtgtggtaagaagacctctagcatgagaatctcctgtaaaaatgcacatcctagggctttactgcatagacaccaaaaatatttggagtgggctcaaagaatctgcattttgtttatattcaactgaattttcttttttatagtttttttctaatttaaaaaaaagtaacacaatatgggctcattgtaaccaggaatgcaaatatgaggaaaggaaaagtaaatcttggttgatccttctttttctcttaccctgaggtagcaatactagtagcagttgttactagcaacaatactggtgagcatgagcatccttccatgccatttttcacacttacaaacatatatacatttttaagaggttttattttttgcttctcttgtttgtttttatatactaggtcatattataaaatttggagatttacttttctcaagtcataatgccaaacactccaggtattttaaaaatgtatgtacatctatatatgtattcacacacatttacacatatacatacaaacacccacatacatatgtgtgtcaggttgcttgaaaatgcagcttaaaacccatttagggctaaatactggcacagtagtccagtatcataaggaaaagttgaaaaaaactttgaagaatgacattcttttaaattctatagttttctatggaatggattattaagatattcaagcgtgtcccataggtgaacattcaggttgttttctattgttgctgcatgtgttttatttcattgccattacaaatgcctttattttggggatgatagatgagcagaaatgggatttccgagtcaaaggctatgttcattttaaattctattagtattataatatgactttcctaaaagcttgaggtaaattacagttgattatcatgattccacttagttatgtcctataaaatcaccttgagcactgaagtagcagacactgactcactgtgttaatgtattaatatgttgtatcaatatattaatattgaattaatatgttgtatcagtatattaatattgaattaatatgctgtatcagtatattaatattaaattaatatgttgtatcagtatattagttattaactctggaggaaatacagggttaggtttctgcaagctccttgtcacacatttttcaacccatcaatacataaccttgttttacatgtgtttctgtttaaatacatcttatttatttatttatttatttgagatggagtctctctctgtcaccaggctgtagtgcagtggcacgatcttagctcactgcaacctctacctcctggattcaagtgattctcctgtctcagcctcccaagtagctgggactacaggtgcacaccaccatgcccagctaatttttgtatttttagtagagatggggtttcacgatgttgtgcaggatgatcttgatctcttgacctcatgatccacccaccttggccttccaaagtgctgggattacaagcgtgagccactactcccagtcagcttatttattacatattattgataacctagcattgaactcatggccagcaatatgtcccatgcctgaacaatgcttatctaacacatggactttctctatcaggcactttacagactaaagtgcctttactaaagtctgtaaagtgcattatggagaaagtccatgtgttagataaggattcagccctgtgcagaaaatgtggcattaaattgaccaccaaaaggatactaatttacattatgagggtgaaacaagaaaggagaatgtcatcttgttctgcctggactgggaacatgcatgctgggtgaccacactgcacgtgaccatgaatgaccacaaatgatctccaaagtgccacaagtattggctttggggttacaaatacatttgagagtgtaggcaaatttgtgaatacagaatccacaaataataaggattgactgtatattcccaccagcaaagtgtttgtcatgttgattattcttcgtcttcactgtttcattttttaaaatatttgtgaaattttaggggaaaactatttcctcgttgccaactaactagtgaagttcagcctattttcttaatttattacacatttaaatgcaatctttgataacttacctgttattatattttgccctttttccaaccaagtgacttaatttttttctcatcaattcttagaaactgtatattagggatatcaatactttgttatatgttatgtaaatacttttttattctattgcttgtcttatttttgttttgggtatctttgctatatgttttaatactcaaatatatcaaccttcctcttgtgatttaaggtctcctgtcttattgtatctccaagactacatagaatttcacatttttattccaatatttttattgttacatattttgcattaaaatcttgactccatccagaatgtttttgtttctagtgttaggcaggggtctatgttcattttttttcttccagacgaacattcctcagttgttccaaataggaagagaggaaatcaacctctccatgtttgcagatagtacgattctctgcctggaaaaccccattgtctctgcccaaaagctccctgatctgatacacaacttcagcaaagtttcaggacacaaaatcagtgaacaaaaatcagtagcattcctatataacaacattcaagctaagagcaaaatcaagaatgcaatcccattcataatcgctacaaaaagaataaaatatctaggaatacagctaaccaaggaggtgaaagacctttacaatgagaattacagaacactgctaaaagaaatcagagatgacagcaaattgaaaaacattccacatgaattttttttttcccatctgaattgttcctggatctacattatccatgcctggtttccaggccctctcagagattctgtaaactacttatatcctttattgatccttttctacttagcctggataaagtagattatgattttgcaactaagagtagtaattggtgctggaaatatttgtacctaatggactgtcaagtaaatgggaacctggggttagctatttaacatagttgagtttgaaggcatgtggagcaaaacatttccgtaaatattggctttggttaattggagtgaagtgcctactgaaggcagcattttgggaaactcaagtggctgcttccgtatagtattttaagaaacgtggctgtactggctacatggaattgtgctaaaaatcttaaggaaagaaaaataaaacaggctcaaggttttaaattattgcctcaatgtagtctcagaaaacaagagaagttttgactggcctaaaagaatatcgtcttttatagcaacaaggttgatgaacttgaacatcaaacatatgctctgattctgtgacttattgaattacaggctgcattgaaagattggctgtgtttcttaagtgaaatttaggacattgggaagaaaagaatgggaccctgagaattagagtagagacatttgggaggattcagatgactcacactcccaacctccctaaatcctccttatcagcagcagcagcccttatcctctgaaggacacaaacctgtctgaagaccttagaaagaccttgcctagcttctaagaggatgccagttcctcatcactcactcctatcttattacctctacttatctatttgaagtcagatcccagtgtgtcccagagatttaatcataaagtcacaccttgggagaaatatatttcttctactactgccactgctattgcaattttttacataccaaaaaatcacaagattttgcaatttatgtctacaaaatttgcataaagttatccattgctcatcctaattttcttcctaactaaaagggacatctgtttttgcaatggctctagtagaatactacatttcccaagcttcctaatatctaggggtggccgtgggacctagtcaatgagacataagtttaattgtactgattattcctaaaaaaaagttttggtatcctaagaactgctcttccttcttctgcattcttccttactgcgtgggcttggtcacaatttctggaactatagaggtcatcttgcactcatcagggaaaggccagaagaattgctaggacttccaatctgacatttttaaacccctgaacaagtgacgacaatcacttttactttttttttctgtaattaatggaagggaaacaaacctaattgatacattcagccaaacacaatcatcagcagtgatgatgcaaaaatgtagcaaagacatagaaagcacctattttccccttgaaaaagtgaaaattcttgagtttcactgattttgctaatttagatcccataccaacactttattcaattagtttggccagagagtcgctgtgtgctagttggcttaggccagtagggccctccctgggagctggggtcaatcccattaaccccacttgtttgcagctccatgggaagaagtgctaagaagaaaaaaggagatgtttggatgtgaaataggtgagtaacatgtccacttcatccctattgtgaatatgtcattaaaatttactactcttattccactttcatggtcactgaacaatctgctggttggatttgacttctcatgtaatttataagagggatatgaactaatcaactaatactagcattgtgatctgattgctggtttagttaatacatttacatagacgattttatgaatcagcatctctgtctgagcttagttaatgtaagtactccacccccacctccaagagatctgctctgcctgtgatgacaagccaggtcttgagtctgtaaggatgttcagggccagatcccagaacagggaattctccaggtaaatggcatcctgcccactcactgcctggggaactgcctttgctgtactttttagcttctccttgaacccttgaaactgttgtagatgtcatgagtgttatttttcttcatgtaagatttcagcagtagcatgtgccctgtctccaggagtaccaaagataccatgcagggtgggacagagccagttcccatcttcctggagtcaacatgattctagaaccttcaccactatagattgtcatcacttcgattccatttaagagtgctgtggcagatgtaactagaatgataccaattgcagaaatgcagggtgagcttgcaaaacaaaaagtcattgattctgtaacccataggctaccaagtgtcatgcaaaacatctggggtatagttaacttgccaatatttattgagtacaataagatgtacatctgactaatagagatgttattagtaatactcaataggataaagagagttctggatgggaagatagaagctacactgctaagtgctaattttctttactatggatgcctccatgagcaaatcacttcaattgaacggccttcaagtttttcacctccaaaactgaatactgtactcacaatagttaaatatttcctgagcagttttatttatctcattaatttactttaaaaggcctttcttcgtatcacaaactccaactggattgtggtttctgagcaaattataacaaattttgtgtttgtggaatccaaattaatgagatttaactgcatgctaattaaaacgccttagaattctgcaaagactttcccttcaagagttcaaatttgttgatgaaattttctcgttagacttcacaatgagtgtggaaaacaaatgatcagtctgtaagccctaaaaaaagaaaaactttaagatattcttcccaggttttaataacacaacctggcagcaatggaacaacctcacaaacctggccttaaggttatcttgcaggttaactccctctcttaaagagattcttgtaatgatttaaaaccaaatggcgacgtagcattgaggttcaattagcggattccttagttgggtcttgatcacatctctgattgtcacctctaatagggcgtattaaaatttccattcattatagtcattagtctctgccagtgataaggttgtgaacaaatctgttggtgttcaacttctaatttgtgtgataatttgtttatgcttagaacacttactggttgtggatggagggggtgtgacccatttagaaactattcatgtagataaatctggaaagtttgcctggaatggctaaggcatggtgatgccacctagtctagtaatagacaagggccacttagaaggtcagatgagtcttattccagagtcaggaagagaagtggtttacccagagatgcaatggggttgcttcaaatgatccagaagggggtttttgcatggaaagaaaggttccattcggtcattgttactctacaaatggggagaaaagcacctgcatcagaatcatctgagaagcttattataaaggtaagctcttgggctacactccagacctctggggctagggccctggaatctgtgtggttagtaagcaccccagattacgcctaggcgtgctgaaattgagaaccactgcaggagacacctgagagcagagacacagaaacaaattaggtatagcaaagacatcaaaacattttgtagtaaagtattgagaaaccattcaacttgcatttatcattgggatttttgccgtcaacagctgaaatacaatatttaagaggaagaaaatttcaaatttgcaacaagccataagaaatggggcttggcaaagtgtcttactcctgtaatcccaacacgttgggaggccaaggtgggcagattgcttgagctcaggagttcaaaaccagcctgggcaacatggtgaaaccccatctctacaaaaaagtgcaaaaattagccaggtgtggtggcatgcacccagtctcagctactcaagaggttgaggtgggaggatggcttgagccctggagggagaggttctcgtgggcaagatggtgctgttgcactccagcctgggtgacacagccagaccctatctcaaaaaaaagaagaagaagaaaaagaaatggtttgggtgtgggtttttttttttatatactttagaggctttcaggttttttcttgctctgtgtggtcttattgagttatttgtgtttgagtttggtacataaaataattttagtacttcttattatatatacaagaatcatggatatgctcaactttatgtctcctatgcctgaaaagttgtgcaccaataactcataagtttttttaggacactgtacactttgtgaatctgatgaaaggcgtggaacttgattcccacaaatgtgtgtgcatcagtatataaagcattacatttaatctctggggacttagagatcagtgctctctctggactctacatcaagagcctctgacctgagcctaaaccacccagcctgctgcttcacaaagtcaagtagctccacctatgactcagccatagcaagcagggaaaggccatggtttgtgtgggaaaaatggatgaaagcaaaactgaggaattcagcagtcctcgaggcctcgactcacacctttaaatctgttggaattgccacaaaaatatttgttttcctacaagaatattagagatttacccatcttgagtggcaagcctagatgccccattcactcatcaaggcctgatgccatatttagcaaaagagccataactgaaggtgcgtttgatgaatttaataggattatgtcttactaatgacattaggctcctgggtcgggcttagcctttatatttacgttttatcactgcaaatgaagatgatattctctggcatatgagttttgcaacctcagggttagtcttgtgatatgtgaagtggcccttggcttgttttgggcccattataaattagatttttaaaaaaacattcactgtgtttattttttattttatttttgagacagggcctcatgctgtcacccaggcaagagtgcagtgatgcaatcacagccctctgcagactcaacttccctgggctcaggtgatcctcctacctcagcctcctgggtaactggggctacaggcatgcatcaccatgcctggctaatttttttggtattaattttgtagaaatgggttttcatcatgttgcccaggctggtcttgaactcctgggctcaagtgatctgcctgcctcagactcctaaagtgtcaggattacaggcatgagccaccacgcccagccaaaaaccattcgctttaggaaaaagaaaaatcaaacttcctataataccaccaccaaagatacctaacgttaataatatagcatgtattcctctagcaaaaattctatgctttttgcaaaaatagggtcatactatatttagtgtaatcaaatctggcttcttcacttatatcttaaatatctatttcaataagttccatctatcatgttcactggctgctaatattctccaatatttatgtatactttaagggtcaactaatagatgcttcagctcattccataaatgagatttttctaacatctttctatgcttatagccattaacatttgggatttttgctgctgttatggttaattttggagtctctgaagaaacaggtgctttgtagcatccagttttcttgcttaaaaggaaattcctcagagtttaagggtgtttagatgtaattttcacttttcactttgttctggaaaactaagaataaataaaaatccaaatctatagcccatgtccacccactcctttgaaagtaatcaacctcagtctctgaaatttcaaaggaaaaaactgaaaataccactgaaatcatttttaattagacatttagcagttcctaaagcaagttataatttggccttcaaaagcagtatttttaaagaagggagcattttaattggtatgttctggcttagcatattttctcagacattaaaattttaaaatctagatgtcatatcaaagtatatgagatgaaaaatatgatttcttctatctaactagctaaactgtggcacataactggacgtgtctatatggatggatctctgggagaaaagaaaaacttttctattagctatggcttgatatatctgggggcccagagctgccaattttatatcatgcatatgctgtgtagtatctcctactcaaagtgtggtccacggaccagtggcatcaatatcaactgggaacttgtcagataaatagaaccatgaatcccagcccacatatcctgaatcggaatcttcattttaacaagatccccgggtgattcttatacactttattgattgattgcttgattgattgagacagagtcatgctgtgtagcccaggctggagtgcagtggcgcaatcttggctcactgcaacctccacctcctgggttcaagcgattctcctgcctcagcctccaggcgcattccaccatgcctggctaattttttgtatttttagtagagatggctttttgccatgttatccaggctggtcttgaactcctggtgtcaagtaatccgcccaccttgacctcccaaagtggaggcattacaggcgtgagccactgtacccatgcatgctgttgaggacaccaaacaaatcaaaccaaccagatatatacacaacattcatctacttctctccactagatatacgacatttctttcaaagaacttgattcttgcaggtgtttgtaaagtgatttaaaatatgaagatgttgtatgtgcattaatataggaatgtgtgtgttcaatcaaatggacataaagagttacatatagtgaaacttctcactttattttgataataggagatttggtgagcaccttcattccttcttttcattttaatattgcatactgtgcagttttttaaaatttgttttagacacaagatctcaccgtgttgcccaggctggacttgaactactgggctccagcaatcctctcccctcaacctcctgagtagctgggactccaggcaagcaccactgcatggggcttggaacattttcttaatctggagacatctaaattaagactacaatattaaaatgatgaaaaaattgaataaagatgttcaccaaaacccctagtgttttgggcaataatgattttaaggctttgaggccccttcccaatgccagtcattctacaaattgttcataagcacaagcaaaatcgtaagttgtaatttggccttcaaatacagtatttttaaagaagggagcattttagttggtatgttcttgtttagcatattttattagatgttaaagttttagaatctagatgtcatattaaagtatatgagataaagaatatgacttcttccgtttaactagctaaactgtggcatataactggatgtgtctgtatagagggacctctgggagaaaagaaaaacttctattagctgtggcttggtatgtttgggggtcccagagcaagccagatacttgactggggaggggggaagagcaatttatgtgccagtaattacaattataaacacatgaatgtcctgggattggagaacctgttctgtatgagggtaccaggagatcttaacagtggaagaacatttaaactgaatcttgatgaataagtaggattccccaaggggaaccaggaggaaccagcacctcaggtaactggaagaatgaatatgaaaatacaaaagtaggccaggcacggtggctgacacctgtaatcccagcactttgggaggccgaggtgggtagataacttgaggccaggagttcgagatctgcctagccaacatggtgaaaccccgtatccactaaaaatacaaaaaaattagccctgcattgtggcgggcgcctgtagtcctagctacttgggaggctgaggcaggagaattccttgaacccaggaggtggaggttgcagtgagtcgagattgcaccactgcactccagcctgagcaacagagcgagactctgtctcaaaaaataataataataaaataaaaataaaaatacagaagtaggttaccatgttaacaaatacgttcatcatcttgttagtagggacccattggagggttttaatcaaggaatgccattagatttgtatttgagaaagataattctggtggttcagtagaaatagagcaaggtgaggtcagaggcagggaaatcaactaggaagccgctgcaaccatctgagtgacagaagatgaacttgaatcgaacattgaatgtagcaatagtagtgtgggactaagttcagagacatgctggaagtggagcaggcaggttagggactgagcaaagaggtagcgtggggagactagaaagacaagaaacactttgaagattctagttcggggctgggcacggtggctcacgcctgtaatcccagcactttgggaggccaaggcagccagatcacctgaggtcaggagttcaagaccagcctggccagctgaccaagatggtaaaactccgtctctactaaaaatataaaaatttagccgggcaaggcggcaggtgcctgtaatcccagctactcgggaggctgaggcagaagaatcgcttgaacctgggaagcggaggttgcagtgagctgagattgtgccactgcactctagcctgggcaacaagagtgaaactccttgtttctgtcttcccttccttgtgaaatcattgtagatacatttgggaaaacaacacaaagagattccactgtcccccaatagtaacgtcttgcaaatctatagtaaaataaacccttctaaaaattgtatgatttatgagcaattttaaattaaaatatcagtatactctcatgctgatttctaactagtcatttctctgacctcccacccctcccctcaccccttggcccctaccaccctcccacacacatacctaatggctctccagaccaggtcctgtccccatgctcccctgatcaagcagatcttgaaccttgtggggaaaatcacgtctctggtggtcactggatgcctggtgtccatcctgaccctctaaagctagggcttcccattgtgggctggtactccctacatgtaccctccatgtcctcttgtagggaccccagcttcagcagtgctctttaccatgttgttaaatatatggcaggttggggtttgattctggccacagctctccccagataactgacagagtcatttagggcctttgtcccacatttctgggaaatttgtttctataatagttaggactttggtatgctagtgacagatgcacagatcaaattaacttaagaaacataaatgtactggcttactgagttgggaagtccagggataaagctcccttcggagattctgggactcaaacaatatgatcaagattctctctcccttgcacttttgctgatttgttgacctcatgctcttcatggtgtggtttatatggccattggcagatctggagatacatccttatatctcagagtgacacatgaggcataagactcgcttctccaccatcactgcaaaaccctactggagaagggctctgtttggcctcatttacatcctgtgccaatcctgtgggccaatcacttgtgcagggcgatgtagtgtattttggatgaatcaaccaatgactcagcctgagctccttatcatctgatagacttggaattggggtatcaaattgtctggcttagtagaaccagatggaaagggaagaaagagtttttcaaaggaggagatattgacgggatgggctaggcagaacagctaatgtccattttagttattcctggatctagcgtcttctcctgtggtgaggagagaggaatgtcacatggcacctatggttgtctcttgggagttatggtcagtgttgacagaagaaggcaaggatggctgtaagcaccaagatgtttatatgtatgaggttggaatttagaggtgttcagaactaatagccttaattgtctttgtgaaattgaaaacaaaagcacttgtgaaaagacaggaaggcagggtggggagcttaaaaagctagttgagggtttgaaggatgagagagagatcacaaggacagtgtagaggactgctaagagatattgaggatccaactaagattggaaactgtagcactcaggattctccagagacacagtaggatggatatatatgcgtacgtacacacacacagaaatttatttcaaggaattggcttatgcaactgtgggggttgcacatctgaaatctctaggacaggactgcaggctggaaactctcaggcaggagctgatgctgcagtctcgaggcaggatttcttcttcctcggggaaacctcaattttgcttttaaggccttccaggtgaagagatgaggcccacctgcatgatcaagggttatctcctttactgacagtcagctgattgtagctgctaaccacatcaatcaaatacttccacagcaacacctaaattagtgtttggtgggataactgggtaccgtagccttgccaagttaacacatacattggagtgtcacagaggcctaaactctgtgagccagtctgcatgacactagatgatctatttttcctcttcagttccacagagataaatacctagcaaatagaagccaagagagtggattgttaaactgattgatgattggaggaatcttcaggctggggtcactggagtctcaaggggagatcttgacgttgctgtcgagagaatggtggacaaagtccctcagggttgtggctggactgagaagttagttccccaagcgtaaagtgacaagagcatcaaccccaccagttaaaatgaataatgcatgaataatacttatgttgggcactgaactaagtatcacattaattttaaattattatcattgttacgatttcatttaattgtcaaggaactgacactacataaagtcagagtggatttagtgggagtaagagggtgagctaaatgtggtatattggagtttatttatttactcaaccaccagttatttaataagcattgattatgagccaggaactgttttaggtgctagagatacagtggcaaacagaacagacaaagtctctgccttcatggggcttaattctgttggtgggaggaggtatctgctaataagcagacaacttcagcaagcaacactagccccaggtccagtggtaagcgtgttatgaagaatagtaaagccaagttaggcaatagagagtgatggggccagacagggctggggtaggatgctagacttataagagaaaccctttcggataaagtgacatttaaacaggaccccgaaggcatgaagggagagcgtgggctatgaatatatagggaagagcgtgttcgagagaaagaacatggtgtgtgcaaaggtgctcagaggctggaggctgcttctccctgtaagtgaggaggagaggggtgggggatgaactgggataggttgcaacaaggagccatgttgggtgtggtgggtcattataagttctctggagttcatgctgagtgaggtggcaagacagtggagagttttgaacacagaagtgacaaggttcttctctaagggccgttttggaggccgtatgaggctgtatgaagggatactgggaggacaaggatagaagaaggagaccagtgggaaactgttaccgtaatccaggcaagaagaatttgtggtctgaaagccatgctaggtatgagcatgaccaggaccatgccacgggtatgcattgctgaagcagcctgccagcgaagaccaagatggcccaggaccctagagcagcatgtctggaggggtctgctgtgttgacatggaacttcttcaagatggagacaggatgggtgggcatggggagaagaactctgacccagattctgaagtcctccaggagagggaagatggtggaggaaagcagcaacggggtagaaagaggagcattagctgcatgcaggcaggtgcttgaggctcctgcctctgggtctttgcatgcacttctttcttttctgaaacattctcttcctaatatccacgtaactcagtctcttccttcccacctcagatctttatttaaatagattggaagactgctgtcaggacatagtttatgtaagaatgaagataactctcttgcctccatccttatgtcacctggcatggggtggcatgagcagccactgcctggaaggtctacttggaagtggtgtcctcaatggagaggcggatctggcttgaggctgggaggtgaggggactctcctgtgaaaggggtaggaatgctggggaccttattgaccatgggctaggggtttcagcaggcactgtggggagtgtctttagggaagtcaggaaaggagggtagaatcaatggggatgaagtaatgagaggaccagagggaacaggtgctgggatgggagctgaggatgccagaacatgggattgactgccctgggagggcctggcaagcctgaggctggcgtgcatgcagcctgtacgcttcctggggcaccaagcagagcatgggtggccacaggagacgtaagggagcgttgtctgaggggatgtgaggaatgaccaggtgctacccacctacagagctctcaggatgcttaactcctgaagaagctgtagcctggaatggcttgtagacctgaatgtataccaggtgtaactggcagagagggagcaggccccagaaggtccttgttcatcctagtcaggtccttcatcctgtcccacttcagggcccaaagtgctctgattctaatgccagcctctttggccttgcatttgtagagaagcgagttccctatcattggaggtatctaagcaatgaagtggacagccacttagaaggagtgtgcaggatggaggcttgggtatttcttgggggctggactcgaagacctttattttccacttggcctggagcgtctgtgagtccttgtcaaatactgcctggcacttacctccatcgggacacagtgcaggcatggctcaagtgggtaaattgtttatggaatgcaaacctcgtgggacttatagatggcttatcaatgtggaaactgtattaaaaataagttgagatcagcaccttccacagcctctgcatatgaaatgtcacttacatttaaacccacatcaaaggttctgggttgattctttgtatacttgttagtagtccaatgcttaggacaccattttcaggtagctgttttttagtgtgtgtttggcagggctggttctatacaaacgttcacagtgagcagagggacagcatgatgtctcctgccatggtttcacaattagctagaagagagagggttgcaggctcactgggccagaccggacgctagaggctgtattcagtaggtggggcagtggcatggacctctctgcccatgatgtggacatcctggcagatgggctgtttcgagagcaagccatggcttcaagaccttggctgtttgtggtgatggggtgaaggaccgaatagttagagttcgtactgagtgtctgtggtgcagggagattctaatcacatcatttgggggtagcggctgtgcttagcactggttaagggaacgaacgggcatagttgtgctatgcttgtgagtatgctcacttcctggagatggggagagtcaaattcttagagtgttgtgtggcttatatattttattaagcacctgtgttctaagtccgataagcactttgcgtacactgcctttaattttccgaatcattccgttttgcttgttgaggaaggcaagcagttaagacaggctcatctcttgacatgaccccacatagtgactgtacctcagaggggtaaccattttctgagagctgggtcccaactgtgttagggtcaaaattctgatttgcataaccagaggtgaatgaagacctgggaaactgacacatactatcttgactcataagagactgatgtataaaaacagaaatgatgccagctgcttattttgtgagaagaaaaaaaaaacaattctgtgaaccagatacatatgttctctcatcagtgcattcaatatgaaggcaaatttatatgaggacataaattaagatcagaaggttgcttatcagcatgaaacagtgtaggctgagtgaggataggacaccttactgacagggttacagagctgtgatcgtcttggctccagtgccaccctgcctgctgtagggctggatggtaaggttacctcacagtgacagggacaccaccaccagtcccagccgctctcagtctctgcttgcagtgcctctaacactgatcatcatcagcccattgggctgattcatcctttctttagacattttcctcatggaccctcagtaagttgtcatcttcctttgagagcaagttttctctttgtggtatctttgcatctcaccactttatttcgttatttttgttttgtggctataagctctacagagaagttgtattgttccatttccaaatttgtgggaaaggggaagaaaagaggagaggcaccatattgtcagcctgatttcccacctcagagacgatattcttgtcctcgttttacaattgagtcaactagatggcatggctttttttcctagctcccattgccatctgacgtggtatttatttagttgtttgtttattgtctatttctcctgttagaatgtaaacttggggacagcaggtctttgccatattcttggcatctggaacggtaagtggcctgaggtaggtgtgggcaggtaggagtatgcgtggattgaagaaggatgaggcaggccctcaatcccagtctctcccacaccccaccttcagtttggtgaggtgacagaagggaggaaaatatgagaagatctgagccaaaatgaaaatcagacaaaaactcagggcatgttctgggggtccttgtgtccctacatcgtcttaaagaaccagcctgggacagtggggactggagctggtgacacacaaggacccaagaatatggaaggcctttctctggcataattgaaataaactttaatgaacaatttgtcctgttttaaatatctttatagataatatctggagctggacaaatcatgtataatctacttcctttatcattcttatttcaattatatccatctacaatgtctcagccaaagggaacaccatttacctggtagcagccacctgaattttaggcattgatatctaagagaaaataagttgctcaatggttgctcctttgtaacgccaaacctaggacttgactatatggttctgatacagtccaacaatgtgctagttgataacagcttgtagatggatatatatgtattctgcatattttgtttggtgaataacccacagcattctaactcaggtgtccagtactgcttatcaaataaggctttaacatagaaatacataaattctagaaattgtcttgcatttattgtattagaaagtgaaattggtttctttaaatctttgtaagggctattaacataatatcttgttccaaatcaaatagagctacttactactaaagacttttgtactttcttcaataattaaagcaagcaagatttgtagacaatgcaattttcatgatgcattgaaaaatgtattcttacagcagctgtgtttatcacacactttcattttcttaatatcttaaaattgcttggcaaaatgaaagggaaggagggtggtcagggatgtttccaacattctattaggatcattttcacacaaacagaaaatctgaagtaattgttcagtgggtcccctgcacccatcacgtacattttacaattaatgttttcctctgtttgcttcatcactggctatccatgtattcatccctctcttcatcttatttttggtgtattttaaattaaattgcagaaatcagtacacttcaccactaaacagttcagcatgcttattattaactcgagttaaatatttaatatatatttcaggtaaaatgtgcgcacagcaacataagcacattttaagctttccattcattgagttttgacaaatgcatacacctgtgtaatgccaatcccaagccaaggtacagacattctttttttttctccaatttaaaactttaattaaaaagtaaactttaatgtcgaaaatgcaaacttggggaaggcagaaagatcacacacaaggctgtcacttcacacttggaaggttgcacagcggccgggcagaggcgctcctcacatcccagacggtggaggggccgggcagaggccctcatcacttcccacacggtgagggggccgggcagaggtgctcctcacttcccagacagggctgcggccagagagaggcactcctcacttcccagatggcagggggcgctgagcagaggtgctcctaacttcccacacgcggtggcagctgcgcagaggcgcttctcacctcccagatgggcggcggccgggcaaaggtgctcctgcttcccagacggggcggcggcattcttaccacccagaatggtgatgctagtgcctctttccagtcgatttccaccctacgtgcacgcagagggaacccatgttctgatttttttctcagcatggattactttagtctttcctagaactgtatacagttctagaatcatatagtatgtactatttgggataagtacatgcaatacatactactttgcatgagactttttcacgcagcacatttttgaaattcatctatttttgtttgcatatgtcagtaatctgtacccattttagtgctgaatcatattccattgtgtgaatatgccacaatttttaaatctatttacttatcgatggtcacctgcgctgtttccagtttgcagctattatgaagaaaattgctgtgcatgttcttatgcaagtctttttgtaggcataagctttctgattacttttgaaactcctggaatatgtagtcttagcacagagtctacacacagtaggtactcaatgaatgtatatattgccctggcacaaaacccacatgacatgttgggttttacagtacaccagacgttttcttcctcatctgttctcagatgagcttcgtaactacctgctgaagaggcagaggcaatccacacaatggaagctgagacattacataatcgctaattgttggagctaaactagaaccctggtttcctaactcctagtcctgtactctctgactgcttgctattgagacgggagagttcccttgacccctttgcaggacttgtgaaaggggtgtggcccacttatttgactgccaccatgctcaaaccccctgcctgagagggagcatgcaggtgagcaggtacaggagctgggggaatgtggcaagaatgaaccccgtactggtactggtcaacggcagcatccagggttgtctgcgacctctggagccctcgagggcatgtgttacaacgctcatagcagttactatctgcagatagctaagtgttaaccagctcagtggcaagtcagggtgacaggcctttacaccctgccctctgggtacctggcttcctgtctggtgtccaggaagaatcaggtcacataggcttgaaggatggttcaaaatatggagattttattaagcagtgggagtggctctcagtggaaagggagctggaaaggggatggtgcgggaagaaggtgctctatctctgaagcttggccgtctctgaggaggctcttctccaaagttgttctctttgaagttaagccgcatctgtttatagtttcggacactcagttgcttctccttttcacgttcagctgcttgtctctctgccagctaaggtctgaggtttatgtgggcacaggagagggggagcgggtaggccaaaaaggtaacatttgggtgggaaaacagggataactcttctcatttagggctgtggtttccaggcttgagggtggggcctttgccaggaaactgccctcttctacccagtacttccctgtctcctgtctgtatcgctatgtcagtgccaaaccgaaggtatgtgtactttacatcctcccttccccccaagcattgctctgtgccacagttacggtctttgagagttttgggtttgtactttggctctatttaagctcctggtcatcagaacttatgtatattttccccttttatatcatcttgttttctcagtgtgtatatattgaggtgaggggaggggcagcagggagggcctgtagagggagttattgaaaagtgacctaagccaatctggtacttttgattggcaatcagagaagtcagccatgaggttcctgagtctctctttctctgccactcccagctgctctgggatcatgaaaaccagcctccaacctgattctgcaacacatgaaaacttttattaacaaggagattcatataccatgcctaaaacactcatacaacctgttctgtaaactcaagttgtcccccatccgtggtttaggcagcccggttgttaccagtggaaggtgtccgagttactggcagcaattccatatggatctgcagcaacttcaattcttgcctcctcagaagaaagaattcaatggaggggcataaagcagaaaaagagactgaagttaagtttcagagcaggagtgaaagtttatttaaaaaggctttagaacagtaaagaaaggaaaattcacttggaagagacccaagtgagcacctgaaggtcaagagccccgtttaacggtgatgctaggactttctaggattcccatgattcctcccttagggtgagctgcctgcatgcacagtgccctccttacctttgggaattgtgcacacacagtgtgtttaggaagttgtatgcatgcccatctgtggctttcttcccttttctggtggtgtgcccctggaagtcatactttgccattttgtctcttaatgcacctgcccaggaagttgcttctccctggagcctgcgtttgattaacactttaatgttaacagatgtgcctcatcaggagattgtctctccctggtgcccttggactggctgctgaattatcatttttagagaggcagtgtgataattgtcagaccatcacctgacattcctagtgggtgggggagaagagccttctcctgccccgctcatgcctgtctaactacctgtaacacagtgagcacctctcttgacaccagtaatctgatagcaggatcaggaagctgcttcttgaggacagagtctttccggaagcagtaggacagtggtgtgaaggaagttctgggcctcagccctcctctgaaagtgtttgctaggctggctaagcccagcacccttttcatggaaattttgaggtttctagccatccctcaaatctctcatagccttcatttgaccattgaaaataatttctaatatccctttatgctaattaatgaactatctgttgcagattcagatgggagagttagaagcttttatgaggccacctctgggaatataaacaccatttgggatctttcaaatgctcactaacaccactgtcttggtacttcctgcttagggtgcttcatatattaactagtaactgttgagggtgtcctaacatgaatctacacacacacacacgcttaaagctcactatggatggcggagtgtttcaacataaaacccaggtcacattggggaggtactagagtccatgtgtccttcccctaacccccaccctctaacggtggcatttccaccagactcttgagttttcagtttgagggaatcctttgaataaatatgattttctgcctccacacttaatgtggttagagctgcagccttgatcctaatctgtctgatctcccatcctcattgatagtaaaccagtgagtaggcaagtcaactgtgagttaatcggggtgggggggatttttaaatgcaagtctgatgtttaaatgtagctctgattatgcctcttggctatcagaagtgagtttcatttggatggagagccattttactgagggcacacagcacagaagctgagctgcagtgtaaagctttcaagtgactcttggagctattaaagtgccactcatttggtaactgttgctgttaattaagtttgtagccccattattaattcttggctctactattattaattatgcttctataaatttatagtaggcagtacctcagggaatttttcaagttgtatattaaaattagagataaataaacacttaagcttccttctcaatataagaagagtttggggtttttatttccggtactaggtaaatttgaaaggtatgtgatggtcattttctctccttactgaaacattttctacatggtttgcagcagaaatttctgtaacatatttaacaatgcggtttagtatttaaatatttaacccattcactgataacttgtagctaattcctacaattaaacttacgcctttggccaggcgcggtggctcacccctgtaatcccatcactttgggaggccgaggcaggtggatcacgaggtcaggagattgagaccatcttggccaacatggtgaaaccgtgtctctaccaaagattcaaaaattagctgggcatggtggcatgcacctgtaatcccagatactcgggagactgaggcaggagaattgcttgaaccagggagtcagaggctgcagtgagctgagatcatgccactgcattccagcctggtgacagagcgagactctgtctcaaaaaaaaaaaaaaaacaaaacttatgccttttatgagagcaagcagacagagaaggaaaagaaaaaaagcctggcattttgtgtataaaaaatcagagctcaagtaatgttggtcaaatatagatgcaaacaagtccatgtgcatattaacaacccctttcaccatgtgctttatttctgaaaatactttaaatccttttctgtcttctgatccagctctccagacaatagttaataaatgggttcataggtaattatgatgcattttggttcttttacctacagcaaattcctttttttctctctctcttattctaagaaggaacaaaaattgcccataattctccaggttatagaaaacgtctattggcattttgatgtagttcctttcagatgcttttccaagcatatatcaaataatttagatcacacaatgttatggtttgattttaccccttaacatttgatgtagcaattctttattattggacatttaagttgtttataatttttgtccttgcaaataatagatatatgatatgttggatagctctttaaataaatatttgagagtacctctaattatctattttaatgcctagaaatataaattttttgcctaaaggcatgaacattgttcaagttcttgatacatactgaaaaattgctttccaggaaatgacgccaatttccagtccactagaaacattccacggtgtctgtcttactgcggccatgccatttaatatagctaatacaattataataatattaacttgctaactttataatttttgaattcggaaacttgaatgagatatgctggaacatcaaatagtgacctattttatctcaacgcttcattttgctttttggagccaaaagagttctttctctctcaaattggattcagtagttgaggggctacacattaactgacagtagccatattaacaagagaaaagacaatatttatttacccatgcatgggagagctgctcagtaatgagtaacccaccgactagccagagataagggtttatataccaacttaacaaaggtgaagggggcaattagggattcagggggaaggcatgaaggtgctcttgggcttttcagtgataatgggaataggaaatatgtcttcatggcagctgaattaggaggaaactgcctttgaggggagttaatggcagctgtatttttgggaggctctgctatagtcagataagggaagttcagataagacttctttctgcatctcctgcagctcaaatgttttcaccttaaaataacctttataaagactctgagggtccaagtgcatccccatactttctatttattttaacatcacaaataaatgtgctcaataatagataaatttttcatcatgaaatgtattgaatattagtaataatggtgttttctgccgtttttgacaggtaaattaccagtaagggatgacacaggaggagaaaaggagaaaatgaagaactgtcataaggataatttttattacagatatgaatatatttgtttggaactaacaactatttttagaagacaaattaggcagaagtggtcactactgtatggacaagggtgaatagtagttgtgattttcaaaaattttttaaacatatctcttgatacagtatttttccaacttcatttcttttctttttttttttttttttttttttttttgagatggagtctcgctctgtcatccaggctggagtgcagtggtgcaatctcggctcactgtaacctctgcctcctgggttcaagcagttctcctgcctcagcttcctaagtagctgggattacaggcgcgcgccaccacacctggctttttgtgtgtgtgtttttaatagagtcagggtttcaccacgtgggtcaggctggtctcaaacttctgacctgacgatccacccgcctcggcctcccaaagtgctgggattataggcgtgagccactgcacccggccttccaacttcatttctttcaagtcacagtcatggaacatgtttacaacttctgagttacactattttggataaatagtcataaatatcagaaattgaaaattagattaattcctccttattttgatattcacctaggaaatagtttttctacagatattattctggcaaatctcagtttcttgaatctcagttccttgaatcttgacttttgtcgccacccttgatttgaacatcccttggcagctttgtggataatacagtgtgagagacataattgaaaagcatgacaagtgagaaaatgggttacatacctcaaaacaaaggctcattatacatgacaatgcaattcatttgggtctctccattgcatatttgctacaggtattgattgccttccaactcttcccacagccttttgctagtcttaaaggcataaatcacttggtgaaaggatatttctatttcagccagataaactctttcctttttgtttagatttaatatgaaggcaaaatgcactgctctcagtgaacagccttgtttcctttcgtttaatggggaagggaacactgaaacatttcctacattctctaggaaaagcaccttttttttttttcttgtctttataaccctgtatctgttgtcactgattcagctattcagtctgggacaaagcgacttttaagttctagagctatgaggaagctataaagggaatacagttcactctgtagagaaataacagcctgggagatcatggaccagaaatgttactctccaaaggtttgctagagctttactttgaattctattcatcaatatttttgttggcctggatcagtgactctaattatgtatagaagatagaaacagcagttatatttagcaagctggaaaagtccctgcagtctaccctcagaacagctaaacatacggagtcaacctgagattctgaatgctctgttcactccctgagagataatgatgactgaagagtgatagcgcagggaacagagtaaagctagaatgggaggcaaggaaagttatcagtcagacctctaggagaagtcccagcccctgccccatgcttttgttttttatttgtctaactttttttttttttttttggagattttccatttcaggcttttgttgcttttctcaaatgtcaaccctacctacctctctctgaacgaacagcccacactttctacttcatcaagaaaattgctaccacagggatgatatcatagcccattactgtatgatgctatctataccttagcctgggcttccaccatttctttgtctcccaaggagaagggacgtgactgcaccggatcttagtgtcatcttttctgcctcccattggggactgtgaagttattccaaggacagttgttccccctaccatagctgctagctccttccctcgtgccaggagccacttagtcacagggtaactgaagagaaaaaagaacgagacctattgctgagcctagagcaagctcccccatacctgcaccccacatgtgtaccaaaagcttgctttctctcccattcccaggtctttgatggggacgaagctaagaccatgtatgccattggccccaggcaataagaggtgcattgtctgcaaaagtcttaaaacaatattaaaatcaactaaaaattggtctttttttttttttgagacaagagtctcactctattgcctaggctggagtgcaatggcacgatctcagctcacagcagcctgcacctcctgggttcgagtgattctcctgcctcagccttctgagtagctgggattacaggcacccaccaccacaccccactaatttttgtatttttactagagatagggtatcaccatgttggccaggctagtcttgtttttattatcaccatgttccagcaattctaaacgatatcagcgttggggaggaaaaacatctcttctttctacctgtcttaagttcattggctggggcccctataacaaaagacagagtaacaagagaaaagcacacacgtttgttgaatgccagttttatgtggcatgggaatcttcacagggaaatgactttgctgagaccagctcagtgggggagaccctaacccagcggtactagaggaattaaagatatacacacagaaatatagaggtgtgaagtgggaaatcaggggtctcacagccttcagagctgagagccccaaacagagatttacccatgtatttatttacagcaatccagtcattagcattatttctatagatgttaaattaactgaaagtatcccttaagggaaaggaagggatgggccaaattaattgcagcaggatcacgcccttaagacacagattgctcatgcttttgtttgtggcttgagaatgcctttaagcagttttcctccctgggcgggccaggtgttccttgccctcattcctgtaaacccacaaccttccagcttgggcgttatccttccagcttgggcgttatggtcattatggacatgttacattgctgcagagattttatttatggccagttttggggccagtttatggccagagtttgggggggcttgctcccaacagacttgaagaagcagttaaactgggagtttttatgctagcttgagtgaagagtggagagtcatggagaaatgtgttaggacagaaaaagtatgagccgaggatagtcaactgggagaaacaacaaggtctgtatgttcacattcctcttgacatccctgtgtctttggagagaaagatgttattttcctccaggcatagggagggtacctttcacatgatctgcctcagggaaggatcagacaatctttgctatacatgctgttttccaaattccttcaacctaaaatattcagtattccaagtcaccatattttggggtagtatgtcttgaaccttatcatcagtgatgtaatattcctccccagaaaatccttttgttggtaagttacaaacaattgctataacgattgttgacccactggcttcctacaggcaacccagctatactcagctgagtgtcaattcataagggttggaatcatttgagtttgctgcctgcacagtttgtgtctctaagccctgtgatactacctagtcctacgtttaaaaagtaggttcaaaataaacaatggtaatacaacaattctaagggtaaagtgacagagcttgccttattgcacttttgtgtgcagatctttctctaaccttgtagcatttattcctttggacgtgtttcttttatgctctccttctcccttaaaataaatacttaaatgtaattaaaaattattaatccattactttgtttccttttttgtactgtgatagttttctaactgacttgaatgtacatacaaaatttaataaaagactatgttttatgtttgccattattttttggcttttattactattattttaagaatattattgaaggcttggcgcagtggctcatgcctgtaatcccagcactttgagaggccgaggtgggcagaccacccgaggtcaggagttcaaggtcggcctggccaacctggcaaaaccccatctctactaaaaatacaaaacttagctgggcatggtggcgtctgtagtcccagctacttgggaggctgagacaagagaatcgcttgaacctgagaggtggagcttgcagtgagctgagatcatgccactgcactccagcctaggtgacagagcaagactccatctcaaaaaaaaaaaaaaaaaattattgaagacaattttgttgtgtagaggaggagggtcttaaatgatcctctctggctgtcagatatgctggggactccctgtgttcctgcacacctgcccaggctctctcctctccttcctccctcattcctgcacctagaatgttttcaaaagttattctaaaagcctaaaataacttccgtgaagacttgctgtgataattccagctctttctttcttctctgaattcttctaacacattgtagttttccatacaatgtagcaagtgatggtatgccagcttagactttttctaatactttttttcccaagatagaatgtaagctccctgaaagttggggttagccttatatttcttcttttgtgtctccccaaagacaacttttggaagtatcccattaaaatgtatactctgtagaaaccagctcaaatccttcaaaaacagctcttctactcctgcaaacttcattatcctctcataactttatgtgatcatttaaaatcaggtttttctaaaacttcggtctgagtgaccaaatgcaattgcttatcttcaaggaaatagtgcttgctttaggcattcactccagaggcacacaaggagagataggtgaaatcaacatgagcagttaatttctggtttcacccgtaaaatactgatttctgtggtttgaatgtgtccctcgaagttcatgtgttgaaaatgtaattccaatgcaatagcattgggaggtgggatcttcaaagagtaatttggtcaagagggctctgtcctcataaatggattaatgccattatcttgggagtgggttagttatcgagagagtgggttgctaatgaaaaggatgagtttgttccattttcctgttgctctcttgtggactgtcttattcttctgcctttcactgtgggataacacaacataaagaccctcaccagatgccagcccctcaaccttggacttcccagcctccagaactataagaaataaatctctgttcttaattatccagtctgtgttattctgttatagcaacacaaaacagactaagacagtgactctacaaccctaaagaggtagtcactgaagaactattaagcattctctcagttgtgtcagtgaaagccatctctatttgtgttccctatcttaagccaacagttctcaaaatatgatccagggactcccaggagtcctagagacctttccaggggttctgtaaggtcaaattatttttataacatgacccagacattatttgcctttttctctctcctaagtgtgtcaaggcattttccagatactatatgacatgtactatcattatagatttagcgtggaagcagatatgagaagccagctgtggtccattaagccagagggtaaagagatttgccaagaatgtaaaaagaatgtcttctcatggagttttttgtttgggaaaatagagtaataattcataaaaatttcctatttatgttaacatatgagtttattgctaattttaaatcaattcataaacacatattttttaatttttcagttttaattttgtatacagcaaataacactctatgtaacccacatatacaaaaggtccttgaggccctcaataagagtgtaaagaccaaaaagtttgagaacttctatcttaggccaaagcagagatttttagaaacatattcttttaattctttctttggttacttacctccaaatcaaagcaatgtgctgcaactgaatccagtggaaaaattaattagctctatgttaattctttggctttgctgtgaaaagcctgatctttgggccattgacatctgttagaaatttaaactcttgagccctgacccagacctactgaatcagattctgcattttagtaagatcactaggtaattttaacctacaggttgagagttatgagcactgctccactttgcctttgtgaatctggctgggatctttttccaactttattgaccatgttaattaactccctcttttttgattctctcctaataaggcttgcagctataactgcagtttatcctgataaaacttatttctgtagggggaaaaaaataatcttctccttcactcttcaagaatttttagctgggactccctgtaacaaaaggtagattaacaagggaaagcaaacaaaagcttaataacatgtatacttcctgtacacatgggagataatgcagaaaaatgagtaaacctctagagtagatctaaaaaagttgtcttagtcttcaggcttaaataccatcctttgctaagacaaaagaaagttatagggaaaggcctggttaagaagaggtggccaggaaaagcatcataaacaaaaccaaggtttgttatgcagatttaagtaatgccttctgcattgataagagtctctagtgatttagacattttcctcttcctggtgcagagagggagacattcctaccaatagggatgtcctgtatagatgtaaatttatgttacaaaagggtaacttttcagtgcttcttctgtatgtgcagtttctcaaaataaccagttcaaaataatcccatgccaaagaggcctatttggatgggcatattctggtttcctacaatcatatgttgggatgacatgtcctgaattccatcacttcctaatgaaatctgataaaggactgacttgtctgacatttattttcatcctacaatgtgaatgcaatgaaggatcaatttgcaattgtattttttatggccttttggatttatgcactagagaggtgctaaagctgatgtgttgattcaagtgaggagtaagaggggtgagaaactgtgagaaaaaaaagtactataaagacacatgcacacgtatgtttattgcggcattattcacaatagcaaagacttggaaccaacccaaatgtccaacaatgatagactggattaagaaaatgtggcacatatacaccatggaatactatacagccataaaaaaggatgagttcatgtcctttgtagggacatggatgaaattggaaaacatcattctcagtaagctgtcgcaagaacaaaaaaccaaacaccgcatattctcactcataggtgggaattgaacagtgagatcacatggacacaggaaggggaatatcacactccggggactgttgcggggtggggggaggggggagggatagcactgggagatatacctaatgctagatgatgagttagtgggtgcagtgcaccagcatgacacatgtatacatatgtaactaacctgcacaatgtgcacatgtaccctaaaacttaaactataataaaaaaaaaaagtaactgtgttttcttctgtttaatgattgttgcactctcctacaaattctctttaaggaaattttcctagaagccttcttccttgaatttgtaagaaagtggcttttcagtgggttgacctcttggcttttacatgtaaatacaccgaaaaaaaaaaaaaaccccaagggatgtaaaaacattgagaagtttctcaaaaaaagaaaaaagaagtccatttagtctggtataactatgaagtaaaataaatcatagtatctgagaaagaaggggaaaatattcaattgtcaaaattagcctgtctcatttatttggccttggagaataatagtcattgatatagaccagtgggtttcaatcttgaataaacagaggatcacctataaactcaagaaaaagcccatgtctgagagattgaattggaatttggtaggtacttatctttaaaattttgacaaggtgattatgaaacacaatgagaattaagaatgtatggtatggtcaaatacgtgagcagatggaacacaaagtccctagtctttaagtgtgtggattcaatcatttattcatttttctttatccagggttagatcctgtaggggcaaagataatttccccctccccctctgaaggttcaagtctgctgaaatgaactgatgagagagattaacagggcaaaggcatacaagtttattaatgtgcataagcatggaagccatacaaaaaaatgaggctcacagaaaggccagatagctgaagcttaaaaagcactctctttgtagaggagccagagatggtggatgcatgaaattgagggttagtagtaaatgctttttaagagagcttaatggacccaaagaggaaacaatagtttataaatgattctctttggaagttgaatttatgggacggtaaggggcagaactgcaaagcaaacgaaggttgtctttttatgcagataaagtttcttgggtaatttcctgaagcggtcctcagaagggtagatgaaaagtttgtctgggtatggtcagaattttgctttcttctcttctccagtggttaatctttcttgttaatttaatgaaattcctagggagggggtttaagactattacaattcttttagaaaaagttttcttaatcagatagggaaattccagagagaggtcctccctgcacttagaagcaaggaaaacagaaagttagcaagtccttggttcagaggcactttctgaggtattccaatttctttcaattcaaaagtggtcagcatgccaaagcactttactttggaatatcatttttctgagccacaacaggcctgtccagagatttgaattaagcaaattaacacaggaacagaacaacagatgccacatcttcttatgagtgagagctaaatgttgaaaatatgtggacataaagatgggaacaatcgacaccagggactactagaggggaggatggaaaggggagcaagtgttgaaaaactacccattgggtactatgctcactacctgggcaataggattgttcattcccccaaaccttagcttcacacaatatacccatgtaacagatctgcacatgaaccccttgaacctaaaataaaagttgaaaagaaaagaaaaatgaataaatcctgtttaacacaagaattttatggccttatacattttctaatgactattagccaagtgggaaacttgttgaaggtgtagagaactaagttcaattcctcatttattccctagatgagctatgccattggagtgaagactctgaactaaattaaaaagaatgtgttagactagtttttgtaccatagataagatggatgcacttgtgctttttaggtacaggaattcagacctgtggaagatccctggagggttaaggaatgcaaatctgcattatctgtaagccaaacatgtaatatgattcactcatgcgtatgcccgccattctttgtcaaatgtatgtgtgggctttattgacagaaaaggttttcaaaaaatcatttagaagcaccactgaacaatgattctttttatcagttagtttagaaattattaatgaccatcaactatgtatcaattacatgtaccctgggatacagtagtgaatctgacagccctaaatcagggagacatacagattaacagatgattaccatctagtgaatttagtgctgatcccattatatctatctgcagtataaatttaggtgtctgtaatcctagaaatactgctttaaagccagcatgtctgctcccatctccctgttagcctgtacaaatctgctcaagtgttaattagtaatcccaggagagaagtgctgtcattcacaattttctcaaaattacctctagaaatagtaaacagtggctcgtaactgatgaatgtgatggttttagccaaaacatattctcaatctatgtctactcaaagtagggcaatagtcatgatggggggaggggtgatagtaaaaatgcattaacatgaaaatgttgaaaacaatgatgcagtccaattatctctttatagaggaggactctataaaatgttaagagagatacaatgacatgttctagattcatggtctattaactcttgatcctaggtttctcaaagggctgaactgactcaaatatactggggactccctctgctcctcacacctgcccaggagggttacttctcaaggtcttgtgccagccattagtgttgtccactcaaactgctcaggaagcgtggtaagcacggtcagttgtgtcagcatttgcacaaagtcagtgacttacggtgcttccttgtggaggagttctctatccaatggtgccaggcttggccatgtgacttgctttggtcaataaaatgtgagcagatgtgatatgactatccacatccgtgcttaggctgtaagagccatcatgtgactcagccatgctcttctctctgccatgagaatggcatattaccataggaaatagtccttcagcctgtggagatagggcaaaacagagccacggcccacctgccactggcatgtaaggtgagtaggaaataaagctttctttgtagtgtacacccctgtgattggaaggttatttgttactgctgcataacttagtgaaagacaacttatatagtaggccagagacctgccaactttttcttaaagaccagatagtaaatattttaggcttgtgggccatttacagtctgtcatagctactcaattctatggcaaaagcagctattgacaatatataaacaaataggtatggctatgtgccaataaaactttatttacaaacacaggtctttggcttgtgggctgtagtttgcccacccctgccataggattttgcttcctcacctccttgaagttggatgtggccagtgaagttgggtgtggcacttgctttgcctagtggaatgcaagctatttaaagaagtggtgtaagtggtggctactctgtcagtctgagtcttgagagataccattagagagctgagcatcggccaacctatgctggacattcagcataactaagaaataaaccttattgtttaaaaccactaagatgtatggggtgtttgttactgcagcatatataactgcgcctatctgtactgatacaggtctatctggcattacgtttcggggcaccacctctgctcactgccatcccagggcacctcacgtggcattctttgttactgacttctttataatgtttgcgttgtagaccacgatgacagaatttacttaacgatgatgttttgattatcatgcaagtgtgggggaggattgttctgttgaaacagcgtgactgcaaatattttaccaatagatcagtgaaattcacgtgcccttgaacattttcaaaggtatgaaatcacctgaaataattttttagttcattttttagtggctaaaatctgttaatagtttgattcacaagcctggcctttgaaaaagtaaaaattggataatgctgcacaagccatgttctccctggtgtgtaagggttaattattggactcttgcttgatgatgacagtgcaggttcattgaagtcatcactttatatcaccagcctgtctgcagcactgttggggccacgcctcttgtgcgatggttggctcagacctgtagcttcctttgccttatcccctttcacattgaagcctcatctgctgcttgacagtgcatgcctgagagttgcttttccacagtccctgttcttctcctaggtctggttaattgcttctctgttaaacagagaacatgttgaacagcagccttaaattattgtccaattttagcctactgggaacccctctgcagctactctgatcaccactgatatttctagaaagttcctattcacaggggactcttttctcccttctttatgctcaagggagaataaatcacagaagcagcaatccctccatgtgtcaaactatcaatcctacatggagctacaaaacaaaaggcagtatccctttgttgccagagaacatccagtccctgtacaagtctgtgcctcaggggctcaggctcattagcaccatagcagtggctcatgctttccatacacttttctctaccaacacctacagttagtctcagagttgttctttatcatgataggttacagagcagtgttttaaccatattaccttgactgaggtatggtgaggccagatgtggatcaagagaaagaaacagggatggattttatggttttgaggctcacagttccctggggagacacagcaggctgtgctgggccactcagcggaagcacagagtgaggcatgaggcagagggagatgggggatggtagggaagcagctttattgtcgtctccagggaaaggaaaaggaaaggcagggtatgcaggtttaggattggctaatttgaaaatgttcttggggctctggggcatagaggctgtccccggttgtctcatacctggccccagggtgatgaggtaggtccacggtggcctagggtgcaagagccacttaagggaagtggtgggagtttaaactacttggttgactcctcaagaaggggaactgactggcctctagctagggcctcaaaacagggtgaagacagtatagaataaaaaatatattacaactaggacagataccaacatactgggggtttgtacctaccacagttattccttacatttatgtttcattttgtctagtaatagtgaagtgaatggagttctagactgaagtctctgtttaggcagactctgaatttgttttctcattggttcccagagatggactgagatacctcagtcctgtggatacctcaggcaggcttaaaatgtggcacaaattctctttaactattcagttgatactttttcgtgagggcttcaaagaggctgattttctattgctaaaaattgcatacctctctatgttcaaagaaaataccatttactttatatatgaaagagcatttgcttatttggaaaacttttatttgcatttcacattttttatcacttcttactaaatagaagtttctcacattctctagggattgaactaagtgataacttagaaagaaagtattgttcaaatacccattttttggcttttatgttagtaaaatgtttcccctttttctagcttttctttgtgatttcagaaacgtgcaacttctttgaacgcatattaaatgtttttaaatttaaataatgaaccacttgcttttgttacagcccagtggttcttcttgcctgctgcacagacagagccaaggcactgagacagtagtgttgcagcgagaaagatttaattattgctaggcagtcaagtgacagaatgagaggcatttctcaaatccactgccccaagagctcagaggctagggtttttaaggataatatggcatgcagggggctagggaataggtgctgctgattggttaaagatgaaatcattgaggtcttcatgcactgagtcagtttctgggtaggagtcacaggaccagttgagtcagttccctggtgtgagtcatgggtccaggtagagtcagtcagtagccagaatgcaaaagtctgaaaaatatctcaaagaccaatcttaggttttacaatagtgatgttatctataggagcaatttgggggcattaccaatcatgtgacctctggctagatggctcctgagcagtaagaaattatagaaaagcaagctaggggacaatggttggttatcatttagttactcctacattttagcagaattcaggcccctcccataattctaaccttgtcgcttttcattagttttacaagggtggttttcagtccctaaacaaggagggggttagttttgggaaagggctattatcatccttgctttaaaattaaactgtaaactaaattcctcccatagttaggttggcctatatccagaagagttagcttgggaggttagaagcagaatggagtgagctattttgctgactagctttctgtcattgtcataatttttagaaaggtggtctcactcttagtaaacagtagtatgctatgctttactcagttgtataatttcatttgaattcaacaaataactacagacagctgtcaacttagtgatgttgagattggggctaggcctgcagtaatcctctgaaatatgtatgtgcaccccaaaaacatgtcattgagatgggtagacacctgcaagaggagtgcttttaaaacgtttttacatgaagatgctttctacttcagtgagacttttgccagtggtgttagaagttgctgtgaaaaccaagataaggagccactgtgtttttgatttgttctagggatttaatatccctcatagttaatcactcaggcaattactgggttaacaatatgtcctgaagaagagtagtttttgagccatgttctttgaatcactaagattcttcaaaactgctttagagtttcccatgaacatttggatcacattaaagcaggctcattatttccatcttcatgtccatgtaaatgaggttgagttcttcacttggttctcagctttagtgttgttagtatatagaaatgcacctgattttttatgttaattttgtatcctgaagcttcattgcagtcgtttatcaggtctaggagtcttttgcaggaatcttttgggtttctctaagtataagagcatgtcactggggaccccaaaagtgaggaaggtgggagagaagtgagggttaaaaaattctctattgggtacaatgttcactatttatgtgatgtgttcactagaagcccaaaccttaccattatgcaatatacccatgtaacaaacctgtacacatactttctgaatctaatataaaataacaaagaaaaaaataacaaaaagtaggctcgttagtaagacaatagctgaggagccctgaggattggtcaccttctagcagagagaggaagggccaagctgatttacaacagtcctgatcaaagaagggtgacctgtccagggcaagtccacaagcctccccctctgtgtcatgaggccacagagcactggagttccatgaagtcaatggaaaagaagagttctactgcttaaacaagtttaaaaaccactgctctagcattgtttataagaaaagaaactaagaataaaaacaatactgaattcaaacagctaattccttaagacctgggaacattgtgtgttcttatgcagttataatttaatccaaatacattggaaccacaccataattcaattctaggtcaagagcagagttttgtatacagcagattcattttggagcactctctggggatttggttacagaaaaatccagaggatttatctgggctgtcttactcataaaactgcacaatggcctagattttagagatgacattacagtgaggtctcctccaggacatgctatggtatacaccactatacaccacttaatctttagagggctcatttgaatcacattatttatgtagtgtgtccacatgttagatttggccagattctcaaactggggtgtcagttccacgtctagcccattaatttgttgccattgtgaagacagtagacttgaatgccttcagaaggagcatgctgtactgcacaagtgcgaggggcctcattcctaaagtgatcacactgtgttttagggaattgtgcccctttacaatgctgtgactttgggtgacactctctagcttctatagtacccaagtctgggttgcgtctgaatttgaaatctctactatgagactgtattgtttgtttttaaagtcgatggagcacttgacttggagccagaagagaaagcttgggtcttcacgcttcttgattaattatcaagccagttaattttctagagcctctgtttattcatttgtcaaatgggacaaataatgtctgtttcacagggcttgttgtgaagattatactctgttgtgttatagaggtttaaagtggacctgtgggtttgtatgaaatacagcaaggtaacataaattaaaagtagatgagggataaaagcggggaaagggtctaaaatggggttaacaagttgtaccttttgtgcagatctatatgcttgctaggaatgagccacaaatttgcttctgtgccctctagcagccaaggagaaaatggaaaccttattttctttaatcatggtgtctacgagattgggaacacagtagggagtcatgaaaaatattccttttcctagtaacttaacagagagagaccaccctcaggggtctgcaaaagaggacattgcatggtacagcctatagtgtctgctacacagagaggttgcaaactggcagtccaccagtgtcaccatttgttgggatttttgttttgttttgtttaggcttgatgtctaaaaagtttgatccaacatttaaaagaatcagattttgcaaaaataacatttttaagttttctttcaaaatcagatgatcagttaatattgtaactatatatcaaaattaattggcactgtgtagcagcttttttttaatgtagcaatgatttcaggtttgccacagtctccaccattccctactgccttacttactacattttatttcctacttggcatttaggcatctgatttagtgactcctattctacagcatccttgtagtaggctcagcagtacgcttcataaggctgagaatccctgagaggattgattgatatgggaaaatgctggtactctgtacaatattgttctacaataaaaatgtagaattagaatattgaagttactgttagaactttgaaatcatgactgagggtttaaaaatgcttaatgagggccgggcgcggtggctcacgcctgtaatcccagcactttgggaggctgaggcgggtggatcacgaggtcaggagatcgacaccatcctggctaacatggtgaaacctcgtctctactaaaaatacaaaaaaaaaattagccaggcgcggtggcaggcgcctgtagtcccagctactcaggaggctgaggccggagaatggcgtgaacccgggaggcggagcttgcagtgagccgagatcgcgccactgcactccagcctgggtgacagagtgagactccgtctcaaaaaaaaaaaaaaaaaaaaagcttaatgaacgagagtctcaaatagctaattaaaacaacctcaacttccaaactaatctcctagcaagtagtttacccagagtatccattccaattgctctttaatcaaataaaaatttcagaatattttatttaaatatttacatagctatatattttcatcagaaaagagtatcacaggaaagacatgttttaagtatgcttttaactgtataaagtttgattgttaggctctatgatctggtgacaatagtcgttactgttagaggtgaatccttgtaaagttgttatttttgtcaaggtccactttggcttctagacttgttgagtttggtaagatgttttgagcgctgagttgctaattttccagaaatgtaatttgcaatgaagatgttggatggggctttcccaattatcagaaggaattctccaaagttgaaaatgagtgataattatctaatattctaaaacatgctgctagacatggatatagagtgtttaataaaagatgtcaaagttgtgttgtggccaccagccaccatcacagctctagccaacattagagatgactggtgatctaggaggagattgtggagggttatctcagtgaagagcctcataaagagtattggggaattttccctcccattgccgtggagagaagagatgagtgctcttaccctttccccaagccaagagagaagagctctgatctagagataggggttatggcaaccatgggagattggcatctcacttcccacttggatgcctgcggagctctctccaggcccatcagaatggagcacagcgatgattttagggatctgtgagcatatatacagatgcttccaacatacagtatttgatagatgcaaagttgctagagcagcctgtgaaagtgaggcaaagaaaaagatgttcagtggttgacaagctcaacttccaccatttggcagagaaagatgtgtacattttcgtggggccaagcaacatcaggaaaggtagagagtttgagcaattgttgctggttccttgtccagaggtggccttttgggttgaggcaacccagactgtgagaaccctgacatgtatgttgaagtagaagatgtgtgttttgggggaggggctcacaaaaggctggtcaaatggttcttccaccatgctagggaacttggaatagagggtccatgtgggcctctgaagaacctacaaatgcaccctgtgaaggtcccaggatgtgactgcctgccttgcacagctgactttggtagccaagagaattgaaaacagcacgacctgatgtaagaagatgttccgtttcctcaccactgatgtcacttccctgtgttaacctgagaagagctacggcacagagtgatggaggagagaatgaaagcagaggaggagggtaaaaggaaaggctacagtcccttccccactacaggtcatacaaaaggaggagggaaaagctttgagttggatatgagattgaagttttgatacgaaattactatacttttagtaagtgagtgagtcttagtttccataaataaggctattataagtgaaagtgatggaaaaatgatggggtcttcctgagctgtccagctgcagggaatggagatccactggaacaagtcaaagataataataatgagaaaaaaaaagattcttaaatccccaccattcaatgaaccagttaccaaacccacacgatacagagacattgagattccaatatgaatctctccacagaaggaggcaccttctcttgccatcttctgtgtattataaccatttttgggggggtttggtgcttcttgttcaaaattgaagtcttgtagccaaaagtcaaaatcatattcttctaaaattcacttgaaaaatatttccttttacagttgaattaaagcaaattacttggttaattaatgtcaaaggtgactctgttctagagataatttctgagtcatgatacctaatatttaaaaattatgttttgatttttatctttagtcatggtgatttcaaatgaggttattaaatcactgtaattcatgatttatataaaatatgaagacattaacctacaacatcttggattgctttttttttttaattgcattagtcactagtaccttctaacagttccagtttttggaaggcagcctctagtttcctattcagcctcatcatagctgttccttttggagagcggtggagaatacaggattgaaggtgaccctcacagcatgacaaattgtcaatctggctccctcagaaaccttatagggagtgtattagtcagctttggctgtcgtaagcaagtaccacagactgggtggcttaaacagcagaagtttattttctcacagttctggaggctggaaagtccaagatcaaggtggaggcctctcttcctggtttgcagaatcccaccttctcactgtgtcctcacgtggcctcttttctgtgcacttaagggagggagagagacagctgtctggcgtctcttcctcttcttctaaagacaccaatgctacctattagggcccatctcttatgaccatagttaacttccctaaagggcctatctctacatatattcacattggggattaaggtttcaacatataaatttgggggcctggggagaacacagttcagtccataacagagaggaagaaagagattcttaaaaagtgttctcttctgcaagttgacatttctgaaaaatatgtttattctccaaatttaagagacttttagaaccaattacctgtgaaattttcttttccaaatgaccgaaactcaactcaaactagctgaagcaaaagtggatattttttggctcacatagcagatggccaagggtcagatatgtcagccacagctggatccagggtcgatgtcatcaggtctttgtcctccccttgagctctgtgtccccccatgttggcccctcctcaggagggtccttttcctgtggtggcattgattacctggggcagctccaggctgatctggcccttagaatttgcagctttaaatggagagaaactgtctcccaagagtcaactctgactgcccccgcctgggttagggatacatattagcagcctggacccagggcctatctgggtggttatgggctggcattcccaacagctgggagaggaccaaatgaaagattccaggcagatcaaactgtaaggcatgtccacagtcttccccttctaagtttctgagctaaaacaacttatttgtcctttgtgacttgtataattgtataattgatagtccagagaaggtccaaattagttcatctttatatgtgtaagagattctatctaaaggtcatcagaacctttttgaaagtcaactgatgtcatgttggcctttgctggtgtttctctgcagactctccggacgacccagccttgtcaccacctggagatttggctccagcctggctaaccacaggctgttgacatgatggctgtggtctctctgcactcctcctccaacctcccccttctctatcctcttatgcatacctattgttgtggtctaaatgtatgtgtcccccccaaattcatatgttaaagtcctagcccccaaagtactagtattagaaagtaggtcttttgggagctgattaggtcatggaggcagggccctcatgattgggattagtgcccttatcaaagaggcttgagagaggtctctcacccctttcaccatgtgaggacacagaagacaccatccatctgtgaaccaagaagtgagccctcaccagacaccaaatctgccagcatcttgatcttggacttcccagtctccagaactgtgagaaacgaatgtctgttgtttatcagccacccagttggtggtattttgttatagcagcccaaatggactaatacacctaatgtcacccatctcatgtgaatgtaggtgctcatctcttgcctgaaattcttggggtcaagtgtgttctggaactcagtttctaatttcagaaaggccatatcgtatacacactgtttactgacacccttagcagagtctgggacagcacccagaaatccatctcattaacatttctgcagagaaacacgtgaacattcatactacgtaggataaagaaaatcaatagtagccttatatcagttcaggtcaggttttgtcaccaaacacattacgagaaaggtttgttctcagggcttttcgtaatttcagaattgtaaacaagggatcccgaatttatattttcttgtatgcattaagtgctacctttgttggactctcagcagctaggactggtctccataaaatttaaaacttaagaaacattttaacttaaagcactttaagcagcactttccaaagtttaaagtatgtaagtaaatctgtgtgagtagataactataaagaacaaactttcagccaatatcttcactttgagtggttactggggggcaaagaattagaaagccactatgtataaaattaaacatttttatttgttcatttctttaaagtacaacttattttccgggagaggaaagtactctcaccaaagaagatttttacagagagaaatcaggtcaacttgaaacttgtttgcaactctctatttgtaacaacctttgtggggttttcataaaaggattttccaagtcttttgtcttcaagaacataaattagaggacactcttaccaggagtacatgcagtttaagtacccaaaaataagtttgtttaccacttagaatcatggagttcaagagaattttcaagtttgcaatcctgggtctctcccagggacattgagagggcagaatcgattctagttttgctaatgcgcctgccaactggtgtcaccatttcccatcacgatatctcagttatcccatctgtcagctctaagagtctttgatgtatttcaacataccatgctttcaggaacctctcggtaccacgttctggtgcttggcagctgtccaggatgaatttgatgtacctctccctgatgcctgccaggagggagttggaggaggggcttaaaggattttctggtaaatccaaatgatcacatatgagctgttatcaatgtgggagaatggaattaggggatagtcttctcattagaattgtgaaaattcaggatggtggaaatactcagtatgaagattttcaggttggctaagtgtatgtgaaatgtcctaatttgaaaaacactttggatttgattgaattagtggtgttaaattagtggggtgtggtgggcatggtgacacggtgctgggcatccttgcatacatgacggatcagaaaaccagcaatccaggcaactctgtggccaatgcggcattttgggtccaagccccttgaccctgtgtctctctccttgcttcatgggaaatcctgccacctggctcagacacaggcctgggggttaaatggagcatgtgctgccaggtactggtcagtgccctcaagggtggagaagacctcttgggaaccacagacaggctgtagggttgtcgtgtttgtctgtttttaagtgacaggctgcttgatctcatcccattagtagtgacgttgctagaggtagagcttgcaaccacccccttcccattaactctaccatcaccacctgccgctaactactgacggctacccaatggccacaaggcacataatattcacggagagccaaagtggcttgcctgtgtcattacagtagctctccttgttaagagtctcttaaccatttccctccttcccacaccccactcttcacacatacatgtacatccctacctgagctagagccctgcttccatccactttcctggccttccccaagctgcctgtgcaaagcctcccttttctgctccctcagcctccggtttcttcctttttctatacctttccccaacaatttcagcctttattaaccttttccttctctaactatcagtcctatcgcttttttgggggggggggcgggaggcaggtgggaggtgtacagctcctcatacttgctgttctgtttatgtatgctctatagcaaactatccccaaatctaacggcttaacacagtaaactgtttccctatcatcactcatgattttgtggatcgggaattccagccggactcagctgggaaattcttttgctcctcgctgtattgaagggggtcgctggatactttcactgggcagatgggtgaactggaggtgattaagatggcttcacatgcctggcgccttggtgggatggctggaaggcatgttcagctgggtgtgtccactggggcttccacacatggtggtctcaaagtagtcagacctctttcaggtagctggcttccacaagagtgagcatttctagagaaaggaagtgtaagtggccaagcctcctaagcctgggcccaggatcctctctgctgtattcggtggttgcacagttatgccgtcctcccagtttttacctagcccccacctctctgtgtgttacaacaaagtctgccaccactattaatcttccacacgtgcctcctccattctcgaatgttcttgaagattatattgctttctccaaacctaaactgtctcataagtttttggcgcttaagacaagtttcaagaaataagaattgaaaagtgttggaggaaagaaagtttccatctctaaccactttctcagaagggcatcagggtttttgcagcaatgtggggatacctcttctgatctcatagcttagggctctgaactaaactgatggccttttctagatttcttcctaggggtgtcaggttggaagtgctgagggactgctctttctccccagggctcagctgtgtcaaggctaagaccaggagtggttcccacagccaggctgggtgagggcaagtttatcctgcggtgcagcacctcagaccagggtctagccaatggtggcctgcaggctgaccccagtccaccacctgtgagcagccaccaccacctgtgtttatactacccatgagctaagcacgattgtcatattttgtttgtttgtttgtttgtttgtgaggcagagtcttgctctgttgcccaggctggaatgcagtggtgcaatctcagctcactgcaacctctgcctcactagttcaaatgatttctggctaatttttgtatttttagtagagatggggtttcaccatgttggccaggctggtctcaaactcctgacctcaagtgatccgcctgcctcagtctcccaaagtgctatgattataggcatgagccactgcacccagccaatttttatatgtttagatgattgggaaatagattttaaaaagaataatatttcatgatacataaaaattataatgacatgcaaatttcagtgtccataaataaagtttctttggaacacagtcatgctcattcgtgtacatggtagctgtggctgctttcacactgtgagagctgggttgagtagttgtgacagcaattattagatgacctgcaaaaccaaaaatacttgctatcttgctctttacagacaagtaacttttttgctgttcttgccaaagaccaaatgcatttttcaaagctggattccaggctcagagttacagcaaagagaacagaaagtatagctcatgattgggtgctgacaggacaagggagagagacgaaaaccattaggagcattagcaacaaatatattttttgccattccaactccatggagcaaatggcttcctaaaagccagcagagaaactaattacctgaactgggagaagaatgaaagactcattgttagaatattcctcagagctgaatcccttctttcagcctactgtattttagtgattcctaataaaagaaaaaaatgtatttttgtcctcacagccaattaatttctgctccaaagcatagaatatgattatttctgtcattattttagtttccagagtcattgatgagacagggaatgacacatacctattaacacactcgcacactcactcacacactcgtgtgggtacatgcatttccctagaagatgtactggaaggatctgactttactttcaggtgccttcatgtcctcgcaattattctacaaatggtttttaagatatttctattgtatttgttgaaattttcctgacattttgacttgtctagacgattattcttgcatccagcacattgtaggaaacactcatttgaaataccccactgtgcttccgggggagctcatctttctggagcatggcgggtccctcatgaggccctctttcgttaaccgaagaacaagctgcagtctgaatgtgagttgttaaaggtatggtattgggagttttctgttctcctgttttcccattctgtaatgttttctttctttctttccttcatttcatttcatttcatttcacttcatagcaacttttgaatgaaaacctccccacagggtttgacaggcaatgaaacttcctcccttgggaggtgtctcagcctgagggaaatggaacagcaccccacagaggattttcctcacttcctccctctctcctttacaaatcaatgttaaagagcctgcatggatgtggttagcaccatctctgccgcatgtgacttttcagtcattttcacccgaaataggatttcattcaccagttactataagctactcgtgccttctaatggactttgcagcagtgattcatccaccctgtgctgggagagagaaagagactttaggtgagaaagaatggttgggagaggggagacaggtaggcagaacagttgtggtaccatcccgccccataagacaataatgatattcagtgttaggcgctttataccaagaaatattccacctgacacattatcctggttgaatcttatgacacatctgcaaatagacattaccaaatacagagggggacttttaggttcagagaggttaagtgacttgcccagtaacacactgctggcaattcgacctgatctctctctttcttccgccttttccatttcagtcagtggcagtgccatctttccacctgcttctgtcaaatgtgttggtgtgatttgatttcttttctgtttctcttgtatcttttaatccagcaataaatccctgctggctctacttgtaagatatacccagaatctattacctccgcccccccaccacccaccttgctccaagcctccatcatctctctcctggagcactgtgatacccttcttcttggtcatcctgcccctgccctgacttccctaaagttgatgcccaacacacaggcagataaaccagatcagacttgtgactgttttcccattctttgggcaatcccattgcattccagataaaagcggaagtccttagagtactgcagtttgcctcctagcccacgttatctctggccttcctttctcactttctccctccattccagccacgttggcttcctgctgtctcttgaatagtcagggcctttgcccatgctactccctctgcttgaagcactcttatcccaggagactgcatgattgagacccttacctccttcatgtctttactgaaatgtttttacagtgaaacctatcttaaatttttttttttttttttttttttttttgagacagagtctctctctggagtgcagtggcacagtctcggctcactgcaacctctgcctcccgggctcaagggattctcctgcctcagcctcccaaatagctgggactacaggcacccaccaccatgcctgattaacttttgcatttttagtagagttggggtttcaccatgctagccaggctggtcttgaactcctgacctctagtgatctgcccaccttggccttcccaaagtgctgggattacaggtgtgagccactgcacccagcctttgtatagctttaatgcatcaaatatgggcttagttcctcatgtaaacaattctcccaggaaattagaggataaaaagttaaaaatagcatatatgtcctgccctcaggaagtttacgttttgaaggggggatacaacaaaaagctagaatttgtagcagcgtacaacacatgccaataaaacttgcaactcaagccctgtgcacagagaaccatttggcagaaattctagagaggcttcctggaggaggtgctagtagaggagaccttgacaaatggggatggatctagatcaaattcccctatgccacgtgctcctctttgcgttcagaatgctcttgtttgcaagatttcagccatgtacaactcttctggcactcagccatggactaaaacgaggttcatgcccacagtattggtctgcagaaaagcatgagactggatgacagtcagaacaaatggaatcctctagggtagggagaagagaaagaaagaggaaataaaacagcataatcccaggaactgccaataggaaaggatgggagaaaggacaactggcaaagactctgatgtggtgtccagcctttcagatgtcacctgaggacgttgctacaattaacatgcagccagacacacacagtgactacacattttggtgtggttggcggcattagttgagtcttaaacaaaagcaatttcagttgcaaatcttgtgccaggctttcagagaaagagaataaattatgctgctgtgacaagctgttccactgtggcaacaatagtttggacttccagtgctgcctgtcaaccaggactgaaaatacatcttcatttgttgctgggcagctgggaagatgagtcattaaagaattttataatacatcaaaggccatgattttctacctttcacgcagttacaccttttcccaagtcctcattctgccacaaaaaacttttgaatgcaccgaaagttaagtagaattccttttaaaatgttctgttctgtgcacatatctctaggggaagtgcagaagacatggggcattcccttttgtcatgcatttcagctccataaagatttattgaccacctactatatgccaagcattatgttagtcagtggggttaaaaagatgagcaaattgtggtcttgaaacccatgccttttgttcagattattacagtgcaagagaagcagcatcagccatgtgtctgagaggccagaggaaggagagagtgaggaaatattgtacctcattaatattgttcctctcgtttcaccactgtattaatctgttctcatgctgccaataaagacatacccaagactgggtaatttataaaggaaagaggtttaatggactctcagttccacatggctggggaggcctcacaatcatggcagaagttgagagaaaagcaaagggacgtcttacatggtggcaggcaagagagcttgtgcaggggaactcccatttataaaaccatcagctctcatgagacttattcgctaccatgagaacagtatggggaaaaccacccccatgattaacttacctcccactgagtccctccacgacacatgggaattatgggagctacaattcaagatgagatttgggtgggcacacagccaaaccatatcaaccactgtagacatgaccaagttcagacttggtcagtagtcaaatgagcctgtgagagaatggtgccacatctttcctgtaagagcacagcattttaacctgcgatggatttgtgagcagtcattccaactctgtattagttttctacagttgctgtaacaaattaccacaagcttaatggcttaaaaccatgtaaatatattatcccacagttctgaagtcagaaatctgaaatagataggctaaaagcaaggggtgacaggctgcattcctttctggaggctctaggggagaatctgtttccttgccttttccaacttctagaggccgctggcattccttggctctttgccccttcccttcttcaaagccagcagcagtagttgagtcctccttaacacagcatcactttttttttttttttttgccttcttcttccacttttaaggactctgtgatggcactggggccactgggataatcgaggataatcttcctattttaagaacagccaattgacaaccttaattctaagcaatcttaattcccttttgccatgtagctgaacatatccaagttctggggattaggatgtggatgtattggggtggggaaattattcttcctaccaccaaccctcatccatctctaaaggcactgatttttttgataaatcagataagtaccagagatgtgtactctgggctcaggagtgaagagggttagctggcctttgccaacagtgacttcatatcaccatactcaatgcaattgaggtgacttaatcaaggggaaaagatggacagcatgttttatggaaatagcacttgcctggtaatcaggagacttggattttagcttctctccttcaaacagactactgagtgtcagtaggcaagttgttgaactgctctgggcctctgtaaaaaatcaaggttgtggttagatgttctcaaatcctctttcatcctctagccttccatggctctcaatttctacagggaatgtactggaaatggagagaggctagcctgtggaaaatgcagtgccattatttcagcatcaaaatcctgaaataagatacagaatgttgtgtaatatacagctcggtgtctgtgcccttttatttctctcttgggcccagccccatcatcctgtccttgatcattgtaatgcagtgttcactaccagtcttttctccccctacattggaaattatgccaaaagagtaatgaatgaattaggtaaatgaattagatgaattagagataaaattatggctctacagttgaaatatcagctttaagagaatcgacttggagaccaggtgcaatggctcacgcctgtaatcccaacacttagggaggccaaggcgggtggatcacctgatgtcaggaatttgagaccagcctggccaacatggcaaaaccccatctctactaaaaatacaaaaaattagcagggcgtggtggcaggtgcctgtaatcccagctacttgggaagctgaggcgggagaatctcttgaacctgggaagctgaggttgcagtgagtggaggttgcagtgagctgaggccgtgccattgcactccagcctcggctacaagggcaaaactccatctcaaaaaaaaaaagaaagaaagaaaattgacttggagatgtacgggttcacatataattgaaagtgagcattccacagtgacttgagaaagttgattccggctttcaaagcttgcattatgggtaagaaacttgagcctaaaaagaacttatatgtatgtgggtcattagacaatctcctccctcaccacctttttttttctttaatcaaagaattatacatatgcaagtaactgaatcacctcttctttcatttttttccctctttaatcacagctgtgtggaaagtttccagctaggcattaaattgggtcaacagctaacacagcataagtgtggacagcaggggcaatcggtggtatatacataggaaataaacgacactgtgctgctggcattgataagctgttgaatagtgcaagggccctattaagatttaaagtaataaaagatgggaggaaatatggttaccagcagctgataaacattcttgccttatgaaggcattagtttcacttaatggcttctagtgcctggagtataagctcttgtaatttttctcccccagagcagactgaaagaatacctaggaattgtcatctttgtagttgctcaagaaagatctttgggtggctgtgagcagatctgaaaatagtaagtatggcaggtacatggagctgcatccgtttgcaaaagctatcaataaagaaaggtatagaaaggatgcccttgaccccggtatgtgcagatagaagtggaatttcctccggaatgtgcatgcaaatgtgcctagctgcaaaagaagaggcattccctgctcaggtgtgtagagtgatttagaaccatttgtttctgctcaatggttctcaaatgaacagtatttcctcactaggaaacagtgctaattccaggctaggacggtccacagagatggtggctgtgcccagatcattcttggaaatctgaggaagggagtcatttcttctcatgccacacccagtaaggggtacattagatactctatttcctccaggcagatctacagtgaccaggaccacgtactaggataggagaggttctggcactattcatcattggctccggaaatagctttcccctctgagctcaaaggtaggctcatcctctgctagagtctattaggtctggtgggattggaactcaggtgcatacccctgggctctccaaccactagtgctgcatccagggcttggggtcctgctttgtgccatcaggtcatcagtgacatgactagggcagctcaacccgcacctctggcatcactgccttcctcccatggccccctagcatgaacccaaagaccacagggccggttccctccttcaggcccaaggctgggcctccaaataatggcctcccaaagatgcccacattcacatgcccagaacctgtgcatatgttaccttatgtggcaaaagagactttgaaaatgtgagtgaattacaatatggagattggcctgggttatctgggtggactcaaagtaatcaataagagggtgacaggagggtcagagtcagagaagaagttgtaatgatagaggcagggagccatgaaccaaacagtgtagacagcctctagagactagaccaagcaaggaagtggattctctcccagggacttcagaaggacctcacccctgccaactcatccgaggacttctgacctccaaaagtataaaataatacatttgtgctgctttaagtcactgagtttgtgataatttgttataacagcagacagaaactaatacagtttatcttattcctttactcatgatcaactactttggggttaacgaacaacagtatatttacttccttcaatgaaacacttacctccacccaccagagtgaaagtttgtcaccctggttccaacaaatgccacaaaccactgtatgatcatctttgggtaggtcagcttgtctgctatggtatttttcttttatattgcagtttacaaagtgctcatttgtcttgtatgatagttatatatggaaggtagcattactatttcacttttctgattttctaaaaaatatctttaatgaacacatattaattttgtgattaaatgacacaataattagaaatgttaaaaggagatggcagttttagtcacttaataaccataatactaacaaattcaggccacatgctatctcagtggatagtccccagaaccaagttaggctagttcatgaggcatttcagatagctgaagggactaagtatacactggaagattgggtacgaagatcaaaagacagctctacaacaaagcttcatgggccattggtttcacagtagggggaactgaaatccaggctacagattcaaaagcttacaacctggcaatttatgtagcatagggaatcaatgtctatagtcttaattacatagaggctaaagcctcaattattctatttctgtaggcaggattcctacataatctatagcatctattggcataaaacattcttagtggccattctgggtacaagcatcccatttctctttctgtccttccacacactaccagtgtctctcgcttatttcctcccaactctaatgttcatatgtgggttatttgagcttctaagttaattccttgcctatatgtaaggaacatattggaaaattataaccaaagtgtagtatatattgcagagtctctacttcccatgagcagctttggagggtacctcacaggagagggttagctggcatctttccattaggaagccagcatcagcacaaggggaaaacttctctccaacgtctagacctctctatcccatgagactttggggactgggactgggtagcagggcagaattgggggaaggaggcacttaagagctttttaatttcaatattctaaccattagtgagggtgtgctgctgggtacatgtctgcccataaataaacatggactgttcattgaaacttgcatttttatgtagaaaagctcatgctaccttatcactttttgcacaaaagttgacacattatgaatgctttaaaaaaaaaattataccttactcccatacactgaacatatctttcctcatctaaaactatccaagcagccaactttttaaaattaatggaaggagagggtctacagcatgtattctcaatgggggcaatgtagccccctaagggagccaaaattggttctgggttgggagtggtgaaaaaagtctttaaaaaaataaattgcagaatatacatgcagcacatagattgatatatatatctgtgatattaaaatttcatatggaggtagttgggaaaaaatgtctaaaaaacctccttagggtgatatttgatatggttttgctgtgtccccacccaactctcatcttgaattgtagctcccataattcccatgtgtggtgggagggacctggtgggagataattgaatcatgggggtggtttcccccatactgttttcgtggtagtgaataagtctcatgagatctgatggttttataagggatttctgctttcacttctcattttccttcttgcctattgccatgtaagatattccttgctcttccaccatgattgtcaggcctccccagccctgtagaactgtgagtcaatcaaaactcttttttctttaataaattacccagtctcagatatgtctttattagcaacatgagaagagactaatacaatattgaaaaaaaaaaagttgagaaacactgatctatagtaaaatttaaatatccaacttctactatttttttggctgtccattcccagtagaatacaagttccatgaaggcagggatatttgtcttttttgtgcactgatttctcctaagtgcctagaatggtgcctgggatgtaggaggtattcaatccatacatattgaattgaatgcatgaatgaacaacttccctcagtgtcccagagtccactttctctcaacactgcaagtggtggcaagctggaaggtttgtgagcagtgctggagctgggctcttccaggtgcattcacaatagtttaaaatagcaggtgcatcagaggaggcctctttgttcctggtactatgctcattgatgtttactatgagccccttgcagactcaagcatccattgtttgccttttaaatatctctactagccgggtgcggtggctcacgcctgtaatcccagcactttgggaggccgaagcgggcggatcatgaggtcaggagatcgagaccatcctggccaacatggtgaaactccctgtctactaaaaatacaaaaaatgagctgggagtggtggcacgtgcctgtaatcccatctcctcaggaggctgaggcagaagaattgcttgaactagggcatcaaaagttgcagtgagccgagatagcaccattgcattccagcctggtgacagagagcgactccatctaaaaaataaaaaaaaaaaattttaaatttaaaaatctctactctccaggccaggtgcagtgagtggctcctgcctataatcctagcactttgggaggccgaggcagtcagattgcttgagttcaggtgtttgagaccagcctggtcgacatggtgaaaccccgtctctaccaaaaatacaaaaattagctagacttggtggtatgcacctgtagtcccagctatttgggaggctgaggcaggagaatctcttgaacccagaaagtggaagttgcagtgagcaaagatcatgccactgcactccagcctggacgacaacgagactatgtctcaaaataataaaataaaataaaataaaaatcctctactgtctacttcccccacccctaatatcctagctatgtggcccaagtacttatttagcccagtccatgaaagtaaaggacagtggacagtgtcctttgataggaggatggggcagaatgggaaaagaaaatggtagggtctggaggtacaagtgggggccagagagaggggctttacagattattcgggtgtttgaaagtcagttggtgttatctttaacatacaaacatgtattatgaatctctgagcatccttcaacgattcctgaattttcaaaacagttgtgtccaaatgacacaccttgtccagaaacaatttggttttgatagaaaaagaggcaaaataaaaacactgatttacaggctcatggtgaggggtttggggaggcagatgagaagagaacctagaaaggatgtcaagagcagacttagctgacctcactttgctttgggcttgctttcctacagacattgacagtgagagttgtttttgctcaccacactgggaatatgtattgcttaggagacacatggcagttaaggcaaacagcacatgccaacaatatgttgcatgatttgatgcctgttttcagggaacttcactaggaagtgtgtgtgtgggtttatatagccacgtacatacatatacatttatatatgttttatatacttagaaataaatacggaatttgttacaggaacgtggccttacacaatcatgggagctggtctgccatcttcattaagccattgtctggtacagatgctggagtttgaagtctgtaggataggaaatcagatgttgtctcagttggcacctgctgcataatacggtaccatagactaggtggcttaaacaacacacatttattctctcatacttccagaggctggaagtccaaaatcagtgtcttgcagggttcggtttctggtgattccccacttcctggctgtgggcagtgccctcttgttgtgtgctcacgtgacctcttctttgtgcacatgtggagagaacaggctctccagtgtcttcacttataaggacactcatcctatccgattgagaccctaccttatcatcgcttaaccttaattacttctgtaaagggcgctatctccaaggacagttatattgggattggggctttaacataagaattttgcagggacatgaattgcagtccatgacagatgtaaactttgagaaacaggaaaaagctggaacctacaagcagaagtgggaacctgtgaggttggactgaaactcagatcagttcttgctgcctctgaccttgatgtatgtatcctggaggagatgctggcatctctcatcatggagctaattgtaggacaggcccagaaatggaagaagctggaagagagtctagtggaaggtggggcagcgtgggcccagctgctgttgcctgccaaagaggtgagcagcagataagtgacgaggtatgtgagctcacacacccaatccactgtggcacttctgccttccagatcctccataagaaggtctctttggcctactctgctcagaaatatataaggcaggagattctgagaaatctagttgagtccagccacgttgacatgctacaaagccaccacagactctaaggagaaattatgtccagggttgggagaagagagccattagctgtacttggatgaacagttagtggcctagaaactgatctagaaagggatctctgttgatgaaaaaggacagtggtgtaaataaaggaagagtgatttggcgatggggtgttggttcagagttaaagacatgagaatgacaaagaaaggacaagggtggcaattgagatagatgcctttattaagtatagggtatagaagtgtagaatagagaagacaaagaaaagcaaaagaactgaatagctagaatgtattaatgcagggcatcaggcatgtggagccagctaaaaagtgagagatcaaacaagattcttagagcaagagaacatcagtaggaactagccacatttatttcacggactcaatgatactgagtttctactactacagggtactgtgtttgatgcacataaaaattattaacatgtattcctgcttatcattattggaggcaggggttgtgaagtcagcatggtccccaccgccacgcccccaccccaggccaaactctaaaggtatttacctgggttttctttcgaaaaaggaagaggtcttattttttttttttatgggagctgagggcagtggataaatttggaaccagacagttgaagtattaccataagcatcagaaaaagtgaataggtttttaaaataatagggaatagagatagaaagcaatcaacaaggcttgttttagaattaaaactctacaaagtaaaagatgtagcctgaatgacccttgaaatcacatgtataatttatagcacctgattccctccaagtcatggtacagaaaatgtatgtctcagctgtgccatgctggccaatctggtctagcctcaggcttgtcacatatgaagtggtgatgacatatttatatcacagaacaattgtgaaaaacaacggctaatgtagttactcaacaaatgtagtgtgcactaaccttatgctaggcactattcccggcactagggacacagaaatgaagagagaaacaatgtcctcattctcgtggaacttgcaaggtagtcagaagagacattttattatttaatctctcactgtctaatatcatagaaatcatacattcacattcatccagagagatagttattattacctttttcacatgctgaaacagaggttacttgtctgagacctcttgctatcaagtgttaaaggtgagactgagtccaggtcttatatgactccatatgcccagcactcttcaaacggccaaatgcctcgtcccacagaaaatagaagcccacagtcctcatatactataaaacttaaatagaatacattatctcatgtggacagatggttatgactttataaactaggaaatcctatgtaggcagatgtttagttgatgaaaagaagtgtaaacatgaccctaatgaatacatgttctgcaagttattggttgctattaatacagagatagttatgctgtattaacggacaaataaggcatatgtagcaagctaaaaagtgagaagtgaaacaagattctttttttttttttttttttttggagacatagtctcgctctgtcatccaggctggggtgcaatggtgcaatctcagctcactgtagcctccgcctcccaggttccagtgattctcctgcctcagcctcctgagtagctgggattacaggtacctgccaccatgcccagctaatttttgtatttttagtagagctggggtttctccatgttggccaggctggtcttgaactgctgacctcaggtgatccgcctacctcggcctcccaaagtgctgggattacaggaatgagccaccatgcctggcctgaaacaattttcttaaggcaagagaaaccactgggaactagccacatgtatttcatgacttcaaatgatactgagtttctactactagaggaatacatgcaatagaggaaataaaagggggtgatgggatcgagtgatggaggagaagatctctttagactggttggtgagggaaggcctctgtgaggagactattgagatatacctgaggaatgggaaggaggcagatctctgaaaatctggaggaagccctttctaggagaaggaacacacaagcaaaggccctaaggcaagaatgagcttggtgtccttggggaacaaaatgaagatcagagtggctggaggttgctgagcaaatgggacctggttaattcatgcatctggaaaggtagaaaggagctagatcctgcaagtccttgcaggccacagtaaggaatctgaattttgttaatatataagacacaaggtattggaagacacaaagtcatcggaagattttaagcgagagtgacaggccattggtattttttaaaaaatcactgtggctgctataaaactatcacttatggagcaactgtaggctttttgctctttttaaagattattgtgcattggatcattcatggatgccagacttgaaatgaacaagatggggaataatggggaacttctggaatatcagtaaaaataaagaagctgctaggatcctggctacagtgtgaacccttgagttgtggcagccgtgagagatggatgtgatggctgtttggtcctgcgagtcacttttctctatcaaatatacttgaccttcatgtgaccctttccatctctttgtgaccaagtaccaagtgataagcgttaattaatttttgggtcactgtgacagatcatcagtgtgctacacttttcaggtaacaggtttccgtgaaccatttgcaatgcccaaattataagaaatcccttaatatctgactctaacagagttgcagtttccaagtctatagcatcccactaacagaggggttggaagacaagatggagccacaaaggtagcagtggcaacccgtccacccctgcttaatgctactcctggtttaagacatgagcccaatttctctttagctggtaggatgacagaaaaagttttaacagcttttttgaggcataattgatattaaaaaggacacatatttcatgtgtacattttgatgagtttggacatatgcaattacctgtgaaactatcatcacaatccagggaataaacatgcctgtcacctccagaagtttccttgtgcccccttgttgtttttgtttgtttgtgtggtagaacacttaacatgatatccaccttcttaacaaattttttaagcgcacaatacagtattgttaattatagggactgtgttgtacaacagatctgtagaactcattcacctttcataactgaaaccttctacttgttcagtaataactccctatctctccctacccccagcccctggcaaccacgattctactctctgcttctatggttttgactattttacaatcctcatataagtgtgaccatgtagtatttgtccttctgtgactggcttatttcacttagcatagtgtcctccaagcttatctatattgtcacgtatttcagaatttccttttttaaggctgaataatattccactgtgtgtatagactatattttctttattctttcatccatcaatgagacacttaggttgtttctatatcttgactattgtgaagaatgctgcaatgaacttgggcgtgcaaatatctcttcaagatcctgatttcagttattttggctatatacccagaagtgggatcactggatcatatgatagtgctatttttaatgtttttaggaatctctgagatggtttggctgtgtccccacccaaacctcatcttgaattgtagctcccctaattcccacaagtagtgggagggacccagtgggagataattgattcatggggatggtttccccatactgttctcatggtagtgaataaatatcatgagatctgatagttttataagaggttttccctttcccttggctctcactctctcttgtctgccaccatgtaagacatgccttttgccttccaccatgattgtgaggcaccccacccccagccatgtggaactgtgtgtccattaaacttctttttctttataaattacccagtctcaggtgtgtctttatcagcagcatgagaatggactaatacagtaaattggcactgcgagggtagggagctattgtaaagatacctgaaaatgtaaaagcaactttgaaaccaagtaacagggagaggctggaagagtttggagggctcagaagaagacaggaaaatgtgggaaagtttggaacttcctagagacttgttgaatggctttgaccaaaatgctgatagtgatatgaaaaatgaagtccagattgaggtgttctcagatggagatgaggaacttgttaggaactggagtaaaagtgactcttgctatgttttagcaaagagactggtggcattttgtccttgccctagagatttgtggaactttgaacttgagggagatgatttagggtatctggcagaagaaattgctaagcagcaaaccattcaagatgtgagtttggtgctgttaaaagcattcagttttgaaagggaaacagagcataaaagttcagaaaatttgcagcctgatgacgcagtagaaaaacccattttctgaggagaaattcaagccggctgcagagatttgcaaaagtaacaaggaaccaaatgttaatcaccaaggcaatggggaaaatgtctccagggcatgtcagataactttgctcccattacaggcccagaggcctaggaggaaaaaatggcccccccacctgctatgtgcagcttagggacttggtgcccggcatcctagccattttagccatggctaaaaggggccaaggtatagctggggccatggcttcagaaggtgcaagccccaagacttggcagcttccacgtgggcacacagaagttaagaattgagttttgggaacttctgcctagatttcagaggatatatggaaactcctggatgtccaggcagaagctttctgtaggggtggggccctcatggagaaccctttgctagggcagtgcagaaggaaaatgtgggattgaagcccccacacagagtccccacaggggcactgcctagggaagttgtcagaagagggccaccatcttccagaccccagaatggtagatccactaacagcttgtatcgtatgcctggaaaagccacaaacactcaaagccagccctgaaagaagctgggaggtaggctgtaccctgcaaagccacaagggtggggctgcccataggaacccacctcttgcatcggcgtgacctgaatgtgagacacagagtcaaaggagatcattttcaagctttaagatttcactgccctgctggattttggacttggatgggacctttagccccctcattttggccaatttctcccatttgggatgggtatatctatccaacgcctgtacccccattgtatctaggaagtaactaacttgcttttgattttacaggctcataggcagaagggacttaccttgtctcagatgagactttggactgtggacttttgagttaatcctgaaatgagttaagactttgggggactatagtgagggcatggttggctttgaaatgtaaggacatgagatttgggaggggccgggggcagaatgatatggtttggctgtgtccccacccaaatctcatcttgaattgtagctcccgtagttcccacatgttgtgggaaggacctggtgggagataattgaatcatgggggcagttcctccatactgttctcatggtagtgaataagtctcatgggatctaatggttttatatgggttttctctttcacttggttctcattctctcgtctgccaccatgtaagatgtcctttttgccttccaccgtcatcatgtggaactgtgagtccattaaacctctttttccttataaattacccagtcttgtgtatgtctttatcagcagcatgaaaatggactaatccaatctccatactgctttccatagcagctacaacattttacattttacatttccactaacagtgtacaagggttccagtttctttacatccttgccagcacttgtctttttgataatagtcatcctaacaggtgtgaggtgatatctcattgtatttttgatgtgcatttctctcatgattggcaatgttgaccaacttttcatatacttgttggccatttttatgtcattttttgagaaatgcctgttcaagtcatttgcccatttttaaatttgtttattttcttgccattgagttgtagtaggagttccttatatctcttaggtattaaacccttgtcagatatgtggtttgtgaatattttatcccatttcataggctgccttttcactctgttgattgtttcctttgctgcacagagctttttaatttgatgtagtcccacttgcctatttttgcttttgttgcctatgtttttggtgtcacatccaagaaatcattgcagagaccaatatcataaagttttgccccatgttttattctaggaattttatagtttcaggtcttacatttaagtctttaacttactttgagttgatttttatatggtataaagtaagcattcaatttcattcttttgcatataagtattcattttttgcagcataatttatcaagggactaacctttctccattgtatattcttggcacgcttgttgaagatcagttgactgtatatgcatgaatttattgctccactgtctcttctgttccattgatctatatgtctgtctttacgccagtaacatactattttgattactctaggttcgttatatattttgaaatcaggaagtgtgatgcatccatttttgttcttctttctcaagattgctttggctttttggggtcttttgtggttccatgagaattttagtattttttttttctatttctgtaaaaaatgcccttgggattttgatggggaaagcatggagcctgtagatcactttgggtagtatagatattttagcaatattgtcttctagtccacaaacacagggtatctttccattttttatgttttctttaatttatttcattgatgttgcctcagtttcagtgaataatcttaaaccttcttggttaagtttatcctaggtattttattctttttgctgctattggaaataggacccctcccctcccctccccttccctcccttctttcactctgttgcccaggctggagtgcagtggcacaatctcggctcactgcaatctccacctctcaggttcaagcaattcttctgcctcagcctcccaagtagctgggattataggcatgtgccaccacacttgcctaatttttgtgtttttagtagagacggggtttcaccatgttggccaggctggtctcaaactcctgacctcaggtgatccacccaccttggcctcccaaagtgctggcctcccaggtgcaaactaccacacctgaccaggattgttttcttaatttccttttcagatagttcagtcttagtacagggaaatgcaactaatttttgtatgttgattttgtttcctgatatttcactgaatttatttattagttctaacagtttttgtgttgagtctttagggtttactgcatataatatcatgtcatctgcaaacagagatattcttacttctttctttcctgtttggatttctttttcttgcctaattgctcggattaggactttcagtagtatgttgaaagtaagtggtgacagtgggcatcattatcttattcttgatcttagaagaaaagcttttatttttcgttagtataatgttaactgcgggattgtcatatgtgaccttttttatttttatttatttttttgagacagagtctcactctgtcacccaggctggagtgcagtggcgtgatctagacttactgcagcctccgcctccccagttcaagtgattctcctgcctcagcctcccaagtagctgggactataggcatgtgccaccatgcctggctaattttttgtatttttagtagagacggagtttcaccatgttggccaggctggtctcaaactcccgacctcaggtgatctgcccgccttggcctcccaaagtgttgggattacaggcatgagccaccacgcccagccaacttttttatattgaggtaaattccttctatacctagtttgttgagagttttatcttggaaggtcagatgctttctctgcatctattgagatgattgtgtgatttttgtccttcattctgttaatgtatattatatcaattgatttgcatatgtcaaactatcatcagatcccagaaataaatcccacttggtcatggtgtatggtacttttaatgtgctatggaattctgttttctagataggtgagactttttacatctatgttcatcagggatattcgcctatagttttcttttcttgtagtgtctttgttttgactttggtgtcaaggtaatactggccttataaaatgagtttggaagtgctttctctccttcagttatttttttaagactttgggaaggattggtgttttaaaaaaatatttggtagaatttgccagtgaatccataatggaaatattgtatataggtaatttagtaagtcaagaattgtccctcaaaaggtactagaaaactcagttcttacttttaagactcttctaattatcctggtggaatggcttctggaatatcaccataatactgaaatttactccataatactactgaatggaagggatccagtgctggaaactttacatttgaccaggtgcagccctcaatactaggacagtttggctagggggctacccccacaggtagcagggaagaaggctgcattggtttgactgggatggaagaagaataagctaagtagtctgtcagagtttgccaggttaaagaggaaagatgatagcacaggctggagggaggtcaaagtcacattctggggaaactagatgtatgttgaccagtaggggcaagcctagtatggaatggtgggtgacagtgaacattgagggccaatgagatttagagaatgaattgaggagtgaggcttaggggaaagaaggccgggcacattagaaggctcagaggtctaagaagcatgaggaagattgtcctccagagagctgtccccttgaaggaggtgcgttggcatgatcttgtcatgaatttctcaccctgtcagaaacatcttatgtagattttttaaagggcaacagttttcctgctcactctgagtacctgaaccttgattctaagacttaggtaaggttcacttggcctggatgtttataaatgccagtaccaaggggagtccttgaaatggcatagaagatggcaaagggctctgcagagccacgaaacccaaatttagaaatgagaattactaacaatgcatatacaacatgtctacaataaactagaaaggatgatatagtttctgataacagtctttgaactttccctacctatgaaatggtattaacccttaatcagcagctcaggaaatagtccacggtagatcctcatctttgtatttcctttactgtctggttacttactgaaaagtggtagctgaggccgtatctcctaacctgcatgctctccctctctattttctttgtctcccatgttctccctacaaagttagcattcattcattcattcttattttctttctttctctctctctctctctctcactctctctccccctccccgttttcctgtggtattgaaagcttattgtcaggatgagccccttattgcttggaacccaatctgtgtccatgaattgcccatttcacagaatcacgaaagccacgctgcttcctgagcaacacagctaagtggcattccccacccctgctcttagcaaaagttcctcaggacattattgttgaattactcaatgcctattatcatagaacctcatgttcacgctgggaggtagttactactacctttttcaaatgctgaaacacaggttacctgcccgatacctctctgctatcaaatgtcaaaggtgaaattcagcccaggtcttctgactctacatccagcattctttatagagctaaatctctcttcccacagaagatagaagcccacagttctcacatacttacaaaacttaaatagagtacattatctcatgtggacaggtggttatgactttataaactaagaaaatctaggcagatgtttagtcaatgtcaagaagtgtaaacatgaccctaattaatggatttgctgaaagttattggtctctccttgtcagaactgttgttttccctgtcacttctcagattggattagaaaaaattaagcatgaagaaaattggcatttaaaatgtgtttattcttcactatcaagacagatagaactttccattcaaaagagaatgaaaagttcattttggcatggtgaatcataaataagaaaaacagaatagagaaatcctaggacgatcaatctctcataaaataaagaaatcgagattttatcgcaaagaattctgcagcacataaaggcccttaggactggactgatctccgagttcaagcgttacacccagtatgctgcataaaccctattcagtgtttgggctcattctcaagaggttgacatccttcccattttcatatcacctccctggtccacctttgctaggtcacaggtttttcaggcactttgcattctgccctccctcctctcaaaagacttcccggcatgttttcgatagcttcacacctagcagatggcagtttttcttctgaccttctgccagccctcttccttcctcagcttccttcctctccacagcttccatttaaggtattttggaagtccctcgaaatgggtccttggtgagtaaacccctttattgagtctcggactttaagaagttcttggcttcatgggacccccttcttctagttgacacttttggggattgatttcaagaatcatctgttgctgataagtcagtgtggcttctattgctgcagaagcaaggaagaaactaggcatatagtggaagaaaatgcgcttaattagaaactggtcctcattagggattcttaaaggaagtgctcaatttgcacctatgttagcagagcctcacacggattaattaaaagctgctactctcaccagcaacacccttcatggctgggttgaattgtttgtagctgtcaactctgtgccaagggcaacaaggtttgaatctgagttctttgaaatgcaggttctttcactcactatgcagaatctagggatccagactctcaagaggcaaagctctggaagaacaggtggagtgagtatccctctggcttctgctcccgccagatgatcaccatgcctctcaactctacactcttttccctgcctgtgctccagttcacactctccacatccctggggccaggctatacctagatccttctgcttgatctctcaggctccgatgtttcaactcgtcattccctaggctattaacttcaagcccttagatggcattcaagctccttggtgacctctctgcgtccgtctccatccccatctgcttccgtgagcttcataggcaagccactctccatagttatatgtccctcaaatacccagcatccccatgccatcatttcaaccagactgtcctttttcttttcccacctaaggaaattctattagttcttcatggctgggttcaaatccacctccttcactctccaggaagactacattattcttttcctaacactcctgaagtgcttgtcctctacagcattgctgcacatattttgttctgttctttattacactagtccatatggctttactccctgctgaatttaaactcttcaagggcttgatctctgtcttattcatctctgtaacctcacagtacctaatcaagttctttgaacaaagccagtgttgaaaagtgtttgttgaattgagaacagcaagccagactttctgatgggctagaaagatatacctagaaagatagagcagagtagcatttctaaagatggaaaggacaagcctggctaaaatcatgctcaaagaaaggttttcttttagggtcctcatcacatcacaatagcaaatttttaaaaaaagaaagggccgagcacgtcagtatagttaccgagcgtacttgtgtactgggcaaagtactgagcgcaatagaaagttactaaaagaaagaacagatgctttttctcctttagagctggtcccttttcaaaataaggcctcaaagtgcatcccattattaaccctgaaatagtgggacacaaacgtccagatagatatgtgcatgccaatacgtgtttaaaaatctggcgtcacacagcacactccagaggaagccaagcctaagagacatgaacacagtaacacggtagggagccgtgtgatccagactgtcctaagcagaagaggccccgggtggagaattctcacactgacagccgcagagcctgccttccccagtgtactggttttcccagggcatcaaacattttatttaataagctacatgtttgagtcacaagcgtagacttgacacccctgtatggtcaactccagctgtcgtttgttctcctcccctctcttctggcacagtggctggaacctgtatctggtgtatcacaacgctccatttcgctgatcacacacagccagaagtgacagtcgcttctctcactgccaaggacagaggagactctggctggacaggagaaattcaggtcgaaccaaggcaagtgaacgatggaattaaaaacggctgagaaatcccatagacttagaattactcatatctgcagactagagggaaatgagttggtcctgatgacaaaacaaccctttcttttctctagtctgttaaacttctattttcccgtcagactgttttaacaatgccctctactgggtattttcaaaactgcagggttctgcaggcctgacctgctcttgttctccttgagtaattctttctgcaagatgaactgaacccaaagttttcttcacataagcaagatgttactgatgtatagtttcttaagagcataaaaagtggaccagtgcatcccctggaaggagggcctcttgccctcttgagagatttctttgtaaaggtgcatgaggaattgaaatctcaccacctcctgaactggcccagagctgtcctggcatggatgacacagggaccttgacatgggctgatggattaagaacaatgttacattttctgaacgcatcacttttccaacagctcttgatctcacatgtgaggctctttctcatccctgaaggctactgacttttccctggatatatttgtattgtgattattctgcatatctaagaatttcatccctttctaaccgctcctctgccaaaacagaaaccaaaaaaagccaaaacatcactctgtgctagttagtttctttgacccctcttaaagaaactctaaacaaaaaatctgcgtccagttatatccaagggggtgttcttactgggtattcccgtcagaacctcccatctgtctattttggttcattctttgccattatcatgtaacaagttcaagataattgtgtttcatctccagttattattcatagtccctctgcatgttgaagattgctgagacagcacagaaaaatagtaaagcaacagatgaggtctgtttgcaaaaaatgtagaacaattcgaggtgcaggatgttcttcaaattgtgatggggtgaggttttgaaaagttcttcggatgggctagtgtttgttttctctctccctctccctctcttcccccctcccctttccgctttcccacttcctctctcctccttccttcctccccatccatttctcttaaatagaaacaaaattccatatattcttagaatccataggatccatatattcttagaatccataggatccagcattgcattttatttaaaagcaaatgccgaccaagtagtcagtagcaccctttcagctccaatagttggtgctatattctgtactcagcagtagactcatttcattattttggagtatggacctgaagaaaatgaatatcagacatgggctaagccaaggccagttaataaatattttaggctttgcaaaccgtatagtctctgtagcaactattcaactctgctcttatagcaccaaagtagccacaaataatagtaaacaaatgggcatggctctgttctagtaaacttacttgtggaaacgggacaggctgaatttggcccacagaccctcgtttgccaatccctgggctaagctattgcaggggtactgctgatggatatgcgggctgtgtcctgtgtgacagtgcctagccaagggggcaagtgggacctgaaatacaacccatgctctgcttctccacgccttccaccacaagaggtcctttttgtaattcagacagaggtaccatttgttcacaggctgtctccaaccagaataagcacatttcctaatggattagggtacttaacatggtttgcataagtgggaggaagagggacctgattttcctgtattaggataagggttacctttgatcccaatggctgttattgaaatgactaaagccacatggttcaaacatggctgccttagcccacatctacagactgggagtaggtggtgggagcaattccaacagagatgtagactgggaaagtgccccaggtaagaggaaccccaaagaaggtgagtttattggttagggggcttgttggatattattaccaaagccatagtccctttatgaagtttgttctgtccaaaaatgtgatttaggccactgtatgagtccattctcacattgctgtaaagaaatacctaatgctgggtaatttataaagaaacgaggtttaattgggctcatgttgctggaggctgtgcaggaagcatggtggcatctgcttggcttctggggaggccttgggaaaacttagaatggtggctgaaggtgaaaggaggagcagcacttcacatggccagggcaggagggagggagagaggggagctatcacacactgttaaagaaccagatctcgtgagaactctatcatgagaacagcaccaaaggggtggtgctaaaccgttcacgaaggatccaccactatgatccaatcacctcttaccaggccctatctccaacatgggggattacaactaaaatgagatttgggtggggacacatatccaaaccatagcagccaccactctccatcttagaatggtagaataataaaattaggaggaaacttggtatgcttttgcatgcattttaacatcagaaccctttgttcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagaaccctttgttcaaataaaatcttatctagaactccagtatacgcaactgtgaaaaagggagagtgctctggtgcagctggagaggaaagacaaggagtgccctcagtaaccccctccccagatccggctggcccagagagagctgctgagactcccccaggacccagtttggagccactgatctcatcactgcataggagggagagagagaggggagatatgaaacaacggaggcaaaatgaaataaaataatcttaggtgacaacattttttaccaggttttgttggtataaaacaccctttccttttcagttcccctacctgaaagtctttggttgcttatatatatttaggatgtttttatatagggtaatatagaattgtaaggcttaatataatattaatatttgacattctattggatttaagcagccagtgggaagagagtaaataaaaataactacacaaaggaaactgctattagcgtttgttaccatgtgaatgaaatagcacatcagctgtgcatttaaagatctggatagaagtttgtttcagttatttgtttgttttgaggtacatttacatacagtgaaatacatagcttttaagtacacagtttgatctgtgttgactatacttacgtaacccacagctctaccaaaatcaacaacatttccatcatgcgggaaagttctcttattccccttcccaataaatctttcccacccagaagcaatcacagatgtgatgtctatcaccacacttggttctattctaggactttgtataaatggaatcataccatatgtactcttttgtgtctactttgtttcacttagcataatatttttgagatttatccatgttgcagcatatggccatacctttttcctttttatgcctgagtagtgttccattgtgtgaatgaatatgccagtttatccattctcctgtttatggacacttggaatgtctaaaagctgccatgaaaagccttgttcaaggctttttgtggacatatattctcatttctctaggataaatgcctaggagtagaattgctgagtgataagagtgatgcatatcttttaagaaaaaaactatcagagttttcacaattatccattttacacatccatgcaatatatgagcattctgattgttccacatccttgccaacacttaatattatcagcctttaaaatttcagctattctatttggtgtgtttctcatgtagttttaatttgcatttctctgtaataatgttgattgccttttctaagtgcttattggctattcacctatcttttgtcaaatgtctattcagatgtttgccctttaaaaaattgtgttgtctttttattgttaaattgtaggagttctttgtaagatacaggtctgggaaatattttctcccaatctgtagtttgcttattttattgagattgtcttttgataatgagttttaaattttgcagttaaatttatggatatttttctcttatggttattgcgttctgtgtttgaaggaatcttgccttcctcaaagtcacaaagatttatcttatattttcttctagaatatttatacttttaagttatacatttatgtctatgattcatcttgagttaatttttatatacaatatgtggtaagattcaaagttcttttctttttccacatggctatctagtcattccagctcaatttcttgaaaagatgtttctttttcaattgaattgctttgatatctttgttgaaattgatttggccatatatatgtagggctacttttgggctttcagttttatttcattgttctgtttctattttatttcactaaaaccacactcttgatttgtatgtttatagttaatcatgaaattagatagagtaagtccttcaactttgttcttctatttcaagaatgtttgggctattctaggtcctttgcatttctgtataaattttagaatcagcttatcgatttctacaaaacgtcttcagaaattttaattgagatctattaagtcattagataaacttgaaaagaaccaacatcttaagaatattgagttttctaatccttaaacatggtatatattattattattattattttttttttatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtggtattccccttcatgtgtccaggtgatctcattgttcaattcccacctatgagtgagaatatacggtgtttggttttttgttcttgcgatagtttactgagaatgatgatttccagggacatggatgaaattggaaatcatcattctcggtatatattatttatttagatcttctttaatttctctcaacagtattttgaggttttcagtatatatctcacatacctttcattaaaattattcctaagtactttctgttttgggaagctattttaaatagtattttaacatgttacattgatgaattctttatgtagaaggtttttttttgaagattatagaattttatgtatctaccaggtttgctaatttgttttagtttatttatatctttgattaattatagccttgtaaaatattacttaatattacatactggtcatttcctgttctgtcttgcagatgattttatagctgacatcggtcaagaactacattatggtgggataaaattttaatttactagagtattatagtgagggaagttttttctttcttatggagagtttttattatgaatgctttttaaaatgctttttctgcatctatttagatggccatttggtttttctccttttaatctattaatatgttgaattatattgactaattttaggatgttaaacagcctttcattccagggttaaacttcacttggccgtgatatattattattattatgtatgtgtggatacatttgagtttttaatgttttgctaatgatttttgtgtttgtgttaatgagagatattgtcattaatgttcttttttttttttttttttttttttccccccctctgagacagagtctcgctctgtcgcccaggctggagtgcaatggtgccatctcagctcactgcaagctccgcctcccgggttcaccccattctcctgcctcagcctcccgagtagctgggactacaggcacccaccatgacatccggctaatttttttgtatttttagtagagacggggtttcaccgtgttagccaggatggtctccatctcctgacctcgtggtccacccgcctcggcctcccagagtgctgggattacaggcgtgagccactgtgcctggccctaatgtttttataacttgcttgtttcagtgtctgggcaacactggccttttaaataattggaaatgttctctcctctgtttctcagagaatttgtggaggattttactattttctttctcaaacatttagtagaatttgccagggaacctctccaggttgggagagttctttgtgggaagtttgtatttatgagtgaaatttctttaattgacacagggctattcaatttttctatttcttcttgggtaattttgttcttttcagtctttgaaggaatttgttcatttcctgtaagttgttaaatttattggcataaatttgttcatacaatttccatattaccttttattgtgtctttgtaggtttttatggtagcatctttatagagatataactcacatataacacagtttaccatttgatgtatacaatccagtgtttttaaagagatttagctatacagctaattttagaacatttttatcaccctaacaagaaatcgtggtgccataccagtccttcccaccctatttacccagccttaggctaccactcctctcttttcagtctttgtagatttgcctattccagactttttatataaatgagataatataataagtggtcttttgagactggcttctgtcacttagaataatgtttttaaggtttactatgctgctgttaacattcatgtacaaatgtttgtgtgaacacacatttttatttctcttgggaatatacctaggggaagaatttctggatcataacgtaactctatatttaagcttctgaggaactgatggactgttttccaaaataactgcaccattttagactttcaccagcagtgcaggaggatttcaatttctctgcatccttgctaacacttggtgtcatctatcttttttattacagccatcctagtgggtgtgaagtagaaactcattttgctttggatttgcatttccctgatggctaatgatgttgagcatcttcccatgtgcttgatggccatgtgtatgtatctttcttggggaaatatccattcagccttgttatcctttaatgactgtagaatctatagcaatatcccttctcactttcctgatatcagtaatcttcatttctctcgtttttttcttaatgagtctaaataggagtttataaattttattagctctttaaagtgccgacttttggttttatcatttttctcttttgtttgttaattttatatttcatttctcctttttactacttcattcttttacttaccctgagtttaatttgctcctcagattatttagatcaaggatctaaatttctaccttaagaaactagctttttctagcatatgatctatcctagtcaacataccatgtgaacttgaaaagatcgatgtattgatagtagcttttactttttctctatcttttttttttctgatactattgattgcttagaagaactgctttaacatagatttccaaactctatacccataaaactggaataggttacactatacccaatttatagataaaaaaatgaaacttgaggctcagaaaggtgaaatagattgctggtctgaaacttacctagagatgaaagttaggtagactccactgcttaggttggaagaatatgcagacaggaaaccagtgggaaggggacagtacaatgtacctgcagacctgattattccagtatagcaaaagcattctgtctcagcctgtcacactttgataagatatatttgggggaatatcatgagtttttggcttatttgttaaacacctggatttttatggtctaactttagttgttgactaagcaaagtatttgttgactaatgtgactgagttgtgaaacgtctcgaaatggcatttcaattgtcagtgaagggggtggcatagacatatgattccttcatatccactcaactgagtctggcgtctccttgaatgcaggcatgcggaatgtccatgtgcctggcatcttggcggtggtcagtaaatgtttgtcaaaaggagctgaagtgtataccgtttctttgacttcttctgtgagtcaagcaccaggttcatctgagtgaaaaaatgcaatgtggatgagactgtgatgtgtcctgtacactgaaagagatcttgatcgttactaaatgggtattaaatgaggcagtgtggccatgacagaaatatgcaagaataaaagaagtgttgtagttcgcagaactttagagggggaaaatatgatttatttattacttgtggaatctcttgatttgatacactggtggaacatagcattatagtcaaagcagcagtgatagcttggcttgtgtgaaaacaaggtaggatttgtaataccatctgatattcttctccgagtttcagattcagaaagaacagtatcaacatgtaccgagcaggggaaacaatataggaaagatataaaagaaaatatgcaatccttgaccaatgtaaataaatgggaacttttgatttatttgtcatgtactcagattgatgggtttcgtagtgaagtaaatgtgtgtgcatccctggttcaggagagagtgttttgtgtatcattctagactactccagactgacatttcaaagcaacgtatcatcagtgaagtatgtatttatcgttagctcttgaaggatttttttttttagttgatagagtcatgtcttagtttctcaatgtggagaagctaaaactgtgatcctgtttctcattttctctctcaccacataggaaactatcctggtcagaagctaccccttggttgtatcagtttgctagggctgtcacaacgaagtaccacaaactgagtcacctaaacagaaatttgcaatctcagttctggaggccaaaagttcaagactgggatattggcagtgttggctcctaccaagagctgccaagaagaatctgtgccacacctcttccttagcatatgttgttggctgacaagctttggcattccttggcttgtagaagcatctctcccacctctgccctcatcttcacgtggtgttctacctgttgtatgtctccaagtccactcacactggattagggacccacactactccaggacaaccttaattaattacatttgcagaagccctacttcaaataaggtcacattttgaagcactgggggtggggacttcaatatatgaattttgggggacatgataacatgctgcttataggtggaaaataatttctacatatttattaataaggaacctctaagatgaacagatttggaaatctagtttatcttcagtttgttctaagcatctgtgtgacctggaataaattacttcattatcccaacctcagcttcttcatctgcaaggtggaagaggtgatacttgctctcctatgttatagagtcgtagtcaattataacaatagctgctgccatttattgagtggtaataagagccggcactatcacaagagtggacaccttttacaggctaggaaacagtggcacaaagaagtaaagtaatttgcccatagccaattaagtggcggagccaagattcgaacccaagaagaatggctacagtgccaactctttcaaccagggaaccaggagagcatcactatataaattctgtgtaaagtgcaagacacaatgcaaaagttcgttgtcactaaaaggagaactcagggcaaagtcttgtccttcccacttctaattctttttttcctactccagtgtttatcaaacttttcccccttttagaatacttattggaaacccatacaaaactcatatctcctctgatgtttttgaaatttcagaacctgcatcattattgaagtaaatccaagcaatcagaatttgaaaatctagctttccaaacggcctcagaggcccccaacacacacatacacatacacacacacacacacacacacacggacacataacacacagtgtgttaactcagtccttcctgccttcagtttctgtggtacagccatgatatggcttggctgtccccagccagatctcatcttgaattgtagctcccataattcccacatgtggtgggagggacccagtgggaggtaattgaatcatgggggtggatttttcccatgctgttctcgtgatagtgaataagtctcacaagatccgatggttttagaaagggctgttcccctgtacgtgctctcttccctgccgccatgtaagacatgcctttgctcctcctttgccttctgccatgattgtgagggctccccagctatgtggaacagtgagtccattaaacctctttttatgtctttattagcagcatgagaacagactaatacaagccataaaaggccaagatcatcattcctttacctacattctttttttgttatttgcccttgcttttcatcatgcaccacatcatttatgtaactaaaaataccaacttccaggccaggtgtggtggctcacgcttgtaatcccagcactttgggaggcggatgcgggtgggtcacctgaggtcaggagttcaagaccagcctggccaacatggtgaaaccccatctctactaaaaatacagaaattagccaggagtgatggcatgtgcctataatcccagctactcaggaggctgaggcaggagaattgcttgaacccaggaggtggaggttgcagtgagctgagattgtgccattgcactccagcctgggcaagagtgagactctgtctcaaagcaaaacaaaaacaaacaaacaaatgaaaaaccagcttcccttagattcccccatgagtttctgactccactacctaattcaataaaggcatttttaagaaatataaatcatatttattcatggttatatgtacatgatacaaaacatttcacagcagaaatggactcttttttaccccatcctcaatcaactaatttccttccctataaaaatctattatttgttttgtgttgtgtgtttcagccagagatactctatgcatgatgcaaacatattagcatccatatgctactttcatctaaaaagtagcatactctccacagtattctaaacctcttctttcacctattaagatatcatttctctattgtaagacttaaaatttaatgtagtgcctttgagcccaaaagtcttgagtttccctacttctaccagatattccccccaaccttcccaaagagaaaggctccctacttaaatggttcctctatcatctgggcctgctgggccgtacccattcctcaacctaacaggtttcacctcccggccagcccatgacattagtcacatcctcctgtaggaacctgaggacacctctcccccttgttactacatagccggcctcccacagcccttgtggtttgctctgctgtggactgtagcccctgtatggtgaacagtgtcctcctcccccaggctgcaagtgtatgtgactagtaaaccacgatctgtctcttttaagtggtgtggggtgttgtttgtctgaccttctcatattatttagggcagaggatccacctttaccaactgggtgaataggaggtgattagaactagtccatattaccacatagagcaatcctttgcttttcctaataagtgcacagaactctatagtatgaataggaaccaatttacttatcttgttccctgttggtagacactgggtttttactctttggttccacagcaatgctctagtgaattttctattccacattttgcatctgaagtcatcttgcatctgaaggagtaaattattacaagtaaagtatgggtcaaatgctatgcacattaaattttaataaacattggccaggcgcagtggctcacacctgtaattccagcactttgggaggccaaggcgggagtggatcacctgaggtcaggagttcgagaccagcctgaccaatatggtaaaaccccatctctattaaaaatacaaaaattagctgggcgtggtggcatgtgtctgtggtcccaggctactcgggaggttgagacaggagaactgcttgaacccaggaggtagaggttgccatgagttgagatcgtgaaactgcactccaggctgggcacagagcgagattctgtctcaaaaaaataaaataaaaaaattaataaacattgccaattgcttttcatagaatgtgtaccaatttagacccccacaggcagctggacagtctatttccccacatcctcatcaacccaggacattaccaaactttctgatcttggccaaggggagaggtgaaaaatgtcaagtccttgtggttttagtttacagttttacaagaagtgagggcaagtgtcttttcatatgcttacaagtcatttgtatttctggcctttctcttattgactcgaggaagcttttcctttattgaataaattaccactttttctatgatatgaagttgaaatatcacttatcatttgtctttgtttatagtaggttttgctgcctagatttgtattttatgttatcacatttaccttcttttgtggattctagtgttggggttacatatagatgcatcttctccagtctgtgtaggagaatctcattttattgtgcgttctttgttgtgattcacagatatcacatttttttacaaattgaaggtttatggcaactctccattgagcaagtctatcagtgccattttcccaaaagcatgtgtttactccatatctgtgtgtcatattttggtaattctcaaaatatttcaaactttgtcattatcattttttcttttatggtgatctgtgatcagtgttgtttatgttgctattataattgctttggggcaccatgaaccacacctgtataagatggagaacttaataaatgttgtatgtgtactgactgttccaccaactggccattgcacatctctctccctctcttcaggcttctttattccctgagacacagcaatattgaaattagaccaattcataaccctacaatggcttctaagtgttcaagtgaaaggaagagtcatacatctctcactttaagttaaaagctagaaatgactaagcttggtgaggaaagcatgtcaaaagctgagacaggccaaaagctagacctcttgggcaaaataattagccaagttgtgaatgcaaaggaaaagttattgaagaaaattgaaagtgctactccagtgaaaacaggaatgataagaaagcaaaacagccttatcgctgatatggagaaaattttaaaaggtcaatgcctggcttcaaaagacaggctgactctcttgttaggggatagtgcagctggtgaagccaatgctcatttaccattccaaaaatcatacagcctctaagaatgacgctaaatctactctgcctgtgccctaaaaatggaacaacgaagcccagatctgtttacagaaggatttattgaatattttaagaccactgttgagacctactgctcaaaaacaaagattcctctcaaaatattgatgctcactgacaatgcacctcatcacacaagagccttatgaagatgtacaagaatgtgtaatacaaggcatgttgttttcatgcctgctaacacaatatccattctatagccctggagcaaagagtaattttgatttccaagtcttattatttaagaaatatactttgtgaggctatagctcccatagataaggattcctcttggatctgagcaaagtaaattgaaacactcctggaaaggattaacagttccagatgccattaagaacagttttgatttctgggaggaggccaaaatttcaacattaactgtagtttagaagcaattgattccaaccttcatggatgactttggaggggttcaagacttcagtggaggaagtcactgcaaatgaggtggaaatagcaaaagaactagaattagaagcagagcctgaagatgtgactgaactgctgtgatctcatgataaaatttaaacaaatgaaaagttgttccttatggatgagtaaagaaagtggtttcttgagatggaatatgctcctggtgaaaatgctatgaacattgttgaaatgacaacaaagtatttagaatattacataaagttagttgataaggcagcagcagggtttgagagattgattccaattttgaaagaatttttgtgtgcatgtggaggtaaaatgctaccaaacagcattgcatgctacagagacttatttcatgaaaggaagaatcagttaatgtagcaaacatcattgtggtcttattttaagaaattgtcacagccaccccaaccttcagcaaccattatcctcatcagtcagcagccatcaacatcaaggcaaaacctcccaccagcaaaaagattacaacttgctgaaggctcagatgatccttagcatttttagccataaagtattttaaaataaggtatatacattgttttttagacataatgctattgcacactcaatcaactacagtataaacataattttatatgtgctgggaaaccaaaaaattcatgtgacttgctttattttgatatttgctttattgtggtggtctgaaactgaatgcacagtatttctgaggtatgcctatagttgcattaaaaaaaattctcctgatgttattgtcaagattttaatggcttcacttttacatttaaatatttgattcatctggaatctatgctgatataaggtatgagataaagatctataatttgtttttacagttgattatttgacaataattcttttttccattaacatacaatgtcatatttatcaaatactgagagactgtttctgatctgtgttctgttccatggatctgtctcttcatgcacaaaaatgagaatgttttaattattatatatttaaaatgttttaatattgattattatgtatatttgtcttttccttattcttgtttattttgttttccaaatgaactttaaaatcatcttgcctatgactccatgaaaaaattatattgctgtttttggattcttgaaaattcatatactaaagtaagaagaattgaatctttaaaatgacaaattttccaatcaaagactgtgacatgcatgttatttctttaaaggtcttcatgccctgatagtgttttagagtttagtttatatagctcttccacatgtctcattacatttattcctaggtatttaaatagtagtctttccttcctttgagactttctgactagtggtaatttacaaatattaaggctgctgatttctagatatgagcttcccccagccatctaattaaatgttttattattctaattttccaggtgtacagtgatatcatctttaaatatgatgattttacttcccttgcttcaatttttgtagtccttacgtctttctcttgtttattttgggttggccttcagaacgatgctgagtaaaggataaaggatgtcttcatcttattcttgattttaacaaaaatgcttctgtagttcccctaccgcaaatattgagtatccatgatgttctaggcaccaggatgtagcaaatacaactgtccttcaggactcaactcaaatccaccttcttccaaagccccctgtgatcatctcaaacagaaattgtctttgcctcctccaaacttcatattttccttccctttactgtcctactttttatcttgctttagaattatcagtatacttgtcttaaatagtccactaaaaatcggtatgctcagagaaggcaggatctttgacaaatcatctagtcatcctcagaactctgccttgcccacagcaaatgctcaacacagtcctgcttaattaattataaattagttagtatgaaaatttgttcaaatatatttgagcaaatactaagtaagcatctgctcagataaaaatgcaggattctcatacagagcacttggccatgagtaataaatgtaagtccggctctcaaaatatacatgtattcctatttggcactagccaaaagggggtgcaatatttacctttaaattattatagagagaatgagctagaaaggaaaaagccagttggagccagaaagcttggagtctttgaacctccctcagttctctaaatctagatgaaatgatatgaatcatcaagtcatttcatgccttttacacttcactttaggatctttttctctaaaaagcctctctcaacagggataatagggtgagtggccttagtatcagtgtttggtttctttgcgatgtgtaattggttttagctagtgtggaatgtcctcttgattttaaattcctatttttagctcctctgtatattgtgttatgtgttcactgttgctccccacacccctccttgcaagtctatacagaagcatttcatgtggaaccggagctgttctagggaagcctgtcatcaaggctgccctttgctctgcacctccccagcaccctcagaggtcagagcgaggctggtgtacagggcagtggatgtgagagcttgaatttcttgccaccttgttacaagccaaagtaggaagaaagtgtatccagaccaggaaacatgatttgtaatcgtggttgcaaatctagcaccctaaacctagcacaccatttggcacatactcggctcttaaatgtccatttaatgcatgaatgactaagcagataagtgagtgagtggatacatatgtgtcttattgggagacggctcatgaactgacattcaccatgggcttttctaagtttttcagtgggatcaatgttggtagtttgtatatttgcacttggtttagaaaactttcctttacctaatcctcaggcgatactgtgaactttgggttgcttacttgataaatatagttttattattaattcatgcatttgaaataacacatgcattgaaagcagcagcaaatccttttaagctctgtgctcttttaaataggttctttctctcatgctcaggaaaaaattcagtggagatgatggcaacagactggtccctcaaatctctggccatagcccaaggaggagagaacccacaattgcaggccatatgtattgccctgtatgatcagtattaaactcaaagtatgtctttgtaactagagacatattctgggtagtgtggctgttagtttgtcccaatctttattttaaggcactatccacatctctttctcttttcctttgcccctaacattgatatcaactgagttttcagggtgccagctgcccatgtcagctctttgagagagcagcctctctcctccttctgcctctcaatcctttcctctccgccagctcttctcggcatgttggtcattcattattgatgaccctccagcaccttctccaccccggtgttcccatagccctgtgcactgctgagcagagccaggtgcaggatctagtcggggtccaggactgctgctccaaggccgccaagactctttcccttcctggctgtcagagaggatgcctggcactagagatacagcagcagcggcgtcagccgctggtcttgaggagggtttgtttctctcctctgtcttctaggaagcaaaaggttaaactgttcattttaagagcctccctgggtataaaatactgagctttgtctttctggagtgagccgattcctaggccccttgacctttgctccaacatgtctgctgcccatcccttagagtgtttttctttgctttctatttagtcagaaggaatgaggctagtgtctgccgttagcttaattattggggaaaagcgttggaagaaaagaaactgattctctccatttttctaattgttacttaaccaagtcttgacaagatacaatttggtggctaatatgcatggagtgccctttctgaaagcagaggctctgcttgtggattctgcagtgaaggctggagtcacaccttggaaatgactgtccaccttcacatttgcacacatcacttacacacatggagctccttccaccaccagcctcccctgagccttcataagacacaggctgctgctttaaggaacattaacaatccagacccttccagggacccatgtgactccagcttctcccacaatagtcagaaatcgtaattgagagttcagaattcataggtaccaggataatattgcagaaagataatcaggcacctacttcccagttccctgaaattaaaacaggtattcatcttgtcagaataagaaaacagggtcctgctgtgttccagccacctggcaaccttgttcttagaatacagaaagggagggaagcaatgtgtgcgatcactctagccgaagaatgtagagagaagcgaagaccatttttttagtcctaatttcctacaagggacaatgcacctaaagtttttcaagccttgctcagaatcatctcacaaaaggaaaggccctttgcttcacaaaatattttaatgaaagcaaaacagtgactaagagcctcatgtactgctggttctgcctgtttcaaatcttgaaaggcctttaataacctccattatgtgactatgtgatttttatcacacaatctcagattcttacattttttaaataactcaccagcaagaaccaatgtcagaactaaatgctaataagatttggcctgggagagtaacatagtaagattgttaatgtttaatgcactctcatcaaagtgggataatcctacggctgaaggttaagtgagccttttgtaaaaaaaaaaaataatagggaagaaaacattattgtagcttttccattttactcagtcaaatgaattcaacataaacttgttatagccaagcccaggctagacatttcctggtgatctggtaatttcccttgtattgttcatgtggtttgtctctttcctcttcctctttgtttctaatgatgatgatgaacagcatctctgcaataggccacattctcaaagtgctccattcattgtcacttgaaaagaccactgttgggttttattgccatcattgatatacaaggataatttacatacaaaattgtggtttggttttagagccatggcaaccagagtatcacttctgatgggaaaaggaagaatggccttcagtgatggagtaggcaattgcaaagagttctgctcccagttctcttgctaaatcaaaagattgcaagggtcaagatcgatttcttcattttctttaggcagcaatctgaagaggccccagcagaaaactccagccttaggatttctggtaatcagaaaaagaagcaactgttcttgggtaacatgtggtgcccataaaagggcatcagctcttgggggcagcctgaggttaccaggttcacctttgctcattctgcgcaaggatcgctcccctcagagtttctgcaggggaatgtgtactctggtgttcggtattaaagcttctacatgaatttatagagttgcttacattggctgagaaattgttttttttttttttttttggtactcagccctaattttccctggcaaatattgctctgtaactttgagatgaatgtacccatcaaaaactccagaagaaattctcatgcagttctattattgctcatcattttgccaaggaacgttagtaaagagagctatgaagtggctaaagaagttgtgttttttgtttgtgtgtttgtttttccttttcatcgttttatgtcttagtaggagaagaatccaagatgaaaaggacaggctctggttttagctttgccactaatttcgtgtgtttccttatgcaagtgtccagatcttcttgggaattaatttctttatttgtcaaagggagctaataatacctgccctggccaacctgtaacatagttatgcgtaggagtaaaatcacagatgtgaaagtttgcaaaattctaagatccttaggtagctcatgcgtcgacaggagtaatgaattatacacctaccgcaaaaggtgattgtggggatccagtgtcaaagggcttagaagagagtgtgacacataagtagcatttggggatggtagctggaagaccaagcagcaagggtgttaccatcaaatcccttccataacccctctcccatacaaagcaaaggggtctaaatagccccagtgctcacttcaatgctactcatattctttggctttggagactttgcttttttggagcccctcattcctactttccagacatttgcagaattcagctgtgctttctaagagattctctggcattaacacagaatgaccttgcagtgggaatgaccttggagctgcagcgacttgagtttaaattctagctctgccccttactagctgggtgggattgattccaggtaactgtcagtaccttgtgtctcaacatcttcagttggggatagcgtcctaccatctccctcatagaggagttaacgagttgaaatgacacagatgctacagtcaggagatgctacgtaattttctgggcccagtgcaaaatgaaaattcagggccccttgttcaagcatattaagcacttcaagatggcaacagcagagcatgaaaccaaggtctaggtcttctgagctcagggtcttgtgcaactgcataggtcacatgcccttgaagcccaccctggccactgatcccatagtggcagcttgccacttagtgggcactcagtagagaccgcttgcttttctttcttcctctttctctcttcttctcttgatagccttaaatccctgggagggggggcttgcatttactcttacacttcctgccacagtttctccccttatgatcgttccttctgctggttaaattgccgcttctcttttgcccctgaaatcagggagccaagtgattaagagaagctagcttatctacacgagcctcccatctctatgtctgtatttcccaagttctttcaaagataacccaataaaataaagaactaacagcatcatgatacatacaaaggggctatggtgtatgtgtggcaggctggggagtaaggatggagaaggtattttgaggcaaagaagaaagaacaaaggaaaatgaaggtattagaagataaaagcttgcacttcacagaagatattattttgctgccatgtatctaagcacaattgaggcagattagttgtaaaatcacctcatttacttttcccagcttttttcagccactttcactaaatcaaccaaccaaaccttttctgtgcccttatgtcccttgtctctgaacttcatcaactaaatatttgttatgcattattttattcagcattcacagtatctgtgggtttgggtatgctacttctttcttcattttatagagaaggagatgatagagtaaccgtccatagttactgtgttcattggaaatgttttgtctccaagtagcagaaagcccaacttacagtgtctgtgttcggggttggaagttggggagaggttcctcctaatgagatgcttggaggcagaccaccgcctcaggggttagacagctcactgacatcctggctcctgtctgctgctctcttggcttttccctcataatcacaagatggctgctgtgggtccaggcatcacaacatggtcaggagaagaagaaatgagggaagaaacagtatccagcctattgttgtcttttcttgggaaagttacactttctcaggcatccactggcttacagacttctacttatgtctcattggccagaactgtgggagtttctagctatagaaatggcggagaaggtgagtgtttagcttttcccgcctttttcctggttgggggagacagctctagagtgaagcacacaacagtatatactttatagtgacaaagatagcaaggggcaaagacagaacctgaacccaggtcctctaatcttgagtttagagattttgccattctgccacattgctcttcttttaaaaatactttcagcaacatccagcttgtccacttcctgctgagacaagccaacaggtataactccaagttatggaaatttaaaacaggaaatatgtttatactatgccttcccttaaggttcctgagagagaactttctacaagttatgtaaaacagagataatgtggcttatagaaaatttattcctcacatgataaattctgtgcatgtgaagtttcgtagaactcactgtagcgcatttagaaacacacgaccagaaattgtgtgaaacattgctttgggatggatggtgcccgtctgaccttaagctatccttcccccactctgctgctcttcaaaccacagccagtttattttttggtagaaactatttacgtatgaagatcgtatttggatgcctttagtaatttattaaactcactttcctaaagcaagatcagagtttaaaacatatgtaaatatcagctgagagattagaaacaaaagccaagaaggaatttctccactgcaattaccacatgcagttaccatggcagggaagctgtgcgggataattcagtccaaggtagagaaataacagagtctggaaatgtaaatatgtttctgttagagatacttgaaataacgtttacactggcttcttcctttttagctatgggatattgtgcaaaacttttttgttgtgttttctttaaatgctccgggcagtaaattggaagtatatagcacctgctacatgtttagtcagtagtcgaaacattgaataaatcatgaaatctgtaggtgaactgaataatagctgccctggagagaactgtaattcactgttgacaaaataaatccccctgcatttttctggggaatcttttatttttagcaagagtgtttgatactcctaagttaattagtagttttaacagagtggaatgttattgaacctaccagtgttgtttaagagctaatgtttatgtgccaggcgccagattaggtaattttataagcatagatcattacattctcgcccagccctgtagggttcctagctctgcttttccagatgaagagccaagacccttagaggttgtaactagtccagagccacatgggctaggaagaaaggaagacctttcaccacttatttacacaagtaagttcttcccaggcagtgtggcagactcagcagattggcccacttaactcttgttccacccccactctatcttgtctacttctaccacagaggccagaaaccacaaatccccagcctcctgtggcttggcttggggtagcccaaatacacagttctgtccaaccatgcataggcagaattccctggggaacatttctctctccccaagtaggtaaagcttctttgccctttaccgtttgttgttccttttcttccttcatggaaagaagagtcactttcaagacatgcagcaaccaccctctaacaatcagaaggaaatacatggttaagattgttgaaacaagaagtaaaagaagtcaagttgcttgacgatattctcttttgtctttttattttttttattttttaaattatactttaagttctagggtacatgtgcacaatgtgcaggtttgttacatatgtatacatgtgccatgttggtttgctgcacccattaattcatcatttacattaggtatttctcctaatgctatccctcccccatgcacccaccccacaacaggccccagtgtgtgatgttccccaccctgtgtccaagtgttctcatcattcgtgtcccacctatgagtgagaacatgcggtgtttggttttctgtccttgtgatagtttgctgagaatgatggtttccagcttcatccatgtccctacaaacggcatgaactcatccttttttatggctgcatagtattccatggtgtatatgtgccacattttcttaatccagtctatcattgatggacatttgggttggttccatgagcttgatgatattctcaaatagattccctagccctaggctgcctgccattgcattccttattacacaagaataatcatctcttattgtattccaatcattgattggcattattttttttctgcatagcaaaatacatggccaaatcagtaaacctgaacttctcaaagtggccatctggtagctactagcttataaactgttccctaggtatagagaattgaaagcaggtgaagtgtgtgtgtgtgtgtgtgtgtgtgtgtgtgtgtgtgtgtatttcacatatcactcaggtcaatgttcctttgaaaatggagaatgcaactctattaagataatagtgtaaatttggtaactgatcacttacagcaattacaacaaaagatgcaaaagtcaggcagaactgggttctaatgctggctgtagcactggttggttatgtgaccttgagctcattagttagccttgcacacatttcctcatatatgattgaggataagagtagttttatctcatagagatttgaggggcatttggcacaggatcaggcacaaagtaagcactcagtggtattgctgccaataataataacaataataataataatagaattatttaagacttgcagattgagggaatttgatgaaatatataacaactgaggttaaagtgttctaattttctgtctagattcatcttttatggtccctttttaatctcacaccagtgtccttccagaattaaaaggtcaatgattttacttcctagagaagcttccttaggggcttatgaatggtgaaaatgtgcacgtttgcctcgactctctatttccattgtcgaaggccttcgcaaatttacctagtgattctagccaagtgcttcctgacattcttaggggctcgaaggtcaatacttgatttggattttttgttgttgtttctttttccctccagcctcctgtgttgtgttgatttgtaaaatggccattgtaaatgttaaaatggaaagaaaaccgagtctgttataagctttgatgtagtaaaaacagcatggagcatcttaaattttaagatgtcatcagaaaagaagctcttcccagtttcctcttgaaaatcattgtattagtcagggttctctagagggacagaactaataggacagatatatatagaaaggggaggttattaagtagtattaacttacacgattacaaggtcccacaataggctgtctgcaagctgaggggcaaggaagccagtccaagtcccaaacgattttatttgacaaaagacaaaaacagaagttatttacaatagtttttgctcaaataattcagtgggggcaactgtacttttcctccaggtttatcttataaccaaacccaagcagaggctgccccaccccaacaccccattttacacagctgggaatgccaaccagaattcagcagcgtggctccctcacccctcaccaccctctattgctcagtgtacagtggggagggaaagatcccacctcagcccaagaacttggagctgaagaacttggaatctgatattcaagggcaggaagcatccagcacagtagaaagatgtaaggtgggaggctcagccagtctagccttttcacatttttctccctggtttacatgctggccatgctggcagctgatttgatggtgcccacccagattaaggatgggtctgcctttcccagctcactgacttgaacgttaatctcctttggccacaccctcacagacacacccaagatcaataatttgcaccctccaatccaatcaagttgacactcagtattagccctcacaatcataaaacagaaaaatgagtgaaaagcataaattttgctttcaaaaagctgggagattctatatccatgaaccacaatatatgacgtaaggctggccaaatgcagtggaacgaaagctcaggaagggctaagagacaatcactatgatcaggttatagattttgacaaagcaagcaaaaaacacgtctccaaaactggtacttcagagcaggcataccctaaaggatgacgccaataagcctttgtttggaaaatggcaagggtattgcaagactggaagtagaaaacctccctggaccctacctgctaccatgtagtagcaaatgaaactgaaagggaaatgcacagtcatcctgtgtgtataggaagcagtccattgttgtggcactacggcagcctgttggccgagaagaagcagtggctaaaataactcatcagcacacaaccctttgtaataagacttaacagtaaatcaggtaaatttttaccaactcacaacatcctgactcctatcccacaaaactgtcctctaaatatctgaatcaagaagtttccacattcagaggaaagtaacaataaaaaggaaccagcacaggatattgtaatatgccatacatgacactacaaagatattataatataaaaggagaaaaaactggaaaatagatggtaaatgcagaacactcactataggtgattccaacagacaaatcaaaagataacattaccatgatcttgacgacttaaagaaaccaccaaagagctcaaaacagaaataaagaggtcaggggtaatatggtgacgtgagaagagaagaaacatacactgatgtagctctccagagaactgaagggggaaatttttttttttttttttgagacggagtctcgccctgttgcccaggctggagtgcagtgacgtgatctcggctcactgcaacctccacctcccgggttcacgccattctcctgcctcagcctcccaagtagctgggactacaggggcacccaccaccatgcccggctaatttttttgtattttttagtagagatggggttttactatggtctcgatctcctgacctcatgatctgcctgcctcagcctcccaaagttctgggattacaggcgtgagccaccgcacccggcctgaagggggaaaatcatcacagatatgaagatgattttgaagcagccaaagtaaaatagacactagacactgccgaacatagaatagaggatatgatgggcaggattatcaaagcaaacaaaacggaaacaacagcttaaaagtattagaaagaaaatagtatatttgggtgacgaggaagatcccagagatacatcacaatatatccctgaagaagagaattaaacaaatgaaacataaacaaagatataattctacgtaactttcaataaataaaagatttgaatttatagattgaaggagtctactatgttacagaaaatttgctaaagaacaatcaatactactctgtattatagatgtattgatagatcttggagataagaatgatttggtcacaccagcaggaatatcaagtaacctatacaagaccacagtttaaaaaaaacctcaggctaacctaagccttccttacagcaacattccaagattgcagagagtaatgcccatgaagccctcagtgaaaaagtatgtggccttagagttttatgcacagccaaactgtcattcaaatgtaaaaacaataaataaaacgtgtccaacatttaagaacccagagaagatgattcccatgagttattctttaaaaaactattggctgggcgtggtggctaacacctgtaatcccaacactttgggagactgaggcaggtggatcacgaggtcgggagatcgagaccatcctggctaacatggtgaaaccacatctctaccaaaaaaattaaaaattagctgggcgtggtggcgggcacctgtagtcccagctacttgggaggctgaggcaggagaatggcgtgaacccgagaggcagagcttgcagtgagcagagatcacaccactacactccagcctgggcaatagagcaagactctgtctcaaaaaaataaataaaattaaaaaataaaaaataaaaaactattaaagactttatctaagagatgaatgaagaaaccatggcaaaaggattttcagtgaacactgagtctgttttgcttttagactgggtctaaataagtgcagaaacttttgttatagaaaaaaaaaactaagctctgaatgttcataaatattttaactaatataaggataaggtggaaggtggtatgtagattcattcatcatctcatttaaacatgataaatcaagtatatttaaatatacttagcatacttactaaagtatattagtaaattaatatatttactgaagtatattagtaaattaatatatttactaaatatactaagtatatttaaatatacaaaaataagtgtaggaatgaacatatatgttagtttgaaatatatatgtaatatataaggtacatgtttaatatgtaaacatataatatatattaaaccaatgtttagtgcctattaaccaaattcaagtgatagaaggaagagaaaataaagaacaatttgtattgcttttagtggaaagtaaaatgtcagtgtttcaagaaacagagaagttaaatagctaaataagggttagttacaaaggtgatcactggaaaaattaaccataatacaaacctgcccaaatagcacaaggaatactcacaaaaagaaaatatagaccaaagagtagaagatttttttaaaaaagcaatagaaacagaaatcaaaatactataaagtaagaccaaacctgtttctcatatcaacaaataaaagtgggctaaactcccatattaaaaaaaaagattctgaaatcgagtaataaagtaaaacttaaccatatgctataccccatatatacctaaagcaaagtgtctcgcaaacttgaaaatagaaggatgagcaaaggaatattatcaaatgccaacaaaaaggaaagtagaggccaataatcttagaataaaacaaggttgaatttagaacaaaaagcattaaacaagaaacataaagacaattgtgtgataagatgtatcattcacaaggaagatctaatagtcattaagtgtttctgtatcaacgtagcctgaaaagttaagcaaaaactaccaaaaagataaggaaaaatagaaagactttaattataggaggcttaacagacaaaatagacccaaaagatgacatagatggcctaaataacataagtaagtagtaaagttacatatatcaatctatccctgaaaactaaaaatatgtcatcctttcagatgtccataaaacgtttcccagaactgactatactttagaccacacagaaaacctaaataaactccccaaatcagaaatcacactgatattgtcctctaatcactatgagtcaaaaaggaatccatgtgaatgtatagaatatttaaaattaatgataatgattataaccacattacatatcctatgggctcaactaaagcatttgctcaaaagaaaatttgtatacgtaagtacttaaattaatgaacaaaaaataaaggaaatcagtgcatatgtcttctactcacgaaattaaatataagaaaaataaagttaacctcaggaaaatataaggtagctatgataataaaagcagaaaataggaaaaaagaataaatctttaagttagctctttatgaaaaatcaataaatcattagtaaacaaaccaaaatggttgccaataagttattttctaggaaaatataaaattaccaggcatgaccccagatggagagaaaacaacaatctaaggaaatgaattagtatagaagaaatacagaatgtggagaaaaagcaaacctcttgaaagaaaacaccagtcctggaatatttcacagattacttctaccaaacctataaggaaaaaataggtccaatattatttaaaccaagtgaaagcatccaggttatttttctgaagctagcatgcatcatgcatattctgataaatagagcacacaaaaaagcaaactaaggaccaatattgcttatgaatatcagtgtaaataatcctaattaaaatattagaaaacaaatctaagagctcacaaagacaagaatttgctatgttcaaatgggatttagtcttaaaaaagtaagactatttcaaaattcacaactgtattaatttaattcataaaatattgtcaaaattaagaatcactttatcatctccataaatacttgaacaggtgtttgataaaattctctaatcttgatgaaaaactcataataaaatgctattttattatacagacagagacatacacacatacatataccaatacatacttagtaacatggtcccaaagctactgatacaactgctgaagaaagtgtcattaatgtcggctacaaggaaagataccttaatcaatagcattaattaacattattgctccagagagcctagctagcctaagtaaacaaaagaaaaaaataagcagagtaattttaaccaggagttaaaattatcatatatgcagatgatatgattatgtactgtaaaacacaaagaatcacatggaaaaaatagtataaacaataaggaaatacacttaggtgattgagtacaaaaatactactcatgttaatctttccacaaacagaaactggttagaaaatataactgaagagatcccatttacaataagaataaatttaacaagaaatgtgcccaaattacacaaataaaatttttaaatgctactgagaaacatgaaaaatgacttaaacaaatggaaaggcatactctgtttaacataaagatgtcttatctaaattaagttatacaggtaatgcaatgcaataaaaaaaaaaacaatagaatctacaggggtagattctaaagttcaagaacaaataaggaagcccaacccaaaagtttctgacaaaggaaaattaagaaagggggattagccctatcaaatattaaaatgtattgtagtccgggtacctgaggtcaggagttcgtgacctgcctggccaatatggtaaaaccctgtctctactaaatatacaaatattagctgggtgtggtagtgggcacctgtaatcccagctacttgggaggcttaggcaggagaattgcttgaacctgggaggcggaggttgcagtgagcccagcggcgccactgcactccagcctgggtgacagagtgagactccatctcaaaaaaaaaaaaaaaaaaaaaaaaaaaaaaaaaaaaaaaaactattgtaaaactacagaagttaaaatatatatgtctccatatctttttttatttttaatttttatggccacatagtaggtgtatatatttatggggtacttgagatattttgatacagacatacaatatgtaatcatcacattagggtaaatagagtatccatcacttcaagcactcattacctctttgtgttacaaacattccaactgtactctctcgttattctaaaatgtattacaaattgtcactgactgcagtcaccctgttgtgctatcaaatactagatattattcatttatatctctatatcctaacaaccaggaagctctatgtaagtgtctagaaatagaccaaactacatatgacaaattttttatttacatatcaataaaaaaatcagtctattcaaaaatgttattgaaacaactgaatacctctttagaaaaaaattaacaagcacaaacaccataaacaaaatcagaaaatgatatactgagaaaaatcatttacaaaggactattcttttttttttaatttaagttctagggtacatgtgcacaacgtgcatgtttgttacatatgtatacatgtgccatgttggtgtgctgcacacattaactcgccatttacattaggtatatctcctaatgctatccctcccccatccccctaccccacaacaggcccagtgtgtgatgttccccaccctgtgtccaagtgtactcattgttcaattcccacctatgagtgagaacatgcggtgtttggttttctgtccttgcgatagtttgctgagaatgatggtttccagcttcatccatgtccctacaaaggacatgaactcatccttttttatggctgcatagtattccatggtgtatatgtgccacattttcttaatccagtctatcatggatggacatttgggttggttccaagtctttgctattgtgaatagtgccgcaataaacatacgtgtgcatgtgtctttatagcagcatgatttataatcctttgggtatatatccagtaatgggatggctgggtcaaatggtatttctagttctagatccttgaggaattaccacactgtcttccacaatggctgaactagtttacagccccacaaacagtgtaaaagtgttcctatttctccacatgctctccagcacctgttgttccctgactttttaatggtcgccattttaactggtgtgagatggtatctcattgtggttttgatttgcatttctctgatggccagtgatgatgagcattttttcatgtgtgttggctgcataaatgtcttctttcgagaagtatctgttcatatccttcacccactttttgatgggttgtttgattttttcttgtaaatttgtttaagttctttgtagattctggatattagccctttgtcagatgggtacattgcaaacgttttctcccattctgtatgttgcctgttcactctgatggtagtttcttttactgtgcagaagctctttagtttaattagatcccatttctcaattttggcttttgttgccgttgcttttggtgttttagtcatgaagtccttgcccatgcctatgtcctgaatggtattgcctaggttttcttctagggtttttttggttttaggtcttacatttaagtctttaatccgtcttgaattaatttttgtataaggtgtgaggaagggatccagtttcagctttctacatatggctagccagttttcccagcaccatctattaaatagagaatcctttccccatttcttatttttgtcagttttgacaaaggactattcttcttaacatgttaaaaatctcttgaataaaattaaaaaacaacccagtggaaatagatagggcaaataatataaataggtacttcccaaaaagaaagaaacatgatgtaaaccattgaaaaaatgcacagtctcactcacaataaatgtatattaagactactgagagatgctgatttaaaaaaaaaagcctgccagatttcacattgacaaggatcaaaaagtttaatcacacattgttggcaacactgtagggaaataaggtaccctcatacatctttggtggacccatgaattggtacaatgttgattaggagcaaattgccagtatttatcatgcaacttgcatgtatctcctgactcagaaatttcacttctaggaattcctcctacattacacttgtgcaattgtgtgtacttgcacttgtgtgaatgatgtatgtacatgaatatgctttgtcatattgtttgtgagaaccaaagattacaaaccaccaaatgctggccaatatacattcattaccacaaaggtctggtcaatttagagaaagaaatcctatgtccacgaaggatataatctctaagaaaacaaagtgctgacagcatcatagagtatgttaccattattgtaaaatggcaatagtaataattattatataaatatatgcttgtgtatgaataaaatgccctgaaagtatactgatagagtttggatatttgtccctgcgcaaatcacatgatgaaatgtaattcccagtgttggaggtgtttgggtcatgggggcagaccccttatgtcttggtgctgtccttgcaatagtgagtgagtgctcacaagatctggttgtttaagtgtgtggtaccacacactcctccttgcttctgctcctaccacatgaaatacctgctacccgtttgccttctgcggtgactgtaagcttcctgaggcctccccagaagcagatgccagcactgtgcttcctgtacagcctgaagaaccatgaaccagttaaacctcttttcttataaatcacccagtctcaggtatttttttctttcttttgagatggagtctcgctctgtcccccagactggagtgcagtgacgtgatcttggttcggctcactgcaagctccacctcccgggctcacgccattgtcctgcctcagcctgccgagtcgctgggactacaggcgcccgccaccatgcccggctaattttttgtatttttaatagagatggggtttcactgtgttagccaggatggtctcaatctcctgacctcgtgatctgcccacctcggcctcccaaagtgctgggattacaggtgtgagccgttgcgcccggccaggtatttctttatagcaatgaaagagtggcctaacacgtatacattagaacctgattacagtagatgcctcttgggaggggacttaaatggccagggttggtgataaaaagtattttttaatgtatccccttttttatctgttaatttttttatgtgtatatgtattacctattcaaaaagttaatcaattttaaattaacttagatcccaattcaaactccacatctgctacctccagctttgtgacctagagcaaactgcaggccagctgccttctctgtggagcagggactgtcagaactcccccatcccagggtgtgatcagagctacatgagataatcatgggaaagtacctggaaattacatgtaattgcttagtaaatgccctccgcttctttccccccagaattaaagtaagctgcatctaactattacaacttaataaggtgcattattgtgctttgctgtgtttttaattttcttgtcatacctgaatggtttaaacatctggcttccttaaggcataattaagtaaaagagagagcagcgtacatcaccagtcaggtgtacttctttccctgttgtaaaagtgatgctttttattcagagccaagtctagatattcaccagtccttggcacgactagaaaaagatttgaaggactaaagctgctagagcataattatgtattggctgtggacttgagatgcctgggttctgtccctcctgactgtgacttagcagccgtttgtcactggagatgttttatgacttctgcaggcttccacagtatcacttgtgaaatgggaataactatttaatagctcacagaggtgctgtattaggttctccagagaaacagaataggatttacgttatatataacaataggatatagcctagatatatagatatatatatataaggatttattgtgggaatttgttcacgtgtttgtagaggctgagaagtgccacatatgccatctccaagctagagaagcaggaaagccagtggtaaaattcagcatgagtccacaggcccaagaaccagcagctctgatgtcccagggcaggagaaaagctggatgtcccaggtcaagggaaggagggaatttacccctcctccttctttttgttctatctgaaccctcaatggattggaagatgcttgcccacaccagtgagggtaatctttactcaatctactgattcaaatgctgttctctttcagaaacacactcacagtcatacccagaaataatgttttaccagctatctgggcaccccataacccagtcaagttgacacataaaattaaccatcacagacactgactagaatgcataaagtccatctagaaaagcacccagtacataataagcactcaacaaatatttttggaaaagtatcaaacactctgtgcaaggagcaagaaatggttcctactttcacggtctacacaaattaatagggagatgaaacaatggcccaaatcactagatcaccaagccatttaggagaagaaactgaagtgaagggggtaggcatgactcataaagagtaatttcctttccctctctaaggccccaccagtgaactggtggccacgttgactaactggagacaggataccaaggaggacagacatcattgtgaggtcccattctacgtaccccaaaccaacagagtcctctggaaggcctgagagctgttaggaacaagacgaaatgggtgtgagattgaagaagtcacaaaatgcagacattttaagctattctcccaaaatacattaaaaatcttactgagaaaaatgtgaaatatatacaatactcacttgcatatactatttcttattttattttatttatttattttttgagacagagtttcactgttgttgcccaggctagagtgcaatggcacgatcttggctcactgcaacctctgccaccctagttcaagcgattctcctgcttcatcctcccaaattgctgggattacaggtgcccaccaccacacctggctaattttttatattttttagtagagatggcgtttcaccatgttggtcaggctggtctcaaactcttgacctcaggtgatccacccacctcagcctcccaaagtgctgggattacaggcgtgagccactgtgcccaaccaacactatttgttattttagatgttgggaagttttcatgaaaattctcttgtccattctcatttacatgcacacacatacatatgcacatgcatgaacacatgcttcacggcgcttcttattaatccttattgggtaaaatcttattgagggacaataaaccagataaaatctccaaccactccctggtgccaagtctcttgggcccctcacactccaggtgggcaaggcagcatgccagtggacacagcatcacctgctcagagggagtggttgtggaaagcacagaggcaggcggcctggtggccaaggtccacaccacatcctcccaggtgggcactgtcctgagtaggcttaaactggcattgtctgtccagtaagtccttttctaaggaaagcaggtatcaactaattagcaacatgcaagtgttttcattttaggaaaagagaagaactctggaattatggggcctggtaaaggttcatttaagcgtcaagatcaagttggctaaacccatagtgtggaagcactctttgcgtagggtgagccaggtggagcagctgtgtgacagatcttggaggcagtctaagggcaatgagcacctggagaacaaagagggaggggctgcccacctgaggaggaagggacatgtgcaactgtctcctagatggggccctgagaactgccgggagacatcacagggcagcccctctccccacctctggctacacagtctcctgcccttctctactcagtgaattctgaggtcaaaggctactgtgccaaactttcaagtagagtgaagcctcctccgtggtgaactataaacttggatggcatcatgtccatttttgtgttcttcacagcacccaacagcaggttcacagtcaacgttagtgagggaccgagattgtagaagcaaatatttctccagcatcaggggtgttgcctcactaggatctaccattgggatcccaacccaggatgatggtttgaaaccttccggtccagttctcccccatttgtcagtctttgtccttgacaattaatgctgtaaatgcatgtactaaatgcccactgagtgtgtgtaacacacaagccggtgatatcagagtggcaccggacagggagcaacacttctgcaaaggagcaggtattccaagtccttctcatctttcctgagcatctgtcatttgggtggacctcactgcacccttcagctattagcagtgactgtaaatggagaagaagttctcgagaaccagcagcaccctgaacactcattaactgagaaaaattggagactcaaggaggcccaataccctcttactgaatacccaccttccttgtgccagggaggtcatagggaggttgaaaaatcaagggttttgccatgtgtctgagtttgattcctccaaaagggcattaacttttcatattacctctgcagagtgggatttaaaatctgtgttagtgacacgatatttcatttcagatccacagggcccacatttaaaattaatattgcatgcttgtcagaatgaattccaaaccctctcacagcaggccccttgtgggacctagagaaggagtggccaattcattatcgtaacactgggatgagggttccatcccagcttttgactgacacctgcagagattttttttttctgagacattttaagtttttggtgtgccccatcttcccagacaagctgcacgtttctgtcactctgtgctgtttccaaagcccagtggtctgcagggtacctttgaggggcctcctctgatccagttaatcagttcctcattgacaacatagacagagcatctggcccaggccagagagggctttcggccgagtccctctggaggatcagtctgtagagggatgtgactaaggcagcagattccgccaggattctgttagacacagaggacacaaggtcacctggccaaaagtggaggtcaggaagactcaagatctgggtccacctgtttcattttctcttagcatctgccctggcctgctgtcgtaaatcatcatcaccgagcttaaaaccaccctgtcgttcaaaaaaaaaaaaaaaaaatgagctatttggtttttgaacactttccttacagtgcgtagcagtttgttagagaggtgggcaggcattaggattttgtttataaccttggaataaactaagccaacagactgtattcttgcagggttaatgtcccctgctttacagtatgggaatgcccaacgaagtttttattatagagggtggaatatggtgcagtattcagtggagacaattgccccgggagtgcagcgcagaaagccacagctgcatctccacttggtgtcggccgggagctgcctcacctggggctccagggtccctttgagaccgcagttccatagcccgtgggtactgtccttgtgtcatcatcctctctctctctctctccattccagtcattcactctctccccctctttttctctgactgcctccaggcactttctttagcacagagctctggtgatacctcccactggccttgggcacccttcttcaaggccactcaccctgcatggaggagaggaagggaaggagtggccaattcattttcgtaacaaacacccaattttgtttttctccgtggactatccagatgcatgcttcttttacagttcatgtctgcgatactttgtcccttagagaaaaaagctgtatacaaatgtgaaattattccaattatctaatctctgttgcattcctcagccctgcaaagagttaaatgatgtgtaaaatcacctgttagcccgcattagacagggctgtatttacacacccagaggtggcctgtgaattatttaaccgaagggactcttggctcagcatctggctagacactgttgagcccaagttccttaggaggtgcagcctgtggccccagagcttcctcttggctggggaaaccgtctgacagacacggtgggctgctgccagaaccaggtctccttgagaacaacttgaactaagctcctcccagctccagatggttcacaaactagagaggagttttgcagagtcctgaacgctttgccaaaaaagagcgttggccatcttccaggccaggcggtaggtttgcctgcatgctgtgaatgccaggattattgttggggttttagagagtccatttcataacacccccagttcccatctgaatttggaaccaatgagagaaaaagggaaagcagtgagatggatggagatcaaaacatcacttttgtcaccaactgacctctcagagaacagggggagagtgacactggatgtcccaactaggaaccccagagtagagacacacttccatgaccagtgctggaaacccatctgcctcatgccaggaggcaggatcttgggtccctgtaccctggtgcagggaacggaaaggagccataccttctgcaagcacccagctcctcacaggaagccagggccaattcttccacctctccttgtctcatctcacttttcaggtgagcttcctttctctcctaccaaggagagggtgggggctgtggcaagagatggaggcatctggggaaaagccttcctcggggaaaacagcattccatatatctcccagggagatgggacctgcatatatttggaggaagaagtcatagagattgcaagagctggagaggattttagaagccactggaatcctctcattttactgaaggaaacagaggcacacgggtgcagcgaaaccctcatggttatatagctagtcaggggcagggctgaatttgtgtggcagtctgcagtttaaagccggtccctcatggtatggagaacacagcagtgggcatttcacacgcataatctcaccacagggggccaggctgcctcttggtctatgggactccaccccactgtgggtttcagggcaggttcccactcctacctcatctatcccttcttgggaatgggagatgcttggaggatgcacagtaattgaaatgctattcctggcaaatgatcatttccgggggaaaatgtgaatatcatgatatcaagtcaaataaagctgttaggttgaggctttgtccttgagctttttagactctgaacaggcagttgggaaggcagtcagctcctgcctgagtcactgggcaggacagccagcccagggaaagatgagggaagtgggggacctgcgttggtatctcactgggaggatgctgtggcctccccattcgatggagatccttgtcaggcctgcttttgcaaatgctcagaactccaggcagctctctggccctcttctttctgtcctctccatgcagctcccactgctgtatttactcggttggcactttccgctgtcagaatcacatttctcccagccactcactgtgttgcagaatctgtgtattgtcttttcttcagctggtgttttgggcttaagccctgaaatgctttgttctgggccccactacagcacccatactgtgtgctagagaaaacaggaaagggccctcaccatcacacccatgaccttggggaggccagcacctttgttgtcatacttcccaaaaccctccatcccctccctgccagaggagctagcacaatctagatgcccactggctgaggtttatttccagcactgcaaggtaacaggtacacacatacgcacaccagatttccattcccattaaatctctgcatccccaaatgagctacctgttggcaaaagctttttatctgtcagaagttctcaagtggaagttgtctctctctctttgctgcacgtgtgttaccacaaatgcggattgtgccggcctttctccatctcacccacaacctccccttaaacctccatctccaacacccccgagtcttcaatgcctcaggagaattctgaagccagcatataattgctgtccagaaagaggccccgtgggaacggaaaggattttgtgtgtgctcacccctacatttaatggggccatccttccccataaggctcagtgctgcaaagccaggagcccacccccaaggctcatgccaaaccccaattatctggagggcaactggccctgggagctgggccaagcacagcccctcctagctgcggaaagagccttcctatatgtctcgtttgacgcctacaaaaacctggggaagctggcagggcagggggtggggaggttaagcccatagggtggacaagccacagggctctgctccctcccttccccctcatttcttcacccctcccccatgaaaccatcaatcaccttgatggcaggagggaggggtgcttggctgaattgacttgaaaacactcagaaacccaaattgcacccacagaggcactcagaattcagggagatgagggatgtccgcctgaaacacttttttgcagtaatgtgttccgtgatggaagtcatctaattcattcatgaggggactgagacctcagaggaaagtggtgtccctgaaactagcaagggtcagaactacttgcagagaagccactaggaaggctttccagatgagactctccccctactcccactaatattagagggactcccctccctccagcatctccccacagggtctggctgcctcaggcttcccttggctctcagagatgcccttccactcaactgctacccacatgcttctacctgctgcacacaccctttctgtctgcagcctctgatatggtttggctgtgtccacacccaaatctcatcttgaattgtacctcctataattcccttgtgtcgtgaaagggacccagtgggaggtaattgaatcatgggggggcaggtctttcctgtactgttctcatgatagtgaataagtcttaggaggtcttctgcacaagctctctcttgcctgccaccatgtgactttgctcctcgttcgccttcctccatgattgtgaggcttccccagccatatggaactgtgagtcaattaaacctctttcttttgtaaattatccagtctcaggtaggtctttcttagcagcgtgagaacagactaatacagcccctcccctaggctttccctccttagagttcatgttgcagaccacttttccttccttctccgctactgactgcccccatccctgtttgtccagggttctcctgttttctgggttccctgatgagagttagttccttttagggactaattcgtcctagggaggactagattaatagactaccaagtcccctttccaaactgacttgcattttaagatggaaaagtgactcccagggacagggcattggctcaacaggtgcttctacagcttggccgtgacagcctgtctctacatagaaagggccaggggctgcagtctttgcttggagctgtgtttgtagaacaagcacactgtttttaacgtggtttatggttttgtttaaatcaggagtgtcgaatcttttgtattccctgggccacaatggaagaagaagaattgtcttgggccacacataaaatatactaacactaatgacagctgatgagcttaatgttttaagaatgtttacaaacttgtattgggccacatgtggcctgtgggccactggctggacaagctcggtttaaattgataagatattcgggaagaagatctaatcactctcctgccagcctctaccctgctgctaaaatgctttcacaggatctaggtcactggctttgataatcaccacagcttgtggatgtcctcctaagtctagtgccggaagggaactcggtattcctcagtgtgaactggaagcagatgaaggaactccacctctcactcaggtcatcatgtttctgttaatgcatcctgagatcaaattcacctttttcttttgctgccatattatattacaatttttcagttgacttaattgcaaagtatcttctatttgggctactgagtcacttatctctcaaattgtgtgttgttctaactatatatctatgccataagtataagggtttacatttattccttactttatgtcatcttaaaacaaatgaaagactactctaatcatgccacttctcactcctgattctagaaaacagtgtctttcttgaccctcctagttttaaatctggactatgaatctggcattcattcttatcccctaacattagacagagtattggctttcagaaagctaagctttgaagtactatatgttgtgtggcttactggagatcagacaatatgcaagaagtcaaattagttagtttggctcatggaaagctgtctaatttggaaataattaggtgtcatctcctgagagagagagagagagagagagcgcgcatagggagaggcagtggggaagaggaagagagagaggacagaaagggaagatgagagaaaatagttttcattacatgttaagcagaaagagttggaaaaaaataatttctatgatctgcaaagtcatttcaggagtacattagcttgctagggctgccatagttaagtatcacaaagtgggtgggctaagtaacagacaattattaactacagttctggagaccagaagtctacgatcaagacagggttggttccttctcggggctgccaggaaaggatctgttcccagcctctctctctggcctgtagatgactttgccccctgtgtttcttcacagtatcttccctctgtgtgtgcctgtctgtgtctaaatttcccctttttataaggacatcagtcattttggattaagatccacactaacaacctcattttaactcgattacctctgtaaaggccctatttccaaatgagatcacattctgaggtactgaaagttaggacttcaatgtctcgatttggagtggggcacaattcagtccataacaaggggattcccaaagagttgtcataggaatatcacccatcaggcaaagctcctggaagcagatggagccaccattaggaaagtttcccatgagactgtggtgcttctgatgtggctcagctctggaactgactcccacccccatcacccatttcaacctctaacccccaccacctaaccaacaccccctcccctgtaaaagcctttcttcttaagtcaggggtaaactttccacattattatggtccgtgtttccaatgcagtggtttctcagatctgcatcgctcctctctacctcctggttccctgcaactccttaacccacaagcagaggaaggagaagagaaggaccctattgtttagagcagaggtgctgggttctccctctacttacaaccttgccctctctcatttctcctgatgaccaggtagggtagacagcaacatccccatccaaacatgagcagtgaggtgacctggccggttcgatgagtggtaggcagcacagccacaggccatctccctcctaaatggggctgggcccaggggttttcctaggccctgcctgactatgctgcaggctctgccttacacttgctcatcctcctgttgcagaagagctacagggagacaagctacaaaaaccttttaatctgtatgattaacagaagcaattggcaaatgaccctgctgctctcccaaggggaataaggggtttattttcagatgctggtatttatcccactgaatttcattgtgcagcctacagtccatcaaatgcttcccagagtcacccagggtttcttcttagattaaaatcagaattaaatcagatagatacatgctttatcaaatctcattttcttggggatgaaaaataagtttctctttcagtctgtgatttcaggaacaggaagcaaagaatttggaagtttaaaaacacctttgcctgagcctgcatagcttattttttctccaggcagatatgggcctccccttgacaaggtgctacctgtaggcaggaaagtcctgctgcttgtcctgccatgtaatggaacttgggccataaggtggataaagataaggctgctctgagaagctgtattagttttcacaatgctgataaagacatacccaagactgggtaatttataaagaaaaagaggtttaacagactcacggttccacgtggttggggaggcctcacaatcatggcagaaggcgaaaggcacatcttacatggtggcaggcaagagaaaatgagagccaagagagtgagagccaagcaaaagaggaaacccctttaaaataatcagatctcaggagacttattcactaccatgagaacagtaggggggaaacccatgattcaattatctctccactaggtcctcccgtaacatgtgggaattaagggagatacacttcaagataagatttgggtggggacacagccaaaccatatcagaagcacagaattagtgcagagttggttaatgaaataatcattttctacataggtaggggagttaaatgatcatattttgccttttaagagtatcatataggaactcttacaaacctatacaaactggggcttgttatgtgagaagtgacgttggtgatacctgcttggaaagcataggtctccaatcccagctgctgtcctctgggagctgcacaaaagaaggtctatcacatgcttctgaagggagctgtagaagcttctgtggttattcatttgctacagatagaagaagaaattaaaaccaattgtgaaggaaagggaaatgaacattattgaggagtgagtaactgtgtggcaggcactgccctgagagattttgcctgcatgctcacctaaattttagaaataggactagctttaaaaaaataaaaaataaatttgagaaataaactattatcctttagaattgataaaaagtagttcatggatattagagatattttggtaaatatcactgtaaagcataaagaaaagaataaaaagtacccatttgctatgatcagaatgttgtgtcccaccaaaattcatatgttgaaacccagcccccaatgtgatactgttaaggggtggggcccttggaggtgattaggtcattagtgttctacctccatgaatgagattagatttgaggaagcctgtttggctctgctggcttatcaggacacatggaaagtgccgtttaagaaagcagaacaagccctcaccagacaccaaatctgtcagtgacttgatcttgaacttaccagcctcctgaactgtgagtaataaatttctattgtttataagttaccccggcaaagatattttgctgatagtagtccaaaagaactaaagaactaaaatgccattgtaccttagcccattctgttgaatcctttggtggctggattgaagagctgggcagtggagagaccagccaatttagaaagactagggggtgcctggtcatgctgccttctatgtaaagagtgggaagtggggcaatgcagaggacattttttggtgcaggaacaccatgaggggaaggactccaagtcttcagatgagatgatggtctctgggcagtcagttacagagcaggaacagcactctgatgtcacttggaaaggcactcatgaaagcagcagagcctgagctggtgtgttcggaggcagcattaaaaatcagcaggaaaggcatgagacatgaaaccaaaaaagggatctttgctgctgggtctcaggcaacacaaggaagaggtttgtcctgggaccccctgtgaggttctaggacctcaggtgctgttgggatcaggcaggaatttcctgaagtcagccttgtggttgcacctccttctttgcggccctcctggggactgttcttcttttttagactcatttaaaatcctcaaggggcccctctgctataagaaagcaccaagggaagggccctgcctttccagtttcccagcacctagcatgcagtgagtgctcaaatataatttatatttggaatgagtgatgattctctctgcttcccctttgggactgaccttgatgctcatttctacctgattttgcttataaattgtgaggagagttctctacactacaatttatctcagtatccctccccagctggtggctctcatgtgctcactggagcagtctgggacatcaaacatgaacaatgacatagtgaaagaagaaaatgcctggggaagataatggcactatctggagcagggagcctgccatctaaggaaatggtaaaaagaaggaggctccttagggcaggtttcaaggggccagaggaagccccaaatgcgtagaatcacagccaggtgctcaggaggggcagcagaagcagccctcaggacgaagggtagtggtcatcgtgcaaggcagacaagggccctagggtgcaggcaggctgggaagatctccagagaatgaggtgggccatctgggggcatcactttgacctgtagacaaagtgaagggagaggggagggtctggtgatgacagcctcagatgcagactctttaagccttctcaaggctttccagtttttgcagctgctgaggaaacttcattctcacccttcttgttccatctgaaaatgcacttctctccagagctctgggagactgtgaaaggctctctcattgccctgaaatatttttttaaggaatgagtatgatcttttctattctctacttctgtcccatgcagagcagatgtagaggaccaggagtgattcagagatgagaactgaatcttccctccagaaagttatgttccagagggaaagaagcggaacttcagtaacagagaatatgaaattggtcctaagtagaggtatgtggctctcgtgactggagcagagggagaaagacttgattcaggttcttgcctcgcagccttggaatgggaaaaaggaataaaaaatatagaacatgggtattagttcattctcacactactataaagacatagctgggaatgtgttatttataaagaaaagaggtttaattgacttgcagttccacaggccgtacaggaagcatggctggggaggcctcaggaaacttacagtcatagtggaaggcaaagaggacgaagtcatgtcttacatatctgcagaaggaggaaaagagcacaaagatggaagtgctacacacttttaaacaaccagatttcatgaaaactgactcactttcatgagaacagcaaaggggaggtctgccttcatgattcactcacctcccacgaggcctctgctctaacactggggattacaattcaacatgagatttgggtggggacacagggccaaaccatagtaacatgtataatacatatgtatgcaagtactggaatatcaagtttcctggaggaagtagcttttgagcagggcctagaagcatgccaaggatttggatgtgtttgttgtgggtggatgaagtccatgaccagcaagcagactcaggagagttttgcagataagtgtgtccagaagcaaaacaggctgggaggagtggtggtgctggaaaggtggcagatgccgaatgatggaggaccttgaattccatagtagggaatttggcatttattttgtagctgtgggaagccatagcagtttttcaccaaagagataatttacatcaattattccaagccctcagattcactccagttgctagttcagttgtttggttcaaggaagcgtcagaaaggaaatgaaccagaaaggatgagtgatcctagagtccagggtgtccttggggtcagagggaggacaaggccttatgttccctgccttttccaggaggaagaaattgtagtaatattccaggacactggatggacttgtttttctttggaaacaaggttattgacctctctgccgcagtaagagaaaaatgatatatatgttagaacttgaatatttttgtagaaacttaatattaaaggccttatgttcaaatatgcagcatttcacagtgctggttgaattatttgggctaggttgccacatggtgttccatgtacaattctccttggtaggctgggttaaaaaatgtggctaggtaaaatgtgagatgagaaataaaaaaggatctttgttttttcatgcttgtgatacttaaataggctactgtgacccaattaagaagctcccagaggccaggtgtggtagcttatgcctgtaatcccagcactttgggaggccaaggcaggcagatcacttgagttcaggagtttgagaccagcctggccatcatggcgaaactccatatctcccaaaaatacaaaacttagtcgggcatggtggcacacacatgtaatcccagctacttggaaagctgaggcaggagaactgcttgaacccaggaggttgcagtgagccaagatcaggccactgtactctagcctgggtgacaaagtgagactgagactctgtcttaaaaaaaaaaaaaaactatccaggcgtggtggtggatgcctgtaatcccagctacttgggatgctgaggtgggagaattgcttgtacatgggaggtgaaagttgcagtgagccgaggtcaggccactgcactctagcctgtgcaacagaggctttgtctcaaaaaaaaaaaaaaaaaaaaaaaaagttcccagaaataacctctaagccacccatctaattggtcccagagagatcaaaaaaaatgcagcattgaaaatggcgtggaggcaatgacttagggtttatagacaggcatcttccctgtcgtcatccctgacatcttccccaagtgggctaccacaggtcctaggtgatgactggttaggccatgaagctgttcagagggacagagagctgcagagtttggggaaatccaccccctgcttccccagaaggagaagatgcatactaatctgttttggagacaatgcagaatactgattagccaaatatttgctggtgatggggatcactgtgtgtattcgttttctattgctgctataacaaattaccatacacttaatggtttagaacaacataaatccattcattatcttatagttctgaaggtcaggaatctgaaaagatctcactgggctaaaatcaagttgctagcaggactgtgtttctttctggaggctctaagggataatcttttttcttgccttttccagcttccaggagctgcctgcattccttggcttgtggccccttcctctattttcaaaatcagtaaagtcccatctatctgaccccttttccatcatcacatctgtctctaaccaactatagctgggaaaggtcttctgctttcaaggacccatgtgattcactgagcatacctggataaccagggtcatctcccatcttaagatccttagccttaatcacatctacaaagtcccttttgccatgtgaagtcacatattcacagattccagggattaggacatggatctcttttgggggaacatttttctgccttctatagtgtgtattaaactttgatgcttatggcatggccccgttttcgtatcttcttccactcagctaaagccttaggtgagcccgggccaccctggcagctgccctggccagctgatgtggtgatccatggagccagctctggttcatgccaataatctcatttatccagcagtctcacttggccttgaacaatttaccgttcccaaatatcagcatgtttttctgtaaaggagtgatggttcccaacaagaagaggttgacacactcaaattcaggtaatttgaggagattagaataaaaggattttaggtcttctgcggttgctagaatatttcattggccagtatctattgtcctcatccgcactgttgctggccatctgcggtcagagattcctcagtccagggcctgaccaaaaggacttgctccacttacattgcaaagcaaacaacagattcttaaacaagaaagatgatgccttctaaagcttggctattccagccaagctcaggggaaagacattttccctaaagtatcaacaagccatttgatctcagacttagaaggtcattcttgtctgcttttttctcccattagatgaaagaaaatgaaatgttttccgtaaaagtaatttatgaagcactccatatggcaatattaaaactgtaaaagtaagcctccaggggacaaaacaaataatgctgtgtcatccgtctgccctggtactgtccctgggtaatgtcaggcacagaacgttggggaactggctccccactcaactggtacttggatgcctttggagcttttccttgaacattgttgctaaggttcatgaaatcttcagatttttgttatggaatccattcgcaaagcaaaatgatcttaagtgtaaatactaaatttactgtaaattgcagacatcactacctccaagacccttttaatatattgagtcccactgaatgctggaatccaagataaagttctttaagaatatagcactcatgtcattcatgtattcattcgttcattgatgcagtcattcaagaaatatttactgagtacctattaggattcagtggtgagcaaaccactctaatgggtgatacaaatgcaaattagagcgatcgttgatatggagaaaagatagagggtttaataagagcttataacaggataagcactgggacaccatggacagattttaggtaggggagttaaatggtcatattttcccttttaagagtatcatataggctgcagtgtgggaaacagatcagagaggcttcagggcctgcccaaccatcctttacgagtgttgtttaacgcaaggtctcgtggtagacagtgttacatggttaaccccatttccattctcctcttgccctgcttccatgtggtatagaggctggaaaagttaaacaccttcttccccacctcctgtgcagctcagtgtagtcatgtgaccctgctctggcctgagacttgagcagtgatctgttgaggtcttctgggaaggaatatgcttttcctgataaaaggaatgagtgcagctgttccccctccccctccttcccacctttcacagagaagggatgactagagctgggcagccatcaggcaaccacaagggaaagaccaagatgttggtgttcatagaatagagcctctgcagcaatgtcagcaccacacacatatggactgcttgttatgtggaaaatatcagcccccatctttggagattggatttttttgttgtggttactttccatgaaaagcattctaaacagatacagtgattcaaacataggcttagccgaaaacaaattaataggcattttgatcattgtcatagttagcgggtggaatccccaaattccacttgtgccattgaaattgcagcctttgaatgggatgataaaagagggttggaaagaagaagggagccgtgatggttttcttccacaggcctgtggtggcattcctcagtgtttcacttccaacctccttggaacccatgcttatcttagcttcagcctccaacacagccttaactgtaagcctagttccctgagtcactctgaaatgtattagtccatgaggaaggagaacagattctgtcttctacctgttttcataactgtagaaatgaacacagtgcatggcacttggtaggtgctcagtgaatgtccactaagccagtacgtacacacaaatacatgcaaaagttgaaaatcgcaatgcattgtgtctttaaaaataaaaaagagaaatagcctgatcttttggaacacatatggggcagagcctgctcaatgaagcatgcacattttggattaagaaatatgattatcatttgtcagctctgatttctgcctctgggctgataagatggtgtccgaggagtcattttcactcctttgcagacaccaaaacagaaggggtctttgctgaaaggtagactctgacgtgacagtcattagtagctagaaacaggcaactgattgcaaagtcaagatgaagtgcttcagtaaaaagaaccttcatgcttgaggcatactctttgcttctttgttgaagttgtggtagatttttttaaaaaacaatcacaatatagtttgctatactttaagtttttaacatctccactggggaaaaattgaaggagctaagtaaattagctcattggatcatgaatttatagaaaaaaaattaatattgccctttgtcgtttctgttaggagtgtcacgggtcaaagcagagacaagaggcatggagaaggagcagtgtgagggcctctccgggtcatttctctgtctggcttctgatgctatctgcccaacacagtttctgaaaacatcagaaactccccagttttgcccaacatgcttcccctaccttgcacctcttagtgcagagacatgttctgtgagaatccacctggtaagacagacaacatggagaggaagatctcagagacctggcttcctttcctgcccttcccttgcagacagagttttactttgtgaagtctccagtttcagaatgagaaacctctgttaagcaaccaggcctatcactgtagggatgagaaaagtgaagtccagataggtgaagcaacttgtcccaggtcaacacagcatgtcagagaagctgaggccagccagtctcctgggttctcccccatgttcttcctactgcccctctgcggcttccatttgtaaagagaggattgcttctcctcactcctctcgcacactcttgaggctatttcagtgaattgtgtctatctttttatatttcccatttaaaagaaaacccactctatggcataatggtttccagtgtcctgctgtttggaagaatgttttacctgcctgtcagtgctgagctttgagctccttgaagaaggacattctcgtggctgtggcccatccaggcagaaccagcctagctggccaagtggtttctctgcatcgtttggctgtcagataagggccacctgcttattgattggcacagtgacgcttaagtccaaacatcctccctaatgacacagaacttcatattaaaggatgtcagggaattgattttgctcttctttaggaacaaaagatgtcagaagttagaaggaactgaacagtcaggaaaacgtaagtctctataccttcccatcaccccatccctgacccacaagccatgatcggccagtggaagataaatctaaccaatcccatgggacaaagggagagagccctgcacagcaagacagcagcagtcattgggcagaaataaatcatgagatggttgagaatctgattctctgggtcaatttctctgcatcctcctctgcccttttaggcctgtgctaaactttccctttgatgcaaatggtattaagtgccttgtgtctgaaaaggttgttggcaggctttggttgagaacataaagatgaatctttgttctcttgtctataaaatggggatataataatctacctcctgtgagaattcaataattttataagataaagctcttagagcagtgcctggcccagagtggatactcaactaatgttaactaagaaaatgaaaatgaaaatccaggaatagtctctgcctgcaaaatgttttgaatgtaaggagggagatgagacgctgtgtatatatgcctctgttctgtatttttaatcaactactaaggccatagagaacaaagagttacccctttttaaggtaaaataaattatactcattgtccagcaaggaagaaatgaattgaaaatcctagaggcagaaaagtgcagagtttggagactaccaggtggcactgagactaaaagctttatttgccatgttcagctcaagatttaatgggttgtatagtgtaaggggctaactccaggatctgctggaactcactctgggatccacagcaaacaaagcactaaccttggcatatggcgctgcgagaagtttcctaggatcagccaggctctgggccactcactgggttcatgcctctgaacattaccttccaggagctgcccccattactgaacctaatacgctactcagaagttttgtaaccaaggttttctaaaagtctgagaaatagaagatgaactttagatttgataaacagggctgtacactggagtcaggtagaggtgagtaggaatcctggccttgccacttactagctgtttgaccttggataaattgcttaacctttctaagcctcaatttcaatgtctttattaaataacttttatgaccgggaaatcaattaaataatttatttaaaatacttagggcagtattgatcatgaaatagatgttctgaaaatacttataatgattttgatcagttcctgagagcccacttgtaattttcattgggtctgtactcttgggacttctccagaaaccatgacaaggaattttagagagtattacccgatattgtagtggactgtgctcaagaatcaaatacaacaatgtcaaaaatttgtctgacacaacaaagaaatggactacctgaaatagtatatatagtccctaagagttttaaaatagatggtggatggtaataaattgaatttctgcgttcttagaaagggtgattcagagataccccaattctaagagtcactgacactgaatgtcaagtattttttgtggcttcagaaatttctgataaatgcattttttcagagtgttgttgtatcataactttgctgtagagcaaaccacttcaaacttagtgatctataaaaataaacatttatggccgggcgtggtggctcacgcctgtaatcccagcactttgggaggccaaggtgggcagatcacaaggtcaggagatcgagaccatcctggctaacatggtgaaaccctgtctctactaaaaatacaaaaaattagccaggcgtggtggcaggcgcctgtagtccccagctactcaggaagctgaggcaggagagtggcatgaacctgggaggtagagcttgcagtgagcctagatcacgccactgcactccagcctgggtgaagagtgagactccgtctcaaaaaatatatataaaataaaaaataaataaacttttattgcttgctcatgagtctataggccagcttaggtttggctgatctagcaatgggttcagtaccatttgctccagatgtctctcatcttccttgaaataacaactattctgaggcgtgttcttctcatggtaagagggcaagagaagggagtaactacagccatgcaggtacatagcaagtccctgttcatatcacattcaataacaccccagtagccaggcaaatcatatggccaaacccgaaagggaaaaggtagacactgctcactatgaggccaaggcaagtattcaggtgtatattaataccatgggggagtcaggaactggggggcaataattccttcttccacacctgtgatgttgcagactgttgctggagtgtagtcttctttctgttagttgaggggattgtttttttgatctagctgtaacccctgatgagtgatgtacctcttagtaaattgtgggcaaacataaggaaaaaggacctctttagtaaatgagccttctaagattcagtcgtgtggtgaaataactaaactgagtggaggacaaagaagtcacagaaccaatccttcaaatccagcccgcagcagcagaggtgtaaacagttactatctaatgtccactccggggtctacctgaattgaattgttggtttccttccaattctcaatgattttctggccattttcatagaaaccatcaatgtaactgatacttctggtttcaaataatatgctagatcaaaagcataaattaccttgaaaatgtgaccatttttctagctctccttggctatcaataaataatactcaaattgctctaaattgttggattgagtttaggagacaaaggccagcagtaactgagatgattaacatgaattgggataaaactccctcttcagttttcatctaacagaatgcaggtcttcagagaatgattgtcttttctagcataatactcatctacctcctgaagggctgggagcttagaattctttctcactctcagtacttcttagagaaacccagaagagtccagtgagaatggtttccctgtttggctgattttctgggaggcagaatggctcaggggttagatgccattctgggatctatggctggattcaaacttggctgcacacctgggtagctgtgtgaccctgcgaaagttgcaaaggttggttaacctctgcagttgtccctgatgttgatcacagatcttcagttcccctttcctcctgtcacccagaggactgagtccctggctcctttgtggttgggtggtgctatgtgaccagttctggccaaggattgtgagcaaacatgctctatgtaacttctggattacactatttaatacccagtgagaaactctccagaattctctcttgtccccctggcacattgaccagcaacatgcaaggtgatgtaactccaatgagtagggttcccttgttgacctacactagacatgtagcatgacagagaaataacctttgtgctaagccactgacatttggggggttatttgctgccataacttaatccaccctaccctgattgatgcacctcactatatctttgtttctttatgtgaaaaaatggagataatagtagaatctatttcatcaagtaattatgaggactaaacaggataatgtgtgtataatacttagaatagtacctagcacataataaatttttaatatattttagctatttatgatgatgatgatgatgttatgccgtgctctaactttgcctctaacaagttatctatttctatcaaacaagttattagtcatgtgtcttcaagaaaatcacttatcatcaagttgcaatcatagtatgttagaataagtgagctgtaagactaatttctagccttatgatgtgagcctctattaagaactcactcagagactccatcctggtgtttcaaagatatttctattggttaggaaaataaaacgtgataatactaaacattattttctccccttcagttgctctcccttccccaaacaaaaagatgtatccttattacagaattctttctgtatcctgttctgaagatttctgctcaggaaattactctggctcgtaaattattaactacaaattggttttccggtttaggcacctacaccctcatcagtccatccccattctctgttctgttttcaccagtaggatgtcaacagtccactatgatcttttttcctgatagcatggtcttaccaaaaggagaagttcctgtccttgaccaccttagtccaggctaaaatagctatccacataccaccactcatgaccactgagacctgttttccaacttcttcagatcagagctttccatatctggtttttctctcatgttactctagatgtatccttctctagtcccaaaggtagccctgtctgcaattcccaatagcagcatgttaatctatgttaacatattatattgaaccataagaaattgcctttgtggaaggggtgggggttgaatatagaaatttcatatggttcaacctatatgtaaacccaatttggaaaagaaggagactgtgatcacatacctattaaattacatgttggatcccatcaagaatcctaatgtatttcttcctccataccttgttgaactgggatcttgttccaggacatgacttatgctctgtatataaccttcagacctccctatacccagcacttggtagatagcagatactgatgctgtatttattgaccaactagatgggagctttttgtgatatctattgttgacatccatgtttatacatttgggctgtttaaaaaggtaccatttataattacattatgggagaaaataacacttcttttctttaacctctttcagattgaagacatcattacaaagatgcaagatgacaagacagggggtgtgcccatcagaacagtcaagagctttctctccaaaatccccagtgtcgtcacaggtaacaccctccttgcaaggtgttggtaacagtcagaactaccaaagagttataagtctagattgcggcctgaggggtgtctgaagatctgtgaatagtaaaaatgaaacattcagtgtgtttcttgactcaggtcccatcctagtcttagtttccaggaagaagctacttgttgcccatcattaagaatgaccttaccatgaccagcccttcaagtgcatgtagattgaggctgctgggaataaataaacccattaataaagtggcgcatcagcaactttgcctgtgggatacacacaagcacagaaatattaaagaaattaaacaggtttttaagaaagtgttatattcaaattctacaaaatgcttttattttcagttttttaactcagtgtacttgacctcctgaaagagaggttttaaactatttttcttcattccttatattgtgctttgtgtgctcatctttcttttaaaatattttattgtgaaatatattaaaacacatgggtagttcaaaaataataaaacacagtacatgtacctaccatcctgccttataaagaacattattatcaatatcttagagcccccttgggtacctactgtattgcatccacttccctaaacactatctgcttgtatactaatcaattcattgtttttcttcatagttttactacctaggtatgtatcttttgctatccaaacaagtaaccaaataaattaagataaaattttagatgattctcttaatctgcctatatgcttttcaaaattcgggaaccaaaggacttagttttcactatataccttttagaatggctaaaaataaaaatattgacagtaccaagtggtggtgagcatgtgaagcaactggaactctcacatattggtgatacgaatggaaaattgtgcagctactttgggaactagtttggcagtttcttacacagttaagcaatgcttaccatatgaaccagcaatcccactcctgggtattcacccaagagcaatgaaaacttgtgtttatacaaaaacttgtatgtaagggtttatagcaacttttattgaagtatactgaagaatatagcaactttattcatcatctccaaagactggaaacaacccaaatgtccttcagtgaacgggtaaatggataaacaaactgtagtctctccacaatcagcaacaaaaaccagggaactattgatactggtagcaacttggattaatctctaggtcatttttctgagtgaaagaagcagtctcaaaggttacatgctatgtgatttcaggtatacagcattgtatacatcacaaaaccgtagtgataaagattagatcagtggtttccagcaactggcatttgcagggcgagtgtgactgcaaaagacaacaggagggagttttatgagatgatgatgatgaacagatgaacagttctgtatactgattatggtgatggtaacatgactctatacataggccaaaattcatggaacaggccaggcatgatggctcatgcctgtaatcccagcactttaggaggctgaggtagggggatcacctgaggtcagggggttgagaccaccttggccaacatggcaaaaccccatctttactaaaaaatacaaaaattagccgggcgtagtggtgcgtgcctgtagtcccagctacttgggagactgaggcaggagaatcacttgaacctgggaggtagaggttgcagtgagctgagatcgtgccactgcactccagcctgggtaacagagcgagactctgtctcagcaacaacaacaacaacaacagaattcatggaacagcacacacacacacgcacacacagggtcaatattactgtatattaacctaaaaaataagtagacccagttgaagtaagtatcccagctcattattgagactgtcactctttgaactcaggtactgtcttactcagctcaggctgctagaacaaagcaccctacactgggtggcttataaagaacagaaattcatgtctcacagttctggaggctggaagtctgagatcaggtaccatcataggttctggtaagagcccattccaggttgtagactgctgacttcttcttgtatccttgtttggtggaaagaaagctagatagggggccgggtgccgtgactcatgcctataatcccagcactttgggaggctgaggtgggtggatcacctgaggtcaggagtttgagagcagcctggccaacatggcaaaaccctgtctctactaaaaatacaaaaaaaaaaaaaaaatagctgggtgtggtggcacgtgcttgtagtcccagctacttgggaggctgaggcaggaaaatcacttgaactgtggaggttgcagtgagcagaggtcacgccactgcactccagcatgggcaacagagtgagactccatctcaaaaaaaaaagtaagctaaatagctctctggcctctctgtaaagggtaataattccatttgtgaggggccctccttcataaactcccccaaaggactcctaatgccatcatgttggggattagatttcaatatatgaatttggaggagacacgttcagtccaaaatagagcccagatagatttgggtaatgaaggatacttgtattgttagtgttctctaattttaaaatttatgtaaatgaaattttactatatatattattcatgtataatatacagtataatatagactatgtatgtaattttactatattatttttcacattcctggattttgttcaataatgtttaagatgtttgtatctatttcacaggccacactgatctgttgtttttcttaccattgttgctggtttgggtatcaaatttatgctagcctcataaatgagccatgaagtatctctcttttcttgatatcctgcttttctttgaaaaataattgtccctttaatccaggttttaagtatgtaatttcaattattttttatttttaaaatttcctctggttctttttttttttttagacagagtcttgctcttgtcacccaggctggagtgcagtggcatgatctcagctcactgaaacccccacctcctgggttcaagcgattctcctgtctcagcctcctgagtagctgggattacaggcatccgccaccacacctggctaattttttgtatttttagtagagacagggtttcaccatgttgcccaggctggtctcgaactcttgaccttaggtgatccgcccaccttggcctcccaaagtactctggttctttttacaatatacttggtcattcatttttttaaatttattcatttagatatttattgagtgttcactattttctaagcattgttaaggacttgagattcagaagtaaatgaaacagataaaaagttctaccctcatggaatttatattctagtagaggaggaaataagtaaggaaaacttgcagaattttagattgtgataaaggccaaggagaaaaataaaatacacaaaaggatgggaagtgttggagtgttgcagctttggaataggtgctcaagaaagagctcctcgagaagatgacatttgagtaaagacggaaaggagatgagggattgaatcatatggatattgagggagagagcatgccagacagccagagctcagtgcccaaggcaagagagttcctggaacattgaggatctgtgaggaggagccagggcagctataatagagtcaagaaaataaggagagtggggatgaagccacgtgagaatggtgagcttgatcacttagcctcttatcactgcaggattttgcacatggcctgacatgctctgacttacctttcaatgagatcactctattatattcagaattccctgggggattgaggggttaggtgccagataggaggctattattaaaatggtgcctcagactaggtgatatggtttcactctgtgtccctacccaaatcgcatctcaaattataatccccacatggcaagggagggacctggtggtaggtgattagctcatggggaaggttctcccgtgctgttctcataatagcgagtgagttctcacaagatctgatggtttaaaagtgtggcacttccccctgctctctctctctcctgccgctatgtaagacatgccttttttcccctttaccttctgccaggattgtaagtttcctgaggcctccgcagccatgtaattaactgtgagtcaattaagcttctttcctttataaattacccagtctcagatcattctttataacagtgtgaaaatggactaatacactaagctatcagcactggagatgtgtgaagtagtcagattcggattcaagtctgaaggtagatgatatggtttggccaagtccccacccaaatctcatcttgaattgtataatagttcccataattcccacatatcatggaagggacctggtgggaggtaattgaatcatgggggcagttacctctatgctgttctcatgatggtgagtgagttctaatgagatctgatgatttcataaggggcttttccctgtctttgctctgcacttctccttgctgcttccatgtgaagacaatgtatttgcttcactttctgccatgattgtaagtttcctcagccgtgctgaactgtgagtcaattaaacatatgtcctttataaattacccaatcttgggtatgtctttattagcagcatgagaatggactaataccgtaaattgttactaggtagtggggcactgctgtaaagatacttgaaaatgtggaagcagccaggcgcggtggctcatgcctgtaatcccagcactttgggaggccatggcaggtggatcatttgaggtcgggagttcaagaccagcctggccaacatggtgaagccctgtctctactaaaagtacaaaaattagctcagtggtagtggcacgcacctgtaatcccagctacttgggaggctgaggcaggagaatcacttgagcccaggcagcagaggttgtggtgagctgagatcacaccactgcattccagtctgtgagaccctgtctcagaaaaaaaaaaaaaatagaaaatatggaagtgactttggaacatgggtgacaggcagaggaaggaacagtttgaagggctcagaagaagacaagaatatgggggaaagtttggaacttcctagagacttggagggcttagaagacaggaagatgtgggaaagtttagaacttcctagagacctgttgaatgactttgaccaaaatactgatagtgatatggacaataaagtccaggctgaggtagtctcagatggagatgagaaacttgttaggaactggagcaaagataaccctcgttatgctgtagcaaagtcaggtggcattttggccctgccctagagatttgtgaaactttgaacttgagagagatgatttaggatatctggcagaaaaacatttctaagtgcagagtgttcaagaggtgacatttgacatctctggacacaagagagcataaaagtttggaaaatttgcagcctgacgaaccagtagaaaagaaaaacacattttctggggagaaattcaagctggctgcagaaatttgcataagtaaggaggaaccaaatgttaattgccaagacagtggggaaaatgtctccagggcatgtcacagaccttcaaggcagcacctcccaccacaggcccagagacctaagaggaaaaaatgtttatttttcctcttaggtccagggccccactgctgtgtgcagcctagggacttaatgccctgtgtcccagctgctccagctatagttaaaaggggtcaaggtacagctcgggccatggcttcagagggtgcaagcctccagccttggcagcttccacatggtgtttgtcttctgggtgtgcagaagacaagaactgaggtttgggaacctccatcttgatttcaaaggatatatagaaacacctggatgtccaggcagaggtgtgctgcaggggcagagccctcatggagagcctctgctagaacagtgcagaagggaaatgtggggttggagtccccacacagagtccccactggggcactgcctagaggagctgtaagaagagggccactgtcctccagactccagaatggtaggtccacccccagcttgcactgtgcaactggaaaagctgcagacactaaacaccagctgtgcaagcagccaggaaggaggctgtaccctgcaaagctaccgggtcagagctgcccaagatagtgggagcccacctcttgcatcagcataacatgggtgtgagacatgaagtaaaaggagattatttcataactttaagatttaattagttacctattggatttcagacttgcatggggcctgtagcccctttgttttggtgaatttctcccatttagaacaggtatatttacccagtgcctgtacccacattgcatttaggaagtaactagcttgcttttgattttacaggctcataggtggaagggacttgcttagtctcagatgagattttggacttggacttttgggttaatgctggaatgaattaagattttgggggactgttgggaaggcatcattgtgttttgaaatgtgaggatatgagatttgggaggggctggggtagaatgatatggtttggacatgtccccacccaaatctcatcttgatttgtaattcccatagtccccatgagtcttgggaaggatgcagtgggaggtaattgaatcatgggttggttacctccatgctttcctcatgatagtgagtgagttctcatgagatctgatagttttataacgggcttttcctctacctcactcttcacatctccttgctgctgccatgtgaagaaggatgtgtttgctttcctttctgccatgattgtaagtttactgaggcctttccagccatgctgtactgtctgtcaattaaacctcttttctttatttcccagtttcatgtatgtctttattagcagcatgagaaccgactaatagagtagaacagatattattagcggatagatcagatatggaatgtgagaggaaaaaaaggaattagccatgatccacactttttggcttcagcaactggaaaaatggagttgctattaatttcaatgaggaatactataataggggtgccaggggttggggtggggggcagttgttagctgaagggtaagaaatcaaaacacaaattttaggtcaagttttagcgacctattagacattcagttggagatgacaagtaagtattccagtatgtggatttggattttaagggagtgtctgtgctgggttcataagccatcagcatgtagacagtatttagagccataggaataatgaggtcaccaagggagtgagtgtagatagaacacacagtccaattcctaaaacacagggtactccaatctatagatgtgagggagagaataagaaaacagcaaaagaaatagaacaagtggctggagacaaggaggaaaaatcaagaggatataatttcttggacaccaatttttctagaaagtgttttaaggaagagtagagtgacctactatagctatgctgagaagctaagggctgagaattgatcattgcctttagcaatgctgaattcattgctgaccttggtaagtgcacattctgtgaaacattgggagcaaaaatccttattgggtgtgtccaacctgagatgaggagagtgattcgaggtgctaagacagttaatcttggaaggagtttcccttgtaaaatgaagaaatgcagtcatatctagaggggtacgttaggtcagaacaggtagatttttaatttaataaaaagataatatgtttgtattatagaaatgactcagtgggggtgggggagatgatgtaggagaatgggaaaacttcaaggagttatatcaaagaataggtaagagaggattgaatttaacatgcatattggtgagtagtttcagctagaaacacatacaatttattcatagaaagaagaaaggaggcagccgggcacagtggctcaggcctctaatcccagcactttgggaggctgaggtaggcagatcacaaggtcaggaaatcaagaccatcctggctaacacggtgaaaccccgtctctactaaaaatacaaaaaaattagctgggtgtggtggcgggcacctgtagtcccagctactcgggaggctgaggcaggagaatggcatgaacccaggaggcagagcttgcagtgagccaagatcacgccactgcactccagcctgggtgacagagtgagactctgtctcaaacaaacaaacaaaacaaaacaaaaaaggaagaaaggaggcataatagatgcacagaggtacaaataagtgggcagatgtgatgggaggtggtggaagcttatagatcttctcattgtctctatgttcctagtaatctggaaaccaaaaatggtagagattttgcaagttcaaggagagatcataagttataaattagtcaactaggaaagtagagattgactggactagggaaatagaactttgattgtgactgatatggtttggctctgtgtccccactctgatttcatctcaaattgtaatccccataatccgcacatgtcgagggagatacctggtaagaggtgattggatcgtgggggtggtttcctccatgctattctcatgatagtgagcaagctctcacgaggtctgatggtttttataagtgtttgacagtttcttcttcacagactctcttgcctgctgccatttaagacatgcgtgcttcccttttcgccatgattgtaagtttcctgaggtctccctagccatacggaactgtgattcaatcaaacctctttttttttttttttttttcataaattacccagtcttgggtatatccttatagcagtgtgagaatgtactaatacagtgaccttcttaggatgattaatatttttgaatttaaagacaggtaatttttttccccatccacatttagctctgtggatttgggcatgcctcaggtagaaagtggacttaattgatgttatagcaagtttgaggttataatagatcaagacagaggcacagtaactaaaatgattgcccattacatttaattgagtaaggatgaaaacaagaacatgagatggatgaggaaccatgaagagtagtaattaccacaaattgtaagtcaagtggcaaagaaattttggagttttcagaggcaagagtaagagagctgaaaatatagtagatggtgattagatggtggcatgtttgaaattgagattctggaaagattgtgattattggcagggacaataatataagatataaccataggaacaaggcattgaaatgggataaagtgtaagatttttggaggagaggaggttaaggaactgagaggccatgatactggaagactgagctgtgtgaatattgaaatcactactgggggagtgttagagaaggtggttgtgagttaaaatctttatggaatgagaagcaaaggaccagggatcagcagatgactttcacaataagaggtacaggtggtttaatcagatggtatgggagtcaaagctgagtgtgttttagagaagagggaggggatgaaggtgatctgaaagcagcagttagtagcaggacagtcacttatctacctgtaaaccccatggtatataaagtgtgggagggaaaatagccaccacgtaagagggctgcagggaagcaggaccactggggaagaatgagaagatgaaaggaatattaactgattttatttatgattcatcatgagtccaagagggcaagtggaagggtttcaggaggagatggtgagtttatgacttgagtaataaatgcctgctgttgctatgtgccaggctctagagtagtcacagacgatataaagatgaacaaagacttgacccctgctcttaaaaagctattaatctagtgagagaaacagacacaggtagatcaatgatttatatgagctatgtgccataatagaagaatggacaaaatgctgtttgagtccaggagagagaatcatgaatttttattgggtatgtctagaatatttctctgagaaggtatatcagttatctatttctgtataacaaacccacaaactataattgcttacaactacagtgatttattgtttcttatgattatgattccatgaaccggcaatctgggcagttctgctggtctcagccatgaggccatagtcatctgatggctcaactgaggctggagggtctacagtggcctcactcatttgtttggccttggtgcttactcttaaactcttaactggggtctcagttcttctccatgtcaccttgtatctgccaataggttagattgggcttcttcacagcctcttggtcttagggttccaagcaggacaggataaaaactgcaagacctcttagggcctaggctccagaactcatacaatgtcaagtgtgccacgtcacgttcttcaaggcaaattacaaggcaaagtctggattgaagaggatggagaaaccaactccacctcctggtgtaggagtggcaacatcatgttgacattgggagacacgattcattggagggcattaccataacaatctaccacagacaataattgagaaccggaccttaaacataagtggaaacccaggaaaagtcattccacgtagagaaaatagaattttcatagcctcaaatacatgacaaacatgccaggtttcagtaagtataagcttgtttgtgtggttggagtttaaaacacatttatgtgtgtatgtatttgagaagaggagcatattggcagaacagccacaggaatgaaaaggatacaagaattacacctaataatatattataaaggaaagctgacttgtagactttgttccaaaggtggggctgcttttatctcaaaggtaacccatctaccctgctcagatggactgccgtcagaggttttaaatatgagggaattcacatccatgaagtggatggaagtttaagcaggaagaaatgaggagtgtggagactagttatggagtctagatgagggaatgtatgtgagaaataaggccatattaacgacaaccacagcatcaactgaaaccatggctgtacagccacgcatcattaaatacttataaaaaccccatgagatagaaaccgttattatctctaccaagtaatggaggaaactgctaattcaagagtaacttttccaaggtcacaccactagtaaatagcaggatctgttcctctgggccacccgtgtaaggatggtagcagtagggttcaaaagatcagaggaaacagtagaaggtatgattgacacaacctgctgacttgaaatagagcagagggtaactcatccaaaatggatacaccttaatatcatggattgaatacattcatttaactttttctcttctgaaaccccacaaaaattatagtaaaagatttttattttaaaagcatgatctaaaagttggaggcctctattacagtgatctaccatgggaaataaacatccttaaaaatcttgaaaagatagtccagtacaaagggcagtcagtgcctcactctcaagatgtgcagatgtgtgaaagactcatggagaatagtcttccaacacaggagacaatagccacaaaactcaagaatctgaaaaacaaatggatgagtggtaactgacaatagccctgaaacaatctaaccatcacttgtcagtggacaaggctaaaaaaaaaaaaaaaaaaaaaaaaaaactctatatttatatgatggagttctcaatgggctcagaaactggtaacatcagcagacttttctatctagttagaatacattttgccaacactctcacctacttaactactgcacagaccaatcactagctagtgtctattgtttagcaatatcagatcctgcacttggccagcacagctcaggctggtgttgaggtggttcctaagaccagtcaagccccaggacagaagacaaatctcatgcttacctctagttgctggcactagagtagagaattacatagagaaaaaacccaggtcactgagacccatgggtaccaaacttaaagttgaaacgcattaatacatggccaccctgttactgtggcaagagaagctgtatctacatgggacagtaatcagcccacacttcagcctttccaccagctcagcagcctccatcagactttctagccatttgagaaatagccagtttcccatcacaaaccagcagataccagcagatactccaacattggagcttccatttcaacagcaacagctgggggaataactttttctcttctctattgggaccccagttctttaataaaaattgaaagtaaagatgaaagaataatggacattataaggctggttaatcagcagtgtctttatttcttgcactgctacataacgtactgtccatacctacatgtgactttgctaaataaacagcaagtgatttcaatggaagaaggcaagaagatggagaccaatggcacgatgatgacagtctgctggtgaaagcttctttccaaagatgatattgatgaggaatgcatgagcatgtcccagtgcatccaagactctgtcactctcagaagctctgggaagctgcttgtcaccactttctcagcaacacagtgaaagtcagagaataatgttgataaaaagtagtatcttgctgcaaggcccgtctctacactgtcaagttaccacattgagttgaaaattttgccaacatatccagatcatcccaaaggcgaaaagagaagcaactgttaatgacctacaccaaataaatcaacaaacacatagcaatatgcggatgtgtacctttgtagtggatcaaatgagcctggacaagaaactctaaatggaaagttttagagcataaagagaacattctagaaaaagaatgtacttgccaaaaaagtcaaaactgagataaaggaaaaattgtagacctggggaatgtgaatttggaaaaataatttatgggtactgaggatagagataacaggggaggtatagctataagcagagcagaaaattgatatccagttttccagaattcacaggtgacatagaagggaaccattgtaccaagtgatacacaaagatcagagttgaagagatgtgatttcgtccacgagtccctttaaagctggctttgtggtgtgtttgtttacaaccttcctaaggtgtcgatgtctaccagttggaacagtgacacaagagatggtaggcatttcttgactttccatctcacaaattaaatttgtttggtgaattcctgaaggatccatacagagcctggactgaaagcacctgtttcgatcttatgtgctgaaagcaaaaccttttctcatcaaatgtttctcttctttgtctttctggctttcatatgtgtgatctaacttcattggttacatctttattaataataaatatctaataaaaatgttaataaatttaaataaatacattgaataaaaataacctatattcatctaacctgttttgggtaaaggaggttcctatacccaagataaggacttgaggaagttatgggtttgggagagaagacacaagatcagtcttgattatgctaagcttgaggttttgaagggttatttgggtagcactgtttaggagaaacttggaagtgaggagccaaagtcctggagaacattttatgtaagagatatgtatggatttgggagtcatcagagtctgagtgacccgggactccagggtcatgactgggaactataattttcacatcttcttctataagccatgtattagtctatctgctacccagccttgagataacatgctcacccaccccacatcttctatgattttgagtttgaaattttcccaccaatatgtaagggaaattatcttccctgctcagatcaggacaaactcataggtgaattcacaggtattgctgggatgaagagggagaaggaatgcctgttggttcacctgtgggttcgaaatgttgggattgggaaggttggcccagggagtaaatgcactgagttaggggatagatatgtttgggagaaggccaaacacaagagataaccattagaatataatctctgtcttagaaagtgaaaaattaagagctgtaaggggtgaggtttagcaaataaatatttctgagcaaaaatagagaattggagagagaaggaaatacggaagaaagaagaacccaacatcagatcaaagtccaaggctcattggctttttgcaggggaagtcacatacaaaccatctcatcttccagaagcttaagatttctgagcaaggtgcccacagaaagggtacttcagagccaccctaccaatcccttttcaggactacagaccaacctcctcagaccctctttgaatagtaagtaggtaacaaagatgatcactggagccaagatggtgagtcttcggagtttccaacctcagcgtgccagctctatccacgccccacctgccctgcaggtgatagacatatcctgggcagaatgcctgccagccccaggaaagcagccagattgtgcagctttgcccagctgtcatagacagtcattccaggataattctccatcacctgaatgtcatgaagaattttccagggactttggagatttatttcttccagaccaccctcagaaacacaaattcctagcatgtaagagccataagatgcatctagtctcacttattcttgcagtcaggaagattgagtaccagagacatgatgtaatgtcctcaaaaatcacagttaaggacagaaccaagactggaatctggattcctcactaccattgcaaactgttcccatgatctcatgcacaaaattatagactcttggattgcagcagtttcttaaaggtgtttgatgcgttctccctgaacatgagaatcacttgtgtaacttgttaaaaatagatttccaggacatccccatgggtctggactcgggatcctctattttcagcagcttctcatatttatctcctacagcctgtatgaatttgggaatgtgtaagacccctacagagtgctctctagcctctgttttaacaatctgcaatgatggatgtcatctctccttccatctttggacaactttgaccttgagaaacttttttttttgtaataaacctaccagcctcctcttgcttcactgcattagtcccaattctacctctgtatcacaaagaatagaggaatggatttgattaaaattatgcccacctagctcttccttatgaaattttcttgcacaaataattttcagaaaatatccaaggtatatacatgcatttttattttacttaacacatttttttatgaatacatttctgtcttttcattatccacaaatttatttttaatagctttatgtttacctaaacatttaaaagtattattcttacagtttcttggcaatacagtttggagtctaggctccaaacagcctatgtgacctgggttggtcactgtgtgaccttgagctagtcaccaacctctttgggcctcagttttctcacctgttaattgataggtttggattaaatgatatttgtagtccattctgactctgatcttctgagattcttcacaggatatgtataaaggcctgtctgaagttaattcttttcactttttctcacgatgttctaactgaatctacctctgagttaatttaggccaccagttttgtcttaagatgtgtgtctcagtctgtcttctgctgttgtaacagaatgccacagactgggcaaagaagagagaaatgtatttctcacagttttagggtctgggaagtccaaaagcatggtgccagcatctaatgagggatatcccatggcagtaggcagaaaatggaaggtgcatgtgtgtgaactggggatggggggtgcaaactcagcctttttattgggaacccactccttggatagctaacccactcctaggataactgcattaattcattctgtagttaatgcttctcactttttctcaagatgttctaactgaatctacctcatggaaccctcatgatctagtcattcattaatgatcccatctcttaatattgttactgtggtaattaaatttcaagatgagttttggaggggacatccaaaccattgcactgtggtacttccagattagaaaaccaaagaacaagaaacagcctctgttttaataacgtgcgatgatggatggcatcatcactcattccatctttggacaactttgacctttagaaactttttttataatgaacttccctgcctccctcttgcttcaattcattcatcccaattctatctctttctcacaaatagagaaatagatttcccaaattagtaattccctgagaattgcccaaagttaatcagtattcttagtctttgttactcttcttctgcttctgtatcactggaaggaagaactttaaaaatgcctcaaaatagagataatttgttggatgcatgtagagggctgaataatggccccccaaaatatcagcttctagttctttacatctgtaaacatttgttgataaagggtctttgaaggtatggttacattaagtatcttcatatgggtaggttattctagatcagggtgtctaatcttttgacttccctgggccacactggaagaagaattctcttgggccacacataaaatgcactaacactaacgatagctgatgaactagaaaaaaaaatcacacacacacacaaaaatctcataatgttttaagaaaattgactaatttgtgttaggctacattcaaagccatcctgagccacatgtggcccatgggccatgggttggacaagcttgtcctagattatctgggtgtgccctaaatacaatgacatgtatccttacaaatgagagtctgaggaaaatttagtatagaaagaagaggagaaggccatatggcctcagaggcagagattagaatgatgtggccagaagccaaggatgccagcagccaccagaagattccttagcacctccagagcaagtatggccctgccatcaccttgattgtggcctggtgaaaccaactgtggacttctggcctccagaactgtgagataataaatttctcttgttttaagccacaaagtttgtggtgatttgttgcagcagccatagaaaactaatacagtgccaaaattacactaagcacattatagtttaaagtagatgacacaatgattttttttagaaaaattgtgattcattaactgaaaaaagaaacaagcaaaaatttagttttcttccaaagttttatttgaaaaaatatagattataatattaattttgaaagcaaattatactaacatgaacttatgtagtagaattatttaataagcattcagcttaaattgcttaataaagttataaattgtatttgtccaggtctaatgtagtttaaaatatcttttggatatcataactaatcatattatttccacgttcgtgatggaattaaatcaattagttataaaataaaatttattcttaattagtatgccaaaatttatacatacataaaataatctcttaaaatattcacttcgaaaagtggtatatttatttcagtaatgcttccattgctttgattttttcagatttttttctccagtaagagcttttagaacttgtttaaatatcctcaacagaagcaaagccatgaattcataaccatatatacatttatataatcaaaattgatttggagattctgctttggagaatggtagactagcctactcagaccaactgtctgaatgagaacaattacaaaatctggtaaaaaaaaaaaaaattcacttgatgtcactggagagttaacaagagaataaagagttactgggccaagattcatgctaacataaacatccatagatatgatggtggccttgggtgctgtttttgccctggggacatttggtaatccaagagagcacctgtcagacgatgcctttattaaggcccatggacattatctcctatgccataggggttgtggatttgctagtttaaagaaaacacatgcaaagatgagagcttatttacctgactctggtattgactattaggttttaccatggtcagcagctgtgggctgtgtcaggtttgggtcagggagatgaggaacaaggaggctacatcttaaccgcacggggaggggacgttttaacaaggccaaaggtgatgaggtacatcagggtaaacatgtgttaggcctaaaaatggatgtcaaggcagcaactatattaaacaaatttatgatgggcagtgattactgtttacctctaaggggcagggagtatattgtgattgggacagtacctgcaagagactaccagagtgttgaaaaaaaaattttttaacatcaatcatggtaacatgattaaaataatgtaaactgttcccacagtatttcttcttagcacttttctgtttgtataatatttcacaataaaaatagctttccttttcctttttccttttgttttacaaaaagtaatttgaagtcagttcggtgaataaagtctgtaattaaagagggaaatgccaattgtggtttaaataaggtgtgactctgggtaaatgaagtcagttttcttgttgtccttaaaagctgtttcataagtttatttccaaagagcatttccaaaaacatttgtagcacagccaatactgatggaaggaagggtgtggcttttttagggccaactctgaaaatgacagtgcttaattaaatattgattatgctgtggttgccttaacaaatgtaacttcactgtaacatgttttatttaaatgtatgaatttttcttcttatgggattcactttagtaacaacctcttaaaatcctgtcaacttataactgtgaaagcaaaggcatatctctgatgctcctggcctttgtgtcattaaaatcttactctaaatgtcgcattaattcatcttttcaacatttttccttgtttgatttttttctcctggaagaaaaaatgctaagtggaatgaaggaaggaaaagacaggcagtttattaaaagtcaaaatataccatacaaacccctaattgtactctaaaatttctttttaaacgtttctattaaaaaattctgggccgggcatggtggctcatgcctataatcgcagcacttttggaggccaaggcgggcggatcacctgaggttgggagttcgagaccagcctgactaacatggagaaaccccgtctctactaaagatacaaaattagccagtcatggtggcgcatgcctgtaatcctagctgctcaggaggctgaagcaggagaattgcttgaacctgggaggcagaggttgcagtgagccgagatcgcaccattgcactccagcctgggcaacaagagtgaaactccatctcaaaagaaattaattaaataaaacattctgtttccaataagataaaatttgagaagagaatgaaatccagatttagtgtagctgacccgggatcactgactcttttttagagaaggaactgggaaactgcagtggacatcatgctctggagcaacagtgactatggatttcactgtatcatcggtcgcagcatggaattctatacactaaaatcgctggatgagatgctggtgggaagaccctaacaaaatcgtgtttctgacagaaagtgtatacacattatgagcaaggagaacattagttttcagcttagctccttgtgcagttgaatttgttactctgttctgaagacattggtgccagataaaagctttaaacacaaaacgttgttactgacatgttaatataattatgccacgtattatatatacaaaactttaaaagctaaatttagaagttattgctgtatcatttatataggctttgttctccttaaacacgttgactttaataaggcatgttttgtacaaataaagtctaattctaccatcagttgcagccacaggaaatttgaagtcatttttatataaaatttaaattccaacacttaattcaggttctatgacaccattttctagatccaagaaggaaatcattggctcaggattttctacagcgatctatcctgtatgttcctcagataatatgcccctagaatattattttttataagaattaatggcagaaacatttgagcttatcactgatggcatttgttgactatcaaaattgtctaaaacctcccacatttatccaggtataaaagtaaacttctaggttgggtgtagggtaggttgggagtcaaaagaggacactctatagagtcacagttcataggttttcctaaagaacactttctaaatctaaatttttcctcccactaagccaaatgaggagggctccagggaaatcactggtgatgattaggggtcctacaagaagcagggtgttaaccttctcactgattggattcttgctgagctgttgaacccatagctcatccttgcttctgctgccagagaggaaaatatggaaaagttcatgggccatttgccagagtttgtggatgtatatgaactgagactcttgaggctaagaggctgcatggggcagcccacaccaaaaggcaaatagggcccatattgtagtgtgatgcttaaggagaaatatatggaacactgacctccccacccccaggatccctgtgactcttggagggtcaagggagcatcatcatggagacagaagacagagaaagagaggaaaagaggaagccgagcccacccttttcctgtctaggtcctctagacaaagctgtgaagggaaaaaaaatagaagataaaatgggatttaaattttaaactggactaaattgcaagtgaccagaaagctaaagggtctgctcaagatgtcataagggaaaagtaaaattatttcccattggtacctcatcgagttcatattgttcaagaaactggatataatacctagtgacaaagagactaggacttctgttttgttcttgtcatacagccaaatattgttctggtcacacagccataacaatacccattggggcagaacactgaactggtaagaaagtaagggaaatttttagaggccttaaaatagaaagtgagaattcaggaaagtagactcgttttagattagtcttttctcagaggacatctgtccatcctgggtagtctagggcatgaattttaaaagcctatatgagtatcaagtaaaaaaattgagtagggtggcagtcagttcagagactcctgaagagcaatacgattattagatgagtagggggagaaggctttagagaaggagatgatggaaataatcgttttgtctttggctattaataggtgaaagacaggagaaaaagtctccctagaaaattcctaattccaaattctaagtctattcttgttggcgtgtctcactaaaccccatgtggcccaaaaattcaagcaaaaatttaaattgtctttttttttcccccactcagtaaagatttaatgatgaaaaaatgcaagttttataatacaaatatataaaattatgaaaacaatttttataacaatcatttgatagtctttttttaaaagactacagaaagtttaaaatataattttgtaattatagatataaacaatgaagttttataaaattaatcatttgatatttttaaaaaggctatccaaaggaatttaaaatcagaatgttgttgaaactgaacaccaactgtatctacatttatttctttttttaaaatactttaagttctagggtacatgtgcacaacatgcaggtttgttacatatgtatacatgtgccatgttggtgtgctgcacccattaactcgtcatttatattaggtatttctcctaatgctatccctcccccctccccccaccccacgacaggccgtggtgtgggatgttccccttcctgtgtccatgtgttctcattgttcaattcctacctatgagtgagaacatgtggtgtttggttttctgtccctgcaatagtttgctgagaatgatggtttccagcttcatccatgtccctacaaaggacggcattattcacaatagcaaagagttggagccaaccctaatgtccatcaatgatagactggattaagaaaatgtggcacatatacaccatggaatactatgcagccataaaaaatttaaactttctctatttcagtactgcccccagctaccaggaagaagcaaacacatctcctctctggagaagcacacattaaatacagaacaaaaaaatttccagataaaaacaaaagtcactggaaacataagaaaacaaaacaacataaggataagtcagcaaagagcacaaatggcagaatccaacacataaagattgcagacattgtaattatattcagattatagaataattattagatcatacgaaattgccatttttataggtcaaagctggtaactatctgcagttccatatgcttaacataatgtttttaaagaaataagagagtactggaagtatgttgaagaaaagaggattaaggattctcaaaaaggactagaagctttgataagtagccaaatggaatctctgcaaatgaaaaatataattgaaattagagacttaatagaaacattaaacagcagatttgacacagctaaacaaagagttgataaactagaagataaagcagataaaagtactcagaatgtatcacggaaaggcagaaacaaataatatgaaagagaggttaaaagacttgaagaagagagtgataaattctaacatctaaccaaattttgagaagtaaataacagagaaaatgggaagagcaattcttccccattgtctttattatttccttccaaatttaaagatctaatagttgacagtttttctgagtggattaaaagcatcgggttccaaaagccaaaaaaattccaagcaggataaaatgaaaacaaatctatatctagctacattgatgtcaaatttcagaacactaaacacaaaaagaatcttcaaaatgactagagagggccagctgaggagacttcacctgtgttccaagcctgagaaacagcaccatgggccacccctggcagacacgtccctaggctggctgagcagctgtgcacccatgtcctgggcctgagaaagagccccacagactgctcctggcaagcatgcccccaggccagctgagaaaccatgtgcccctagacagagtaacagccctgtggtcccaaccccagtgagccagaccccaagaaagctgacccactgtgtgcagacatatgcctccaatctgagcaacagctcagcaagcccacctctggaaaagttgcaccgctaccagcacaaactgtctaagcctaggccactgagacattcataaatatcgctagtatggattacagcttaagaaactactggagactatactactgtgtctacccagaagcaaagccaatgcactgcattgagcccacaccccaacacccacataaatgaataaatcttttcctattaaacctactccataaaattggaagaggtgactgtttcatcagatgtgtagaaatcaatgtagggacacaataaacatgaaaaagcaaggaaacagacctccaaaggaacacaataattccctagtaataaaccccaatcataaggaaataaatgaaatgacagaaaaagaattcaaaataataattctaaacaaattcagtgaaatataagaaaatatattcaatgaaatcatgaaaacaataagtcattattttaatgagaaattcaacagagatagatatcatttaaaatgaaccaaattctatggctgaagaactcaatgagtgaaataaaaaatacaattgagaacttcaacaccagactagaccaagcagaatttgttcttacttgaagacaggtattttgaaataatacaggcaaacaaatagatgaaattaaataaataataaaaaggaattaagtcaaaggatttatgggatatcattaagtgaacaaatatttgcattgtggacattctggaagaagagaagggaaaaggtgcagaaaacatatttaatgaaataatacgtgaaaactttccaagtcttgggagaaagatccaggaagctcaaagaaccccaaatagatataatccccacaggtcctctctgaggcacattttagtcaaattgtcaaaagtcaaagacaaacagcaaaagaaaagcttcaagtcacatataaggtaatctccatcagattgatagcagatttctcatcagaaaccatgtaggccaggaaagaatagaatgataaagtcaaagtagtgaaagaaaaaaaataaaacttgccattcaatattatgcccagcaaagccattctttagaaatgaaggagaaataaaaattttcgcagacaagcaaaaattaagaaaattcatcaccactagaccaaccttacaagaaacgcttaagagagtcttacatctagaagcgaaaagacaataaccactgtcatgaaagcatgcagaactataaaacttattgatggagccaatacacaaaggagaaagaaaaagaatcagaccatatcactacagaaaaacacccaactgcaaaaataagagaggaagtaaggaacaaaggatatacaaaacaagtaaaaagaaatcgataggatgataaaagtcctcaccgatcaataataaccttgaatgtaaatagattaaaatctccatttagatgtagactgactgaacagattaaaaatacaagatacaatatacagcccacaagaaactcatctcacctataaagacacaaatagactgaaagtgaagtgatggaaaaagatactccatgcaaacagaaaccaaaagcaagcagagtagctgtacttatatcagacaaaacacacttcaagacaaaagctacaaaaagagacaagggcattatatgatgacgaagagattaattcagcaagagaatataacaattgtaaacatatacacttaacactagggcacctagatatataaagcaaatattattagatctaaagggagagatagactacaatacaataatagttggggactttaacaccccactctcagccttcgacagatcatctacacagaaaatcaacaaagaaacatcagatttaaactgcactatagaccaaataatataaacctaacgacatttacagaatatttcacccaatagctgcagaatatgcattttttttcatcagcacgtggaacattctccaggcttgaccgtatattaggacacaaaacaaatctcaaaaagcttttcaaaatcaaaattatggccaggcatggtgtaatcccagcactataatcccagcactttgggaagacaatgcaggaggattgtttgagcccaagagtttgagaccagcctggacaacatagtgaggctttgtctctacaaaagattaaaaaattaaccacccgtggtgctgcacacctgtggtcccagctactcaggcggctgaggtgggaggctctcttgagcccaagagggttgcagtaaggatgcagtgagccatgatcatgcctctgcactccatcctgggcaatagagtgagactctatctccaaaaaaatattgaaattttatcaagtatttaatctgaccgcaatggaataaaactggatatcagtaacaagagggacatttgaaactatacaaatacacaaaaagtaacctgctcctgagtgaccagtgagtgaaggaaaaaatttaaagtgaaatttaaaaattccttgaaacaaatgtaaatagaaacacaacataccaaaacgtacgggacacagcaaaagctatattacaggcaagtttatagcaataaattcctaggttgaaaaactaaaaagatttcaaatcatcaacttgagatgcatctccagaaaccagaaaactgagaacaaaccaatccaaagttagtaggaaagaaatgataaagatcagagcagaaatgaacaatattgaaactgaaggaaaaaatacaaaagatcaatgaaataaaaagttggttttggaaaagaaaaacaaaattttaaaaacctttagctacacaatgaaaaaaagagaagactcaaataaatcagaaatgaaaaaggaaacatcacaatgaataccacagaaatacaaaggatcgttagagactataatgaacaactccatgccagtaaatttaaaaacctagaggaaataaattcctgaacacatacaacctatcaagattgaaccaagaagaaatagaaaacctgaataggtcaataacaagtaataagattaaatcagtaataaaaagtttcccaaaaaagaaaagcccagaattggatggcttcactgctgaaatctaccaaacccttgaagaaaattaatgctaatttttcttaaactattccaaaaatttgaagtagaggaaatttttcctaactcattctatgagaccagtgtaactaactagataaggatgcaaccaaaaaatgaaaaaggttatacaggttaatatccttaatgaacatagacacaaaaatcctcaacaaaatacaaaccaaatccaacaacacatcaaaaagataatacaccatgatcaagtaggatttatctcatgaatgcaaggatgattcaacatatgcaaatcaataaatataatacatcacatccatagaatgaaacacaaaagttatgtgattgtctccaaagatggagaaaaagcattcaatacaattcaacatcccatcatgataaaaactctcaattaagatggtatagaaggaaagtaccttaacataataaaggccacatatgataaacccacagctaacatggtactgaatggggaaatctttaaagctttttcactaagaactggaaaaagacaaggatgcccactcttaccattcttattcaacatagtaatggaagccctagccagagcaattggcaaaaaaataaataaagggcatccaaattggaaaggaggaaatcaaattgtctctgtttgcaggcacatgaacttatatgtagaaaaacctaaaggctatatcaaaaaactcttagaactgataagtgaattcagtaaagttgcaggttacaaaatcaacatacaaagatcagtagtgtttctgtacttgaacaatgaactaatgaaaaagaaatcaaaaaggcaatcctacttacaatagttacatttaaaaaaaacctaggaataaacttaaccacagaaatgaaagacctttgtaaggaaaactacaaaacactgatgaaagaagttgaagaggatacaaatggaaagacatctcatgctcatggataagaagaattaacattgttaaaatgaccatactacccaaaacaaactatggattcaatgcaatctctaccaaaataatgatattcttcacagaaatagaaagaatcataaaaatgtacatggaaccacaaaagaccatgaatagccaaggcaatcctcagcgaaaagaacatagttagaggtatcacactgctagacttcaaaatatactacaaagctgtagtaaccaaaacagcatggtactgttataagaatagacacagagaccaatagagcagaagagaacccagaaattaatccacatatctatagccaactgatttttgacaaagatgtgaagaacactcactgaggcaaaacaaaacagtatcttaaataaatggtccccaaaaaatcagatatccatatacagaagaatgaaactagacgctcatctctcatcctatactaaagccaactcaaaatggatcaaagacctaaatgcaaaatctgaaaatataaaactagtacaagaaaacataggagaaatgcttcaggacattggcctgggaaaagattttatgaataagaccccactggcacagactacaaaagcaaaaataaacaaatgggattatatcaaactaaaaagcttctgtacagtaaaggaaacaagaatgagaagacatcttacagaatgagagaaaatatattcaaacttttcatctgacaggaggtcaatatccagaatatgcaaggaactcaaatatcttgacagcaaaaaaaaaaaaccgaacaatccaattttaaaatgggcaaataatctaaacaggcatttctcaaaagaagacatacaagtgaccaaaaaatacatgaaacaagtgttcaacatcatgaatcatcagggaaatgccaatcaaaaccacaatgaggtatcattttaccccagtcaggatggctattatcataaagacaaaaataacaaatgctggcaagaatgcagagaaaagggaacttatgcactgttgatggggatgtaaactagtagagccactatggagaacagtatggaggttcctcaaaacactaaaaatagaactactatagcatccagcaattccactactggacatttatgcaaagggaaggaaatcagtatatcaaagggacatctacacccccatgcttattgcagcactattatatagccaagatatggaatcaacctagggtgtccaacaatagatggatgaacaaagaaaatgtggtatgaatatataggtatatgtgacggaatactattaggctaaggaaaagaataaaatcctgtcatttgtggcaacatggatggaactggaggatattatgctaagtgaaataaggcagataccacatgttgtcactcatatgtggaagctaaaaaatattgatctcatagaagtagaaagtagagcagaggatactagaggttgagaagggtagagagggggagagagttgttaaaggatacaaaattacagatagaagtaagttctagtgctctatagcactgtagaataactctaattaacaataatatatagtttcaaatagctagatggagaatattgaatgttttcaacacaaaaaaagataaatgtttgagatgatagactatgctaattactccaatctgatcactatgcattatatgtatcaaaacatcactatgtaccccataaatatgtacaatttttacatcaattttttaaataaaataaaacaactagaaataaaagacagattgcctatcaaaaaacgactgacagctaacttctatgtaaaaatggacgctacaaggcagtagaagaccatctttcatgtgctctgataaaataacaattagaattctacatgtaatgaaactatctttcaacaagagcaaaattatcatgcaaaagaagtgaaaggaatgtatcactaccctatctttaccaaagaaatgtctacaaaatatattttaggaagaagaaaaattatctcaggatgaaagtttgagatatcaaaaggaatgataaatactgtggtaagtggggcttaatctaaacaatcatggactgtataaagaaaaagcaataatatccactatgaggagttaataagaacccaagtgacttctaactactggaaaataagagcatgcaaattgggaaaggatataaacgtcctctattgttcggaaaaatggtaaagctacttagtagttttagactggtaagaacactcactggggcaaaaaaacagtgtcttaaaataaatgttgctgggaaaactggatatccagatgcagaagaatggcttcttaaaaagccattcttctgcatagctttttaagttgaaattaattaaagtcatgtagaatattaaaatttagtcacctgcattaataaaatttaaaacttatgctcatcaaaagatctattaaagtaaaaagaagccacaattggaagaagatatttgcagcacacaccaacaaagcattagaatcatgaatatataaaagacttctaaaaattgagaaaacaacaaacaatgccatagaaaaatgagcaaaaccatgaacaaacatttcatagaagagaaaatatacatgaccaataagcatacaacagttgctcaatgtcattaataatcatgaaaatgcaaattaattaaaactacagtgagatatcattttaattcactaaactggaaaaaattagactctgaccatgccaggtatgcacaagtgtgtggaacaaagggaatgctaatcgaatgctggtggaagtgtgcattcgcaaaccacattggaaaacgttgtggtgatgcctatggaagttgaactcttacatatttatgacttggcatctccactccaaggaatatattatagactagagaaacaattgtgcaagtgattgaagacactcatcttagcagcattgttcgtagcagcaaaattctggaataatccaggcatgacgtttggctctagaatggaaagagaaagcacattatagtcatatggtagaattatacaaatgaattagctataggctttaacaaggatacaattcaaaaacaatattcctgagaataagcacaggatatctcatgatcccaattatgtaaagtttaaaatcaggcaaaagtaagcattgtattatttagtgattcatgcatatttggttaaatggtaaaaatacatacttgaaaaggaggactaacttttgtggggaaagtagacaacaagaaatgtttaggtgtggaggtactcggtatcaatctcaaagtatactcataatgttttcttctttttactgggtggtgggtacctttattattttagaatacatctttatacttttacatatatgcttatgttgcattttgcaattaaaattttttcaagagtttacagttatataaacatatatactatatttacagccatgaaaaaattgtacatatatatatatatatatatatatatatatatatatacacacaaacacactagtatgtgtgtggatgggagagggagaaagattgattttaaaggaatataaaataaaggtgtatcacgaggtgggactaaatgaacacatttacttgcagaagatgaatttgactttactgtgcttttttggattgtgccgactcataaatctaactgggcttttagtagacaggagacgattgaacattattccatcttatgtattttcaaacagactgtattattttgggtgttgtgtgtctcacccacactgtcaagattctgtaaacctgcaacgtgatccattcggctgcgctctagttattatccaattatcatccattctgcttattaacaggcataaacagacagtatttctgcatggagctgataccctccattatgggtcaccggtcccgttcttaagtaggattgtgaaggaaaaaagcagagaacttcatcttcagtactaatttctctcacttaattccttctgttttactctttctcaagaatgggcatttatcctctactggtgaagaaagggcagagttgtaggagccatctacggtaaatgcaggctttcaaagggtggggggggacggtagagattttaaacgtaataataaaactgaacaaaatttgatctgctgtatgttatcactatgcaattctaaacagtgttagcatgaaaatattcctcccctagaaattattttgttgatctaagagtactgaattgctacagttacttttgcattgtaataatatatctgtaagcttcaaatcagcatattatattctacatggacgttaactcagagaaccaagagttgcacagggactgccagcacactcagtgacacacacacgttttgatcgtataataagtgcctaacagggtggaactgggcacagggcatgtctcagacctgtatggtacttttaaaaaaataagttaaaataaacactggggcatggtgatggaaaagatgaaaaaacagaacgtaagttatttcaatgttgtcactcggtgtggccacttggagtttatatttgcattttactgttgcatttgaaaattgttaaagtgaaagtgacaagtgcaagacacactctttttgtttggtaaatatacatttcagtccacacatgagaatagttattgaatgttagaagtatcttttaaaatgaaatgtatgttttttcctatcttttggttttaaaagtgaaagaaaaagaaattttagaaaatttaaccttatgttacttactagtataatttagtggttgcctaaattgtactgtttgcatacgtttcagttttattaaagatcacttattggctgttgtcagtaaagagaggatgttaaaaatgatgtgttctgagtgtcaaatccataggtgtactctgtgatcctcttttccgatcagttccccgagtgtcagtaggaaatctaaacagctaaggaccaagcacaggaggagatataaccaatggacttttaactgaggggacacggtttgcatattttttttatttttattttttattttttgagacagagtctcactctgtcacccaggctggagtgcagtggtgcaatcttgtctcactgcaatctccgcctcccggattcaagtaattctcctgcctcagcctcctgactagctgggattacaggcttccgccaccacacccagctaatttttgtattttttagtagagatggggtttcaccatcttggccaggctggtctcgaactcctgacctcctgatccacccatctcagcctcccaaagtgctgggattacaggcgtgagccatggtgcctggccggtttgcatatttgtaacggtgtctttagcacctgcccgtcatctttcctaaacttggtctgcttgagaacacaccttgcttgccatgtcgtttataggataattttccatgaatggaattatttgaatctcaaagattttgtcaaaaaatatattcaaagcttgggtgtaatagacattacacctgaaattacatcctttgcggttatctcaatgtactttaaaatgtttagacattatgctaaaaatatgttaaaagggggcgtcattttttcaatttctcttagggatcacacaaggaagaaaagtttttcaagactgctgatgtaaaatagtgttatcagacagtgttcacatttggagggattgttggtagccaagtctccttggtgtttcttgtgaaagaattcttgagaaagaaatatcaggcaattggggtatattccttaaacatatagtagggaatggggctggtgaatcagttctgaatgcctgttttcttctttaaaattccagccaatgatatgaagcccaggtatgtgggggccttttgatgacagtgagggtgagactaaggaagctgacctgccctgcccagggacacaaggctggctagcaacagagccaggacattagtcagtgtgtctggctctgaagcccccatgggggacactgtctcccatctcctttctcctgtgtttagccttgactttcaccttcaatgtcatgccagacaaagagttgctatggggcaagtgggaaaggcaaaactttttctgaactgctctttaatttgtcaatatagcccaaatctagttgcaatctggtacacttttagtcatgaacgagggtggaagaaagctaatatcacatgttgacctttcattttgccaccaagaagctctccttgaatattctgaaggagaacacgttcttgctgggggctggataaaccttaaaaatttcatgcccctgaatgagcatttcccctcatcacggacttgtccctggggctttcttaggcatgggcaggatgtggattgaaggaagaaacccagtgtcatgggcagcaaaggttgaatgtcttctgtgtctagtcctaacactgacttggagcccattcctcatcattttatcttactttctcccatctgaaaatatttacaaaatcatgtttgatgtcaaaatactaaatactatttggggggccgggtgtggtggctcacatctgtaatcctagcaatttgggaggctgaggcgggcagactgccagagctcaggagttcgagaccagcctggacaacacggtgaaaccctctctctactaaaatacaaaaaattagccaggcatggttttgcatgcttgtagtcccagttactcaggaggctgaggcaggagaatcacttgaaccctgaaggcggatgttgcagtgagccaagattgtgccactgcactccagcctgagcgacagagcgagactccatctcaaaataataataatagtatttggaggattttcccagagcatttgggaagcatttgtacacaaatgagtctgtgagcaaagggccaaggcaaggggcaggagctcagatgcaggctgtgttgatggggctcaaatccagagccccatgatccctatcccgtgctccactgcaccatcctattatcctattttgcattttatttttacattcctataaataaaaagtgcaatcaaataacttgaaatatggtattgcttttgtgcttaaaaataatctcagaaatacagcaaacatgccattcacttgaaattctaaaaaagggcaaaactatgttgacagaaaacagatcaatgatttcctggggtgctgggggtagcagtgggtaggaagagaattagctgtgaaagggcacttggaaactttttcagatgagagaactgctgtatcctgatggtgagggtggtttacacagctgtatacggttaccaacactcatcaaactgtgtgcttaaaacactgactatgcaatacctttatgcttatgtctttttataatttaaatagggagaaaaaatatgtattttgtaatatacatattaatacacattataagatatatataaatatcaataaataataccttatttggaaatagggtttttgcagatgtatataattaggcccaccctaaatccaatggctggtttccttataaaaaaaagggagagggggctgggcgcggtggctggcgcgcctaatcccagcactttgggaggccaaggtgggcggatcaccaggtcaggagatggagaccatcctggctaacacagcaaaaccccatctctactaaaaatacaaaaaattagccaggtatggtggcgggcgcctgtagtcccagctacctgggaggctgaggcaggagaatggcgtgaacccaggaggcagagcttgcagtgagccgagatcgcaccactggactccagcctgggtgacagagcgagactccatctcaaacaaaaaaaaaaaaggagagggatatttgagatacacagacacagagttatatattgtacattttacaaagaaaaaaatgtacatatatatgtatacctatatacgtatgacatccctttctattctgtcttccacaaatgtgagtataagtcttcacagtgggaagtaggaatgatcagagatggagtattagtttgccagcactgccgtaacaaggtcccacagaccagatggtttaaacaacaggaatttattatctcacagttctggaggctcagaatccaagatcatggtgggggcagggttggtttcttcggagacttctctccttggcttgtagatggccgccttctcactgagtctccacatcctcttccttctgtgtgtgtctgcatccaaacttcctcttcttgtggggacaccagtcatactggattcaggcataccctgatgacctcattttaacttattttcttctttgaggaccctatctctaaatccagtcacattctgaggtacatgggattaggactccacatatgaatttttggggggacacaattccacccataacagatggagaatagtgcttgaggtctttactaatttactcaccttggctctatttgaggttttctgccaggagcaggtattttataatttaaagtatacatatgggaaaacacacacacatacacatatatatatacacatatacacatatatatacacatatgtgtgtgcatatttcaaacaaggcagagatcatctgtgacccaaatatgtgctgatgagatcaatggactgtgctacttattggtcccataacatatcacttgtaacctctatctatgaccttccacgtcagtgcaataactaatacagccatcatacacagctgtgcaagagttaacattttattcttctgtgactgaacttctgtttcgagtcccccttttctcagagttgcatctcagttggtggggctgggggtgtctgtggtctcaggcagggaaggcaggcagctcttctggacctggccagagtacatggtcatttctccaggatggtctcccttagacagcctcattccctacctggccactcacatgtgttattgctgcaccctctgtcctgaccctcaggcttcttaagtttgactctgaagccgcactctctgggtttgaatcccagctctactcactatgggctctgtaccttggccacttcactttactttacttctttgtgctttgattacctcatctataaattagagctattcataatagtatctacttcatgtggctgttgggaggattaaatgagttagtatgtgaaaacatttgaaagcgtgtctgccccatagtaaaagctgtatactgtaagtgattcccattattagtagtagtagtagtattgttactgtgatgtcacatgcctcattggtgttttattttggggagcacataaagtactccatttgcctctcttagctgcaagagagaaattctcctgggttgtctcgggtccatgtgctggacccatatttctgctcctgcatcatgctgggaatacagattgtggagctggggtgcagggaggtgtatgactttgccagcttcctgtatttcccttgagaagtggagcggtgctaattgtccctgtcccggatgttccatcaactgtgtggtcccataccaacccctcaggggtgtctgcccaacccccaccccagctttctttccttctttacttagcatctactcctcaggagactgctttgcccagtatgccctaagataataaatgaccttctgagagtcaaatgccaggactcactcttggtctgtttgtcctcacccggctgctcccttgggggtaggccaggacacacactgggtgagaagcgtggtggaggaaaattatctgagttaatttatcaaaatacattattccccagtgacactagggaaaccttacagaggccccgccagcatcaaagagcaaggttctgtttcccatgttccgttacccgatccccagggcctgaaacagagtccagggaatatttggaaactaatcgtcatgagtggtagcatcctaagcagtaccattgtttacctcctaagatcccccaataattgtggttggctatttgttttctagtcatttagacacacacacaaaaattgtttttcaaatgagaaggggaatccacaacaaaaaactgtggctagcttattttcgagtttgaatgctttgtgtaaattaataaagttgaagtctatcccatgtgtataaaaatcttggagttatgttcattaatgagtctattgaattagttttcataaattcttctgattcaattgcatattcttaaattaacaacaaaagtccaacttgtatcattaaagactcaaaacagatggtgggaacagtaaagtgtaggaaagtgggaaaaatccttaaaaaataaacggttctttaaaataaatgaataccaaataaaacagaaaagtataaagagctatagttctttttttttttttttttttttaactgagacagagtctcgctctgtcacccaggatggagtgcagtggtgcgatctcagctcactgcaacctccgcttcccgggttgaagcgattttcctgtctcagcctcctgagtagctgggattacagatgcatgccaccacgcccagttaatttttgtatttttagtagagacggggttttgccatgttggccaggctggtcttgaactcctgacctcaggtgatctgcccacctcggcctcccaaagtgctgggattacaggcatgagccactgcacccggccgggagccatagttcttggtggaaagcaaagcttttcacatcagctagtgtagtgtctgaaaaagtcctcattatagatgggacaaaaagatttagtgggaagaagaaagagaacattgagacagttatgaaaagttttaattgtaaattttaattctcatgtgaaatgaaaattttgggatactttcacacacacacacacaaatgttatcctcagattaaaatatttatgtgggaaatgtttagaggtaaaatgtttagaggggaaaaaaccacttaccatgattgctgccagaaagggtaaaccttagaatcataatactgcagaatttaatgatcctttgtgagcttctggttcaacactcgttttacaagcaaagaaatggaggctcagagagattggttaggtgagccctgcaaggactcatggctaaatagtggtgaaatcagaagctaaagccaggttttctggcttttattccaggactgagatgtagtgacctgactctcgtaagtttctggcttcttccttttggagccacaggtaagcaccagtctagaaccttccactcagacttcatgctccagggttgtgaccagagcttacaagggtgttgtcctgggctggaagcagagactgtgaaactcaaatatacttaggcaaatgcaagcatatgaataaatcaccgaaatcaggacaaacagcttttcttagataaattgcccttggaaagaaaggtgaaaactaagccataatgcatgaatgtgttaattgtttttctcttctacagacactaatttattctgaagggaatgcttcatttccaaattctccttctactttaaagaaattcaaacttcaagaaaaaaattcaacaccatattgtgattgcttcaatagttaagaatttcggctgtcacgactgaaaaaaatcattagcaaaaactggccgtggaaaagggaagtctgtctagttcatgacaagcatccatcatcgtatgtgagttagtaatttctcacctctcatttgagagaggcaaggtacctgtgtgccattggggtgggctttccccgcagtgacagatccggatagatcaccagcctggctaagctccaagccttaaattcctttacttctcacccctgggccatttccgccacttttcctccatctcctttatccatttaacatctgttacatatatgtatatacacacacactttaagttctagggtacacatgcacaacgtgcaggtttgttacataggtttatatgtgccatgttggtttgctgcacccatcaactcgtcatttacattagttatttctcttaatactatctctcccctaggcctccaccccctgacaggccctggtgtgtgatgttcccctctctgtgtccttctgttctcattgttcaactcccacttatgagtgagaacatgcggtgtttcgttttctgtccttgtgatagtttgctgagaatgttagtttccagcttcatccatgtccctgcaaagggaatgaactcatccttttttatggctgcatagtattccatggtgtatatgtgccacattttctttatccagtctattattgacgtttaacatcttttatttatttttatgttttactttttgagacagggtctctgtcacccagactggagtacagtggtgcaatctcggctcactgtagcctctgtctcctaggttcaagtgattcttgtgcctcagcctctccagaggagactttgacaaatatatatatacacatacatacacaaatatatatatatatatttgtcacaaggatttgaccttatgcaattatgtttgctggttaagcagcctctgtgaggctgttgtctttacatctgaccatgagatgttggagcttgaagtccaagaggcaggtggtcagcagaggaagatggatatgaagtcgggagagcagggatgggctgggacccacaggcacacacagaacccatgaagacccaccggaactcaggtcagttatcgctgcctctctgggtgctatagttgtcctacaggatatgccggctcccatcatcacagacatacacacgcacctggcccaagagtcacagaagctgaaggaaaattcagggaaggtagagcagttgtgacttggctactgccccacccagcaacatgagccacagataaaacaggtgtgagctacagaatggctgccgcttccctgcctcctctgaatctcacatgtaagcatctcttgtggcccactctaacaagaaacattcaggaaaggagatctgggggagggggagcctctccaagctgacactttgcaagccacccagtctacaatgtggagaatggttgcaaagccttccacacttcttcctgccaatcctcaccctggtctccagggtcaagtgtgcactttctggggatgcagcctctccaccccacacacaagttgtaccgggaaaaactgagatttccagcaggcagagattgagaagcagcagctaataacattacaaggccatttggcagcagcgcaaaccttcaccattacaattagagcaagtggaggtaaaagagactctcttaatggccaaatcaaataaaaagtgacaggcttctgaagattatgttgaaccctgtatggcatgttaatgaaacaaagggtcagataccatttcatctgtggcttatctgcttagatagaagggatgtttttctgcctagtcctacctgaggatttccaagccacccctatgcatgaagatctgacacatttttgtccgcacttttctcagagtgttggggaaccaggactgagccagcagcgaaatattctgtgatgtaaggtggaatttagaataaaggtattttggtgatcaagcagctcaatggtccttaaccttgactgtaaccttgactgaatcacatgcaaagctttatagcctttctgatgtccaagctgcccagagatttttagggtgcacccaaggcatcaccagttagtaacgcatcccaggtgattccaaggtacaaccagagtctagaaccagggatctagtctaatccttttttcagataatgaagctaagtcatagagaagttaggtgtgttggccagtagtaaatacaaacagtagaacccaagtctcccaactcttaaacttatcaccttccactatatgccctgccatatctgctattgagaagagtgagaaacacacattaaaactgcatactctactgtgttccaagaatgggatgactttgaaatgcatgctatttgtagaatataggtagtgagactgatgcctggtcattcgcctacagccttaacacctcctggaagtctgattctttcagtttaccttgcccatagtgtgagacagagaaggaaaatagacgagtctcagaatgcattgttcagtggaatgcattttggaatgatcctacaaattacaggaaagctttaatcgccaataattaggtgtcttaaaaatggagttgtcttctggcgtatgctgacattatcagtccaagatagacttgagccaggagcctctgtgacagtatgctttagaaagagtgagagagggagcatgtgtaagctaagaaaacctttgtaaataagcaaagtcttattcaacctacagtctgtcctcagagctatcatttatcaggggaacccacccctgataattcaacatgagtccttttctattttccgtaagcgtcggccggtctgagaaacaaagggaaagagtacaaagagataaatttttaaagctgggtgtccgggggagacatcacatgtcggcaggttctgtgatgccccctaagccacaaaaccagcaggtttttactagtgattttcaaaaggggagggagtgtacaaatatggtgtgggtcacagagatcacatgcttcacaaggtaataaaatatgacaaggcaaatggaggtggggcgagatcacaggcccggggcgaaattaaaattgctaatgaagtttcaggcacgctttgtcattgataacatcttatcaaccgtaaaagacagacattcctagagcggccattttagagacctcccactaagaatgcactctctttctcagggatgttccttgctgagaaaaagacttcagcaatatttctcctatttgctcttgaaagaagagaaagatggctctgttccgcctggctctcaggctaccagacctaatggttatctcccttgttccttgaacattgctgttatcctgttcttttttcaaggtgcccagatttcctattgtttaaacaatttgtgcagttaacgcaatcattacagggtcctgaggtgacatacatcctcagcttacgaagatgacaggattaagagattaaagtaaagacaggcgtaagaaatcacaagaatattgattggggaagtgataagtgtccatgaaatcttcacagtttatgttcagagattgcagtaaagacaggcataagaaattataaaagtattaatttggggaactaattagcgtccatgaaatcttcacaatttatgttctgccatggcttcaaccggtccctccgtttggggtccctgacttcctgcaacaataattatttattttaaaagaaacaaaatcaaattattagacatttcaatctgtggtagtaacatgatattctggcatctactttcattatcacctttattaaaataaatttaaagaaaaatggcagtatgtttctgtgaagaccacgagtactcattttaaaggactcaagagttgcagaaaagtaaaaagaaaagagtaaaatcattttctaaatctcaccttccagaaataacgatgttgagcattaagtggacttcatttcatactctttcaaagattatgtaggcatatatatgtgtgtgtatatacatatatatggatacatccttagagaagttggctggctagatagacacactataaaaatggaatcatactctaatgccatttttaatttaaaaaatacatattcagatccactgtacttatatacagaagtaaatgaaactaaagtaacacgagaggaattctgaccctcatataattttttttactatccaacataattattttttttattatactttaagttttagggtacatgtgcacaacatgcaggtttgttacatatgtatacatgtgccatgttggtgtgctgcacccattaactcgtcatttaacattaggtatatctcctaatgctatccctccccttccccccaccccacaacaggccccggtgtgtgatgttccccgtcctgtgtccatgtgttctcattgttcaattcccacctatgagtgagaacatgtggtgtttggtttttttcccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggcttggttccaagtctttgctattgtgaatagtgccgcaataaacatacgtgagcatgtgtctttatggcagcatgatttataatcctttgggtatatacccagtaatgggatggctgggtcaaatgatatttccagttctagatccctgaggaatcgccacaccaacttccacaatggttgaactagtttacagtcccaccaacagtgtaaaagcattcctatttctccacatcctctccagcacctgttgtttcctgactttttaatgattttcattctaactggtgtgagatggatggtatctcattgtggttttgatttgcatttctctgatggccagtgatgatgagcatttttcccatgtgttttttggctgcataaatgtcttcttttgagaagtgtctgttcatatccttcacccactttttgatggggttgtttgtttttttcctgtaaatttgttggagttcattgtagattctggatattagccctagccctttgtcagatgagtaggttgcaaaaattttcttccattctgtaggttgcctgttcactctgatggtggtttcttttgctgtgcagaagctctttagtctgattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaggaagggatccagtttcagctttctacatatgtctagccagttttcccaacaccatttattaaatagggaatcctttccccatttcttctttttgtcaggtttgtcaaagatcagatagttgtagatgtgcggcattatttctaagagctctgtccttttccattggtctatatctctgttttggtaccagtaccatgctgttttggttactgtggccttgtagtatagttagaagtcaggtagcatgatgcctccagctttgttcttttggcttaggattgacttggcaatgcgggctctttttttggttccatatgaaccttaaagtagttttttccaattctgtgaagaaagtcattggtagcttgatggggatggcattgaatctataaattaccttgggcataaattaccttggccattttcacgatatcgattcttcctagccttgagcatggaatgttcttccatttgtatcctcttttatttcatttagtagtggtttgtagttctccttggagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgcccgtttccaaagggaatgcttccagtttttgtccattcagtatgatattggctgtgggtttgtcatacatagctcttattattttgagatacatcccatcaatacctaatttattgagagttttttagcatgaagcgttgttgaattttgtcaaaggccttttctacatcttttgagataatcatgtggtttttgtctttggttctgtttatatgctggattacgtttattgattttcgtatgttgaaccagccttgcatcccagggatgaagcccacttgattatggtggataagctttttgatgtgctgctggattcggtttgccagtattttaccgagaatttttgcatcggtgttcatcaaggatattggtctaatattctctttttatgtggtgtctctgccaggctttggtatcaggatgacgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagagtgtatgtgttgaggaatttatccatttcttcttgattttctagtttatttgcatagaggtgtttatagtattctctgatggtagtttgtatttctgtgggatcagtggtgatatcccctttatcattttttattacatctatttgattcttctctcttttcttctttattagtcttgctagtggtctatcaattttgttgatcttttcaaaaaaccagctcctggattcattgattttttgaagagttttttgtgtctctatttccttcagttctgttctgatcttagtcatttcttgccttctgctagcttttgaatgtgtttgctcttgcttctctagttcttttaattgtgatgttagggtgtcaattttagacctttcatgctttctcttgtgggcatttagtgctataaatttccctctacacactgctttgaatgtgtcccagagattctggtatgttgtgtttttgttcttgttggtttcaaaaaacatctttatttctcccttcatttcgttatgtacccagtagccattcagcagcaggttgttcagtttccatgtagttgagcggttttgagtgaatttcttaatcctgagttctagtttgattgcactgtggtgtgagagacagtttgttataatttctattcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccaagtctctttgtaggtcactaagggcttgctttatgaatctgggtgctcctgtattgggtgcatatatatttaggatagttagttcttcttgttgtattgatcccctttaccattatgtaatggccttctttgtctcttttgatctttgttgatttaaagtctgttttatctgagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattagagcatttggcccatttacatttaaggttagtattgttatgtgtgaatttgatcctgtccttatgatgttagctggttattttgctcgttagttgatgcagtttcttcctagcatcaatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttgaaatgaatgaaatgaagcatgaagagaagtttagagaaaaaagaataaaaagaaacaaacaaagcctccaagaaatatgggactatgtgtaaagcccaaatctacatctaattgatgtacctgaaagtgactgggagaatggaaccaagttggaaaacactctgcaggatattatccaagagaacttccccaatctagcaaggcaggccaacattcaaattcaggcaatacagagaatgccacaaagatactcctcaagaagagcaactccaagacacatcattgtctgattcaccgaagttgaaatgaaggaaaaaatgttaaggcagccagagagaaaggtcgggttacccacaaagggaagcccatcagactaacagctgatctcttggcagaaactctctaagccagaagagagtgggggccaatattcaacattcttaaagaaaagaattttcaacatactgattttttacagatgccttatcaaaagagattatgaaagctattggaattgtaatacttttattaattaatggttcacttttatatagtatcagtgaacttcgagcaatgaaagaagatgattttaatgcttccttcatttctctatcacccacctcctgatttttatagatcattatcattcattcattcaaccagtgtttatttagagaatactttgtgtaaggcaccttcaaggtgctgagcctagagctataagctatcgatggaacagacaagattctcacacataatggggcttgcattttaatagaaagaaaaaataaatcactattttgacattgcgctgattctgttcagtaaccataagcctcataattgttcagtattgtttctatatttgaattctttctatgcatatacataagtagaagtctggcagactagagagatagccagactcacttttataaaaatgggatgatactataaattcacttccgtcgctgacagcccatcctccacctaccttcttatctctgatcctccctagcagccctatccaggtttccctggttagaaggagaagctcggtcttttccagattcacagggaaaggttcccaagcaggaggagtgaggaggagccaggtggcagggccaggccaggccaagcctttctccactgcttctctgcagaatttccttggctgctggttttggaagtgtgtgacattaggttatgtccatttccttggttggtggctgctgataaaaattttgactggtttcactattttgatgctataattcttcatttttttttaggcattgctaagttagataaatcttatgttcagtcttttctatcttatctttaccccaagtctacctccttaaaatacttttatgagcacaaatccctgatgtaaaatcaagccataatgtgtttcctggagtaggggcggacaaatatgttaactaaattctttttgcgtgcttcatgttggatcaattcttaaggaataattttgactgagcctcttttaagcttttccaggcctggcttgttttcctgaaaagcttcaaagcagagaggagaatctttgtcagttagctgggtgagtggttcacaagcctcactgttgtgacacactccgtcatttgtgagggcatcacagccattttgttaatagaaatacagagccaaaagtcaaacatgattttatatgtgtgagatgttgcccgagggaaagggcaaagaatgagaagagctggactgggcaactctcatgtgaccccaggtccctttcaaagttgagtttctctagcaagtttgggatttccaaatgtttctactgagaaaaaaaaaaaaaggaaacgtgcaattaaattagaaaactacacagctcttactgaagagctgaaattttaaaaagatgcttaaaataaagcaaggaagataaggagaaagaaacataaagcatccaaacctgaaagaataacattcagataggctaacactcagaaaagattggagtcttgccaaacatcctgaggtcagccgccaccacagcaaaaagactgtttgatttggagtgacaagaaagatgatgtgatctcagaggaaacagatggctcactaaagatatttgaggatattttaataaaaagaagattttaaaaggtgtgagtaggatacagggaaagtgacaaaagatggagcaagttggaacctgatgggagtaatctggggggaaggaacccatagcagaagtggtggctctcaatggtggagcccagccaatccgtgggatcgggcaggaagggagctgacccactgtctgctccacgacctcctggtgctgcctccccttggctgaacccagccagaaggcaaagagagacccattggtccattccgtccaagatctctctcagggctcagagcagcgtacagaaaggtagtgtttctggaggaacaaatagaagatatccagcagtaagggcaaggaggcacagaagtacttcctgcttcaaggggttgagtggctatggtagttgatgttgagaaggcagatgaagtaaaagcaacttcgcatatatctttcctatcaaagacaatggtctaactggaaagaaaacaataaacagggttgtgactaaaaactgggcaaatgatctaaacagacatttctcaaaagtaaacatacaaatggccaagaggtatatgaaaaaaatgttcaacatcaccatcatcagggaaatgcaaataaaaaccacagtgagatattatctcaccccagttagaacggctatgatcaaaaagacaaaaaataacaaatgctgacaaggatgcaaaaaaaacccacttatactgtgttggtaggaacgtaagttagtacagccactatggagaatagtatggcggttcctccaaaaaactaaaatagaactaccatacaacccagcaatcctactactaggtttctgtattgttttgttttatattttttgtttttttggttttttttttttttttttttttttgagaaggagtcttgctctgttgcctagtctagagtgcaatggcatgatcttggctcactgcaacctccatctcctgggttcaagtgattctcctgcctcaacctccccagtagctgggattacaggtgtgtgccaccacacccagctaatctttttagttgagatggggtttcgccatgttagccaggctggtcttgaacccctgatctcaagtcatctgcccactttggcctcccaaagtgctaggattacagataagagctaccatgcccagccccattactaggcatttatccaaaggaaaggaaaccagcatatcagaggaatacctgcaccccatgtttatcacagcactattcacaatcgctaagatattgaatcaacctaagtgtccatcgacagatgaatggataaagaaagtgtggtatatttatacaatggaatactattcagccatttaaaaataaaactctgtcattcatggcaacatggatgagcctggaggacattacgttaagtgaagtaacccaggcacagaaagacaaataccatatgatctcattcacatacagaagctgaaaaacagttgatctcatagaagtagagagtacaattgtagttattagaaactgagaagggtaggaggggaggagatggagaggttggttcaaggttacaaaattatagccagatcagaggaatatgttctagtgttctatagcactgttgggtgactacagttaaaaatttttgtatattttcaaatagctagaatagaagattttgaatgttcccaacgtaaagaattgaaaactctttgaggtgatggatgtgttaattaccgtgatttatcattacacattgtatctatcaaaataccactctataccctataaagatgtataattattatgttcaattaaaaataatgtaaggaataaacaatattgaaagcaaaagaaaaaatcccaaagtggtcaaagcaataagccaatacttaactcctttaagcccatctgcaggcctaaatgaatcttacctgagagtgctgaaagaaaattatgtttaatttccagaaagggtcaaaagagtacattattgaacctgtaataaagttactgaaattaaaaggaatgttaaagatctcaggtttcttgatttcaggaagctatttgatggagcctttcaaagtttggttggtaatgaatatgctggagaaacaccggccatacaagaaggtttccctgacctgggatggacagtcatgcacagtgtttactagtgttgctcgcatggcatgaggaggaaagggcacaggacccttctttttgacccactcctattcaagtttctatgaaggtcttgaatgaagataggaggtgtaggtcaaagtcgtggttatgactgtttcaaagtcagaaaggagaatcggttctgtggatcttacaagctcctttaagatgcctcaggctatgaagctgtgggagagctggaaattctggatggatgggataatatttcctgaagcttgagggaaggtgtttgctgaagtttgtccaatgtgctctgtatgaagccagaacccaatgtcccatctgccttgttccagcactgcctcggattccagatcctgagaaccaccctttaccccagggaaacccctgatgccaccttctctgctgccaaccattatgtggtgtgagctgtccccaggttgcaagtctctgccagcagccctgcatgcttcaagactctctgtgtggccccacagggcaagcacaacaaagaggtcaaatgacagaatttcaaaagatttcaactgatgaaccaaattaaaggacatgttaggtattggaattttccaatttacagagctagtttgtcctagcattggccagaatgaaggctgaaagagtggcagggctgccaccatggttactgcagcaggtggaattcgagtgcctgaattgagggaagtgggggtcctcctgcatcccgagatagcgagagcacctcagaagtgctggcttaggtggtggcacccactgtaagagaacgatgacaaatctcagtttctccctaggagagtgcccagcagggtgatgagccaggaagatctgtcaggatgaagagtagtgagaggaagggggaaccctggagaagagaagaacttaaagggattcacaagaagttgaggagggcagagctgaatgagacaaggttgcagggaaacagactttttaagatcagtgtaagggaaaaaaaaatccttgacaatcagaattgtttcaaaacagagtcagcagcttcttgagactgggtcgctgtgctaagaacgtaaagggggagctgggtggcaccagcaaagtggcaggaatgtgtccctgcagggtctttgctgccttccgaatcctctcctttgtgatcctgtaatttgtgagagagcctggagggtagcatggaaaagagagaggagaggacctgacagcagtatttccatcttgtcccctaacaattgcctaggcagtctcctctcagcagggaagcaaactggtcaccaaataataataattatccccctacatttccttaattatttaaacttctgaaaggacatcaaacacagcaaagagtcaatgacttgctttcagaagtgattcagactgtagctccacccataacagtgtcaccttgagcagtcacatatgccttaacatccttctttctaaagcaattccatcttcccaggttgattgttgagcgtttagacatgatgacatatataatctttatatatgtatatttacaagtatatgtttatggataaattttgactgcctgtaacccatgtggccttgtgtcatcacacataagttcactgaagctcccaacaaccagacttttggggaagtacaaacctccacattagcactaggtctccttgcctgcccctctgctggaagaatccctggcaggggccttctttggtgatgggattgaattttctatttcctgaaatgtaatcagctttcagtttcaatggtggtcacccccttgtaccttcttttaaagattggaacgctgtattggtttctcagggctgctgtggtcttcatagaagatgacccgcgtatttccaaggtttcctccaggattgctggggctgtctgcgtccagatgttaaggttactgtagacaataaatgggagagggtgaaggaaggaggatgtttagagaaaattatccagtcacctggaggaaaggctcttagctgcaaaagaggaaataagggccaggcacagtggctcatgcctgtaatcccagcactttgggaggccgaggcaggcagatcatgaggtcaggagatcaagaccatcctggccaacatagtgaaacccatctctactaaaaatacaaaaatcagccgggcgcagtggcacacgcctgtagtcccagctacttgggaggctgaggcaggagaattgcttgaacccgggaggcagaggttgcagtgagatgagatcgtgccactgcactgcagcctggtgacagagtgagactccatctcaaaaaaaaaaataagaaactgctatttagcacaacatcaaataagcagtttgttgcttatgtctgaacacttctgtgaaaacaggcaaaggcagtcgtgtgtaggttctggtgaccaggaactggagctgcacagaggtgtagaggctcccaaagctcgtcaattgtttatgaagggagtaaaggctggaagtcagggggtgggtgtcagtttctgccactagctaccagatttctcctaaagatgggaaagctccctttatagagctggagtgcaattttgtgttttctttgtgtttggcaatgtctgttactgacttgcaatagatatgcaacagtataggtatgttcatcttagtattttggggacaaaactcccaaaccagccaccacacaaatgtatttataggtaccagtaggcacctttggactcggagggaagtcagcctccttaaagccgtattcagtaaggagaatgaagggtaggcatggctgcagcttgggttgtgcccaccatgtggatatccagccatgatctcaatagtcaggttggtccacattgtccagatatctccatgtaacattaactcagactttatgaaaataaccggtgagaataaccaaagccacattgggtaatgaaaactgtatgtacaattttctttagttacattgatgttgttacatactgttcataattaattacattggtttgtaatgtatcatgtcctattgtattgtaggttctaataccaagaccctaggtgttcctctcttaaaagctggtgaccacctttaactcatgtggtaaaagaatgatagttctgggaggatctgcattctctctgtgtccatgcagcattgccccacactgcctgtgctgagctgcatgatcctcatagctacatcatagtctttgcttgtaggcttgtcgtttggagaaccgtcttggagtctttattggttgatgtcaatggaaagctctgcttccctctggatgtcctatggtattgctgttcctaatgtctttctaatgagtgctacgtgtctgtatgtgtgtataaagagatttatgtaaagaattggctcatgtgattacggaggctgagaaaccccaagatctgcatttgccactaagtactcagatatttggtcaaacatgattgtgagtgctgttgagtgctgtattttttaactgccacgtaatcccctcaaggtccgtgttattctagacagtaaaccgggagaggcttctaaagccccctttgtcaggaaatgttactttagaatctgaccttgtgtgaaacacagatgacagaacctctctagtgcaatgacattaaaatcctcccccagtacttgaagtgcaagggaaatagctcattgctattatggctggatcatctcatggcctctcaacagatcaagagcaccattactactgttgctttcttgacttgtgttttacttttattctaacatttgttgcagtctgtgttaaatagggaggtagaccaaactatgagaaggagccctatattggaaactgtatagccaactatgaaacctccaggcttactttgctttctcattacaggcggccttcccctctgctccactggagagagtcagagtaattggctcttgctttatatgaaggatatgctcccaaaaaagttgtatttaaatcaagttttaacaaaccgactcatgcttgtttatccacttataacacttactatttaaaggaaatgataaagagtccttttctgttgttacagcgtagttggcaaagctgtatcttctgaagactgacttgcactcagcagttttagatcaactcgagtctgtttatactaagatccacagacccctggtggttctcagatgacttgcaaattctactagtttttccaattgtgtgttttttgatgataacttaaaaattttttatgataatcttttcattgtttagtataataatgtacagataaaccctagatgatcaccttataactgagtgctgtcatgagatttcagtgcctttgttctcagtcctgtaggtaaccaagacttcatctaaaatcacatcacttgactttaaatgtttgcaagacacatctgactgtcattgggttgataaaatctgtcttgtcctcattttgtgttgtgtgggactctatcatcaggtacaaaagcaaaactcctttgccatgagcgttcacagttgaatgacttttttatagaccaagagtttagtttcttagagtatatattgaatcaatttggcatcatggaaatggcatagtacattagaggcacatactatgttaactgtcacaatctaatgataaagaacagaaaaggacatattacataatcggtgcatttctgttaaagtcatggcaagcttattgaactagttttatagcaatttggcaggataaaaatgatgggaggatggagtcatcatagggtgcctgccctgtagcatggacacctgggacacaccttgctggatgatgtcttctttgggttccatcttaatacatgacaactggaaataattctgtagcagaaagtagagtgtaaaatagaaaatgactcttattctgatgaatcaaagtttttaagccatatatgtcggagtacacttgaattacttctgtaaaaactagcacattatataaaaatcataataaaaacagagattccagtgaggggtccctcttgttcagagtcgaaagattcaagtcaacaaaaatggaacctgtaagttagtctttttgccactgttaaaagaaaaacactggacacaatacttttaacagagtttatgtgagcattagaggattcatgaattgggcagcacccagaaccagaaaaggttcagagagctctacccagcagcatgggtagtgagctttaataggcggaacgtggaagtaagacaaagaaaacatatttgatttgttagagtagaaagtccctagttagaggttagttggaggtttctgatggtaacttctctagtttcattttactgttcacattgggctttggtttgcttacctaggaacttaaagtgctgggaatgcttcggcttaatgacctcccaattaaaatttttttaacatcacttttatttatgatctacaaagtggcaactgcctatttttttttaattttattattattatactttaagttttagggtacatgtgcacaatgtgcaggtttgttacatatgtatacatggccatgttggtgtgctgcacccattaactcatcatttagcattaggtatatctctcagtgctatccctcccctctcccccaaccccacaacagtcctcggtgtgtgatgttccccttcctgtgtccatgtgttctcattgttcagttcccacctgtgagtgagaacatgcagcgtttggttttttgttcttgcaatagtttgctgagaatgatggtttccagcttcatccatgtccctacaaagcacatgaactcatccttttttatggctgcatagtattccatgttgtatatgtgccacattttcttaatccagtctatcattgttggacatttggcttggttccaagtctttgctattgtgaatagtgccgcaataaacatacatgtgcatgtgtctttatagcagcatgatttataatcctttgagtatatacccagtaatgggatggctgggtcaaatggtatttctagttctacatccctgaggaatcgccacaccaacttccacaatggttgaactagtttacagtcccaccaacagtgtaaaagtgttcctatttctccacatcctctccagcacctgttgtttcctgactttttaatgattgccattctaactggtgtgggatggatggtatctcattgtggttttgatttgcatttctctgatggccagtgatgatgagcattttttcatgtgttctttggctgcataaatgtcttcttttgagaagtgtctgttcatatcctttgcccacttgttgatggggttgtttgtttttttcttgtaaatttgttggagttcattgtagattctggatattagccctttgtcagatgaataggttgcaaacattttctcccattctgtaggttgcctgttcactctgatggtggtttcttttgctgtgcagaagctctttagtttaattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaaggagggatccagtttcagctttctacatatggctagccagttttcccagcaccatttattaaatagggaatcctttccccatttcttctttttgtcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggtaatgcgggctcttttttggttccatatgaactttaaagtagtttttttccaattctgtgaagaaagtcattggtagcttgatggggttggcattgaatctataaatcaccttgggcggtatggccattttcacgatattgattcttcctacccatgagcatggaatgttcttgcatttgtttgtatcctcttttatttcattgagtagtggtttgtagttctccttgaagaggtcattcatatcccttgtcagttggattcctaggtattttattctctttgaagcaattgtgaatgggagttcactcatgatttggctgtttgtctgttattggtgtataagaatgcttgtgatttttgcacattgagtttgtatcctgagactttgctgaagttgcttatcagcttaaggagatttggagctgagatgatggggttttctagatatacaatcatgtcatctgcaaacagggacaatttgacttcctcttttcctaaatgaataccctttatttccttctcctgcctgattgccctggccagaacttccaacactatgttgaataggagtggtgagagagggcatccctgtcttgtgccagttttcaaaggtaatgcttccagtttttgtccattcagtatgatattggctgtgggtttgtcatagatagctcttattattttgagatacatcccatcaatacctaatttattgaaagtttttagcatgaagcgttgttgaattttgtcaaaggccttttctgcatctattgagattatcatgcggtttttgtctttggttctgtttatatgctggattacgtttattgattttcgtatgttgaaccagccttgcctcccagggatgaagcccacctgatcatggtggataagctttttgatgtgttgctggattcggtttgccagtattttaccgagaatttttgcatcagtgttcatcaaggatattggtctaaaattctctttttatgtggtgtctctgccaggctttggtatcaggatgacgctggcctcataaaatgagttaggaaggattccgtctttttctattgactggaatggtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagggtgtatgtgtccaggaatttatccatttcttctagattttctatttatttgcatagaggcgtttatagtattctctgatggtagtttgtatttctgtgggatcagtggtgatatcccctttgtcattttttattgcgtctatttgattcttctctcttttcttctttattagtcttggtagcagtctatccattttgttgatcttttcaaaaaaccagctcctggattcatttatttttttgaagggttttttgtgtctctatctccttcagttctcctctgatcttagttatttcttgccttctgctagcttttgaatgtgtttgctcttgcttctctagttcttttaattgtgatgttagggtgtcaattttagacctttcgtgctttctcttgtgggcatttagtgctataaatttccctctacacactgctttgaatgtgtcccagagattctggtatgttgtgtctttgttctctttggtttcaaagaacatctttatgtctgccttcattttgttatgtacccagtagtcattcaggagcaggttgttcagtttccatgtagttgagcagttttgagtgagtttcttaatcctgagttctagtttgattgcactgtggtgtgagagacagtttgttataatttctattcttttacatttgctgaggagtgctttacttccaactatgtggtcaattttgaaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccattattattgtgtgggagtctaagtctctttgtaggtcactaagggcttgctttatgaatctgggtgctcctgtattaggtgcatatatatttaggatagttagttcttcttgttgaattgatccctttagcattatgtaatagccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattggagcatttagcccatttacatttaaggttaatattgttatgtgtgaatttgatcctgttattatgatgttagctggttgttttgctcattggttgatgcagtttcttcctagccttgatggtctttacaatttggcatgtttttgcagtggctggtactgcggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggtccccactctcttctggcttgtagagtttctgctgagagatcagctgttagtctgatgggctttcctttgtgggtaacccgacctttctctctggctgctcttaacattttttccttcatttcaactttggtgaatctgacaattatgtgtcttggagttgctcttctcaaggagtatctttgtggcgttctctgtatttcctgaatttgaatgttggcctgccttgctagattggggaagttctcctggataatatcctgcagagtgttttccaacttggttccattctccctgtcactttcaggtacaccaatcagacgtagatttgggcttttcacatactcccgtatttcttggagactttgtttgtttttattcttttttctctaaacttctcttctcgcttcatttcattcatttcgtctttcattgatgatatcctttcttccagttgatcacatcgactactgaggcttgtgcattcgtcacatagttctcgtgccgtggttttcagctccatcaggtcctttaaggacttctctgcattggttattctagttagtcattcttttaatttcttttcaaggtttttaacttctttgccattggttcgaacttcctcctttagctggtagtttgatcttctgaagcctccttctctcaactcgtcaaagtcattctccgtccagctgtgttccgttgctggtgaggagctgcattcctttggaggaggagaggtgctctgatttttagagtttccattttttctgctctttttttcccccatctttgtggttttatctacctttggtctttgatgatggtgatgtttttggtgtggatgtcctttctgtttgttagtttttcttctatcagtcaggaccctcagctgcaggtctgttggagtttgctggaggtccactccagagcctgtttacctgcgtatcagcagtggtggctgcagaacagcagatattggtgaaccgcaagtgctgctgcctgatcgttcctctggaagttttgtctcaggggagtacctggttgtgtgaggtgtcagtctgcccctactgggggggtgcctcccagttaggctactcgggggtcagggacccacttgaggaggcagtctgcccagactgcgtgctgagagaaccactgctctcttcaaagctgtcagacagggacatttaagtctgcagaggttactgctgccttttgtttgtctgtgccctgcccgcagaggtggaggctgcagaggcaggcaggcctccttgagctgtggtgggttccacccagtttgagcttcctggccactttgtttacctcctaaagcctgggcaatggcgggtgcccctcctccagcctcactgccgccttgcagtttgatctcagactgctgtgctagcaatgagcgaagctccgtgggcataggactctccaagccaggtgcaggatataatctcctggtgtgccatttgttaagcccgttggaaaagggcagtattagggtggaagtgacccaattttctgggttccgtctgtcacccctttctttgactaggaagggaatttcctgaccccttgcgcttcctggatgaggcgatgcctcgccctgctttggctcacgcacggtgcgctgcacccactgtcctgcacccactgtccagcactacccagtgagatgaacccggtacctcagttggaaatgcacaaatcacccatcttctgcgctggtcatgctgggagctgtagactggagctgttcctattcggccatcttggctccacccccccggcaactgcctattgttttacctgatatgcacaacattggccattagtgttaccaaagcaacatccatcacaagaattaatgcttcttgatttgaattttactcctctctgtctctgtttatgtgcattcatttgattgtacacttgtataagaactaaaagcataaaaagtttattcctacatctggcacagctcacgtctgtaatcccagcacttcgggaggccaaggcgggcagatcatgaggtcaggagttcaagaccagcctgaccaacgtggtgaaaccccaactctactaaaaatacaaaaattagccaggtggggtgttgcgtgcctgtaatcccagcttctcaggaggctgaggcaagagaattgcttgaacccgggaggcggaggttgcagtgagccaagatcgcactgcaccccagcctgggtgacagaatgagactctgtctcaaaaaaaaaaaaaaaaaagtttattcctagttttacatttgtagcattgaaattaaaagaatctaaataaataacagagcactgtgagaatttgttgtttaacagagctctatatgcattacacaatttcaaggaacattgatctgaatgttcctatccctcatggaccttgagccctgacaaaagttaataaagatgggtctccttttcttcttgtcccctgctttcagctctgaatgagaaaagttttgcaaatatgtcggtactttgtattaagcctaaaacttataaagtatcagatttgtaagttgactgtattaactttaatttctcaaagtgttctcagttaattaggttaacctaaaactaaaactataaagtgattcctcccctaccaagaaaaaaaaaattaagctgaaatcctctgtttagagtttcaggcctttgggctggactccacaacccttctcaggaagtagcagtagacacctgaccttaggctgtagtgctaatataacctgtgtcagtagctgccccattgcaaacaaggaaatgatcctctgaagtcaaactcaggaaggaacaagaacctgtctctctgagctctctaaagagtgtggttaagagtatgagcattgacaacagactgcctaggttcagataccacctctgatgccagttatgtgattttgggccagtttcttaatctctcaatgtctcaacaacatgagtctaataatagcatatatacccctataaccatggcatgaggattagacaggttgattggtgtgtataaaacacttggaacagggcctggcacagggtatgccttagtagatgttagcactgcatcacgactgctactatgattaccgtccctgtcactgttgctgctgccaccacaggcaggtcagtggaacgtcacccttcagggatttatcagcgccactccctaagcatgccacctgcatgaagggcagacatgaaattgtgccgccagcgttctggtttcttcagcgctccctgccagctgagctgtgtgaaaagcactcagctatgaaaaaatgagaaagattgattgaaatgttggtgaggtcattgtcaaatattctctgtcaactgaatgactgcaaatagggagatgactgcccccccaccaagtcagcctaggagggttcagtccttcatttattcattcacacatcactccttcactgtgccagccagccatgacaattaagtgcatttgggaggaggtggcagctgagctggaaagggggtttggcattatgctgggaaggtgtaaaaagccaggctgaagatttgggccgtctttttttttcccccagatagtggggagctggatttggagacaagaaacctttgtagaccctctggcactctctattgacagatcactgctaggaggcagtgtgactcggagaaccgcatgggctccgccaccagctctgggttccgcactcattagccagatgaccttgggctcattatttagcaagcctgcacttctgtttcctcacctacaaaatatgcataaaatagcagtacatacctcacggagttgttctggggcttaaatgagttcatctgtgcaaacatttagacgaagtgcttgacataatcagagctatgtaggtgctgttaattcttctttgccccactggtccccaggttccatatctgtaacaagaagcaactggaccacataatttcacatccttttatacccaagtttttgatcaagagagctcaggctgtactttaagcttaatgtgacagtgatttatagcatagcttgggggcgatctgaacacttgggggcagaaaaacaagttaggctttccctgtttccatcattctcccacctttcctccatctgcctgtccccacctggacatacatgccaaaagccacggcccattttactagatctaggtagtatgggaaaagaccatgaagcggacacatcatctgtactgccagtgtctctcttcaaaataaactttttttttttttgagcctgaatctcactctgttgcccaggttggagtacaatggcatgatctcaactcactgcaacctccacctcccgggttcaagcaattctcctgcctcagcttcccaagtagctgggataacaggcacctgccactacagccggctaatttttgtatttttagtagagatggggtttcaccatgctagccagactggtctcaaactcctgacctcaagcaatccacttaccttggcctcccaaagtgctaggattacaggcatgagccaccgcgcccggcccgcttcaaaataaacttctttaccaggaaataggattaagaggaggtagaaggaaattagagtaggatcagaaagatagaaaaaggagttttctctgaaacaataggacagccagatacaggctgagcaggcccaatgatggatagagaggcacatccactgctgagctctaacctagagagagaatgtctcaaaactccttgcatggaaggtgcctggaaatgtatttattctcctgttgtttattctcacctctcttcattcctttttctttcttctgtccttgaatcgcagcagataaaaagacaaatctgctgagaggatgcatgtcacaagtggtcagatgaattacagccatagcaccatatagataagaggcaaggctggcgcctgggcaggtctgagagggtccaggaggacacacaccatatcaaattgtgcaatttagcaaatggctggtggcagactgaaatgatagttaatctgttttccatgcactaaaggcttttgccaaactaagatttgctgtgaagacccaaagctggagcccacccagggagcgggctgccttggatgcgtttcccagccttctacagtggatgccagtaaaactaactagagacatgaatgggcaccaggataaacacaaggggatattttgttcttaccattagagaaggatactgctaactggcaagaagtcccatggttgttatcttttgattagtagtagtaaaaatactatttaaagctagtagcattttttgagagcttgctttacactgggtactttttcaagtgtcttacaagtattcgctcattttatctgcacggcagctgtatgaagagaatactgtcattatcttcactgcataggtgagcaatggaggcacagagaagttcagcaacttgtccaagctctcatagctgggaagtggcagagccaggctttgaactcaggcagtctgactcagagtccaagactgccggcctgaattgtaggagagagacagtgcgggtataccaggaaccaaatcctatcggctgaacatcagtgtttaagtcgagcccagatgctctgcacaaaatacaatgtgtctgtgcacatgtgactgttaatcagccatttccttggttcctgctttgtgctggccactgagctggaccctgtgggatggataaatcaatgtcagtcatgcccctggagacctggctgttgcaaaaaggctcctgaaatcatcataacccaaaagagaaaagggcaggtgctgaagagaagtataggtaaagagcagcaaaatcataaaggaggggagactctttgcctctgtggtatcagggaatgcttctcagagcgggtggcgtttgccctgagacttgaagtaggaatttaaaaacatagaaatgcagtggaacgggaagaaggacattctaggtggagagaagtagagcaaaatggtccaatctgcccccctaagggtgtgagacagagaagtggatgggaaggccaggaaggctgtcgccatgtgggccgaacatggggagggaggtgtttgtcagaatcagaatggactcagagggaagctgagctaaaagcttcaatttacagatgaaagaagaaagaatttggatatgtgactcactcagtgtaccaagttcgtggcagaagtaagtctcaaaccccaggcttgcctccaattttctttgcactgatctcctggcataaacatgtggctaacaagggtctcacaatgccaggagggtgttacgtttttataacctgttctatttgagggtctccaaaattacatatttgaagttaatattagccagatgctaactgtctgcaggcaagaataagcacccactttacattgggagaagctagagatttgggaatcaggatttgctgcagatactttgaggaatctaggcctctaatccacagtctcctaaattctggaacttctggcttaattacactttttaataaccagtcatcattgctgcataatttgtgaggtctggtatagtatgattcctgttcccttcagctaaccctgcccccacccccatcctttaataaacgtaaaacttttctttcctgtgaattcatttttttcccttttatcttttggacctttgcaattaacatattaatatttaattcatattacctgaaggtccaagaacacttttaaactcatgaaaaaccttcactagtaatttagctgctaccaaggtatccctgagccctcattatttgcctctggaaaatgccgtaaacgacatctaacaggcttcagctctgtacctctacaaataagaaattaagcagtattcagaacgccattgattattaatttaaaagaaatcaaaaatcaatatcacattcctgtaacctggcagtttttcttaactgaaggcagttgcctgcagaagccttgtggctttccagagcaacggcgccccttcgtggtgataatgtgaactgcaccccaggcgtgattgaaaataaggcagaaaggaatgccggcctcgagcaaggacaccggttcatgcccaaatcacttctgctttcagccaacagactgtttctgccaaaagatggacgcagctagattttttttttttttgtaccgataatctgtcttaaaacttggagaggatctcttttcccctgtgaagtcaggaaaatgacagcaagcagcatggattggttcgaataattttcaccagaaatgtggggtgaggggaagggatgggactggagtcagagcagtgatctggcgggatggggtgatgagccatacggagatgaggtgtggcgccacgggctgggagtcagggattatagagtgagggtggggtaggatcttcctggtcatcaaaactatgagaaatgtaattatttacattttaaactaagccaaagactgtattgaaatgtcttacacccagaacagagaagtggtatcaccaaagttcagaattcccagctctaacgtgatgcctttggggactgcctccccaccccaggctgacctaacacacccctttgagaaaagaggatttagtttctcctgactgtgaattgaatatgtgggatgtgcccctccaggagcttctaaaatcacctctgctttgaccttgaggggccgtggtagaggggagacagcaccggcttagaaaccccacggctcggctctagtcccagcatcagtggagcaccaaggggagaaagtattcatcactgaggtattttatgatatgtatattgttcctgggcagttgcaccccttatcgcctgcaccctgtgtacagctccccattcctcctcccttggaggccactgtgctatgtaacttgctgtgggctgcaagaaagactgggctcccgtttcctcttctgaaaggcaggaatcatgctcccggctgacctcacagaatcattccacagattaaatggcgatatggcttgtctgtgttcacactcaaatccacatgttgtgggagggacctggtgggtggtaattgaatcatgcgggcaggtctttcccatgctgttcttgtgatacagaacaaacctcatgagatatgatggtatcataatggggggaggttcccctgcacaagctctccctttgcctgctgccatctatgtaagacatgacttgcacctccttgccttctgccatgattgtgaggcctccccagccacgtggaactgtaagtccattaaacctctttcttttgtaaattgcccagtcttaggtatgtctttatcagcagcatgaaaatggactaatacaaatgggatgtaaaaataaaattcttatatacttagaacggcaatatgagctttacatctgagttatgctataatatcaatcaacatatataataatataaagtagtatatttattataagttataataacagagtgagatagcttagtaatttcttgttagtatctgcaatcttggggaaaacaaatctagagaaataagtccaaactggagctgcagagtcaagtgggcgagagaaagaagtctcgctttttttgttttccaggaaagctcaggtccagttcagcaggccagcccaagagactgggagagccctatgtactcaggagagcagcctcacccctcgtccttgtccaagattggggagtgggtgcccacagcttgtatgtgtccccatgagagtgggtgtcattatgaggagcatcaaagggccaagcacagtggtgacagatgtgggggaatttgccattctgagggcagaggaggtcaaacacaagtggactcgcttattaagcccagaaagagaactgggagaggaaggccaagtgaggatggaggcggagatccagggcccatctgcaagtcaaggagcaccgaggatgctcagcagcagagccaggagagggcatggagcggactcgcttgcagagcctgtagaaagaaccaactctgccgacactttgatttttaacttctggccttcagaactgggagagaataaatttccattgttttaacccacaaaggaagaaaaagactatcaagagtagaagggcctgacaggtggccacacggcaggtgagtcagagagttgagtcacgtgggaggtagtttagaaaaggatttgtgaagagggccatcccctagcagcgtgttgaatatagtgaggaatatgagatggaaaagaatctttttagagaacatgggtgccagacatagccacagacaaagtcgtgaaatagacagaaatttgtcccatttatggagactgtggttttccacccatatgtccccccaccccatgtcatgtttacctggccctcaggctcacgctgatggccctgggctgcttttttcccctcaaaagctgatgtctggtctctaattataagatacaagatgagatggaaataattgttaacaatgtattcattcaacaatggattgtgtaaaaaaaaatgtggtacacatacaccatggaatactacacagccatgaaaaggataaagtcgtattcttcacagcaacaggaatggagctggaggccattatcctaagcaaattaaagcagaggcacaaaactcaatactatgtgttctcacttataagtgggagctaaacattgggtcctcatggacacgaagataatagtaactgacactgaagactactagagggggtagggtgggagggggacgaggggtgaaaaacaaccagcaggtcctttgctcagtacttgagtgacgggatcatttgtctatcaaacctcagcgacatgcaatttatacatataacaaacctgcacatgtacccccgagcctaaaataaaagtcaaaacaaaatattcattcccaaatcatttactacatacaaatcgttaagtcaggatccctgctgtgacactagggattatagaagtgttgaaagcttcattctcatccagtcattcattcagtgcctggctggggttgtgataagcaaaagcaaacccatccctctccacatgtagcttccagtctcgtggtggcatttcctcagaggatgaagccatccaggtagcatagcaggcatgaggtggttccagtaaatggaggtgggacagtctccttgggctgccaccctgcttggggctattcctggtagggcctggagctctgcctagagaagcccacatgccctctcctggagtcacaagggcaggccaagtattctgtcctattccagtctttgctagaatgtgtcaagtgctgtgggcttgagtccttggcaatttttgcatgggacttagtttgggggtaagttttctggaaacttgaaatgtttcacttaaaaagaaaaatgcaggattcaaagaagtaaagagtaacaaataaatagaggcttttttagttcaggggtcagcaaactgagggcattgcagctgttctggaattaatgcgtgtccgggcaagggtcagtaattctgagatgccgttctgttgctttcaggccttttttggtgaaaactcttaaaggaggtataattcttcccttgctgggagtctttgtttcagaggggttgtaaaaaaagattcccagaggataaatcatatctgtattaacttcctaatgaaatgaaaaattatatcattgctgattattcctccttggctgatatggaaaaaaatactattaatactttttagtgtgattttaatcctttgcattcacggatatttgcattagtattttctggacatcatcttgtttatatggattttattcattgtaagatgccatcagatccaggcatctgagttctgggggggcaatgctataatccctgcccagaaccaaaactttccctgtgcagatggtctttcaatagagtggaatgtgtttggggtttctgcatatttcagtttacaaacccttcagtgatggttgtcttcatcctgagtttggctccatgcttcagaagatgcaacagtgctgagaacggtgcctgacatgcaggaaacattcagtaagtgtttgctgaatgaatgaataaattaattcaacaacagctaatgaaagcacatcccttaaaaagtctcggcaatattgcgagcataataccaaaggcagaaaccataaaagaaagaattgatggattggaaggggaaaatctttttttttgagacagagtctcactgtgtcacccaggctagagtgtagtggtacaatcttgactcactgcaacctccacctcccgagttcaggcaattctcatgcctcagcctcccaagtagctgggactacagatacacattgccacacccagctaatttttgtaattttagtagagacggggtttcaccatgttgcccaggctggtctcaaattcctgacctcaaatgacccacccacctcagcctcccaaagtgctgggattataggcgtgagccaccgcagccggccagaaggggaaaatcttataacatgaatttcagataaactgttacatccttaatacttaacgaattcctgttaatcagtatacaaatattagtacccaaatagaataaataccgatggccaataaatgtattagaaacatttgaatctcacttataaaaacatagttattttcctaaatggggtatcattttttcccaatcagattggcaaaaataaacaagaatacaaatccagcctagcacatgtacgtactttcaaagggaggataatttggttcaacatgttttgaaagctggttgtatggtatgttttgaaaccttgaaaatgacccagaaattttccttctagagatttatcttaaggaaattataggaggcataaaaagtttcacctgcttattgctttgtggcttatcattgcaaaaagaaaatggaaaactacttcttcagctaaaggaagtgatacgctatcgtactagaatattaaaaatgaagaaggtagggaaaagagaaagagaatctaagcggtaaaattgtttgacctttattttcttctttttgcttagctatattttctaaagtttttgttaaaataaactcttttaacaaaaaaattctaaaaactcatagctgcttagatgataatataattataatatttatgttaatttttgttgcgaacgtatgtttatgttgaacttaccaagtgatctaagctatattactaagttcttttcataagcctctgagttcatgtatattaagcccttaacataattcttagagttaagcagagcaggtggcgttattcttccatgaccgcactgagactcagaaaagttacatgacttattcaatatcacataattaataaagagtaagactggccacaaagtccaggatgccacacacatagctgagtgcttcttcctctatcatagaaacaaaaatctggatgaccattaggccgttgttggcctgcaaaggtgtagagcaaactattttatggtattgagagcacttatcttggcattactccatctgattgtttgtgtcaagtaggaaagatacatttattattcccattttgtagatggagaagctgaggctcagagaggttgagtgacattcccaaggttgtacacagtaagtggtaaagttaggatttaaacagttttagtccgaatcccttgctctgtctacttcagtttggcataataaattcttaacttccttaacagtttgtcccatcatattcctaaagttttatgatttgatgaagtctctcttaagctccttttccacatgggtggcatgggttagcaagattttgagggctgatcttgtgtgacagattgtatttccaaagatgtctggaataatatcttgtgtcccacatactgttgtggaactatcacctctccatcccaaaaggtggaacagaagcaacactatgaaactgccaaggctaaatcataaacattcaatgcacttctgccttgctctcttgggatgtttgtgcttagaatccagctgccctgctgtgaggaagcccaagcaactctgtggaaaggaccacatggaaaggaacagaagtgcccagctcacatccctggctgagctcctggccatcagcctaatttgctggccatgtgagtcatcttgaaagtactgtaggttcaaggtttactttctgaggtttcagttatccatggtcaaccgtggcccaaaaataggtgaatatagcacaataagatattgtaagagagagactatataacttttatttacataacttttcttacagtatattgctatgatttttctcttattagttgttgttaatctcttatgactaagttataaataaaactttatcataggtatgtatgtatagaaaaaacatagtatatgtaggattcagtactatccgctgttgtaggtatccactgggagtcttggaacatatcccttgtggataaacagagactactgtagatcctcctgctcctaattagcctaccctaactgatgttgcattgagcaaagtgaggtgagccgaccaacctctgcccaaattgcagatttctgtgtaagataagtgattattctgttgggggtagtttgttatactcattttccctcctaaccccaaattaggtggcagggatggaggagtcttgcttatcatctctctatttttgttaactcctcctcgttcagggtagactttggcacctggatcacaaccttattctccaccccaaacctgccattatccttggtgacaccattatccatgaaggggacccatttgatatgttagcttctcagttccctgtcttctaccccaaagtccttcaaattcaaagtatcttactctttttgttttaaaattgcttggagtagtagagaggactctagtggaatatacaagccaaaataatcaggaatttttacatgagagaaaggaggaatgtcgtgaagggcatcaaaaagcaagaaagatgctcattttcccttccaaccccaatttaggtggcagaggtgggagcaggtgaaaagaacaaagggcattggaaaagaccacctggaagtcagtgaagaccaagcggtaaagggatccttagcttaggcaaaggctagatggggacttatctcaccaatggagccagagaacagatgttccagatgtgtgtgtggaagtgggaagaggactgattaaggaaagaagaagctcaaagcaatatagagatgagacagagaaataacaggattccagaggcacttggattttactcaccaaggatgagggggaattagttggtctcaacatttctaacggcaaagttacaggtcacctaatacatatttatgtattagttggatcagaggatggatggatggatgagtgggtgggtggatggtagatggcagtggatgaacagatgaatgaatggacagatgtgaggatttctctgtgggagattcagttcgcccaggagtgatggtgtttctgagagagccctagcagcatttgttatctcctaggctctctctgaatgttcgaagcagtgagtggcaaagaggaggctcagccctctctggattgatctgttactggggtgtacaggcattcagtgcagagttctcttcatcaatggtcaaataacttctgttacccacttgtgatggctcctgtagcctctggttcgactccatgtaacaactgaagagcagccttgctgcaacagataggaagcaggtcttatctctgatttgagaatagaaggcccggtgggtacaacctgtagcactttcaatcctgtagaaatatagatagtgatgctgttggtaaaaaggaatccaccctttccaaactttttcctaagtcagtggttgtcaactggatgaggtcttgctcaagcacaagtgtctggacccctcctctagaaggagtgattctgcaaggctgagcaagcctgagaatgtgcatttctcacctgtaatcctagcactttgggaggccaaggcgggtggattgtctgagctcaggagttcaagaccagcctaggcaacatggtgaaaccctgtctctactaaaatacaaaaaaagtttccaggtgtagtggcacacacttatagtcccagctactcaggaggctgaggcacaagaattgcttgaacccaggaggcagaggttgtagtgagccaagatcatgccactgcactcaagcctgggtggcagagcaagactctgtctcagataaaaaaagggatgtgcatttctaataaattcccaagtgatattgatactgctctaggaccacactttgggaatcacttccatcctgcatggctaggtttaaattaggcattcttaacttcatatgtggcagggtgagtggatgttgagggccccaggtatattcttgaaaaacaaaaagaagtcagtgatcagttaattcattctagtctcctgctgagactgttgtctggcttatgaaggccaggatttttgccacctgaggcatttggagaagcctatgaaggagagtagaggagaggttggggacaacagaatgaagccagccagaaaaagagactgggcatagggggaatgggaatttgaggagaaacatatcattcatcagaacttaaatctgcatttttagagaagatattataatgtgcttacgtggcctccagatgtgcacaggtgccataggatagaagtagcccagggaagccttgtcatagatgggctacataaataggaaggcttgcagcagtgttaaaagacagctgatatgattaggctttgtgtccccacccaaatctcatcttggcttataatccctgtaatcccgttgtgacaagggagagaccaggaggtaactgaatcatgggagcggtttcctccatgctgttctcatgatagtgagttctcatgagatctgatggttttacaaagggctcttccccactttgctctgcacttctccttcctgccgccttgtgaagaaggtaccttgcttctctttcaccttctgccacgattgtaagtttcctgaggcctccgcagccatgctgaactgtgagtcaattaaacctttttcctttataaattaaccagtctctggcagttctttacagcagtatgaaaatggactaatacaacaccctccatgcaacctggagaaaatgcaaagtacatatagctctcaaacttcaggaaggggatccatatatgcagacagccattctttaaaataacctttccattctcccatccacttcgctcacacgtgatagatagtctgtattatctcttctctaacatctccacccaaaactaaacaaaacattaaaaccctccagtcattatttaacttgcctctttcttcacctcacttccagtttctccccgattcacattcacaaaagcccaagaatgttatggctgatcaaggactctcctttgagggtgggaagaaactgcaggggtcaggccagaattctcttctgcagacagaggagggggaaagacaggaaataagcatgcacaacgttcacctttgttggctgcacaacagcttgggatgtgcacccagccctaggtctccagctgagatgtcctcagttgtactcagcaaaattgccaccttttctgagttatgaaagccttctctcctagagccccagtatgttcctggcacctgcaggcttttgggttttggttttggggtttttttctgtgtggtgttgttgttgtgtttcttcaccagggcatgagtagacagatcctatgcaggcactttctttgtgatcttcaggatcatttgttttatcttgcctcccaaatgctgatcacccatgggcatgcttcttgagggttgcaaccatggctttaaaacccagaacagctggtgtctgtggtctgcagggcccagaaaatattatttaatccaggaaacattcctttgttctgctctgcttcattcagacctctcctgggtcttttccttcccctgctggctatcgatttccatccaactgaaggggtgaagttcagaagcccaggagacagcctgaataatgggtatgcaagtgttgcatcacacatgcagcaaacatttattaagcatgtatactatacagggctgcaaaagtccatatgtactaggatcttacagtacacttggaaacaacaaggaatctgggtatgaggattctttaggtggaccagatgcctgctctgtgtagcagcagaactcttcaatatggactgtaaccacctgctccaaaatcaccctggggaattgtgaataaaatgcagacttcaaggctcatcctatacttgatgagatagggccctgaaatctgctatcttaacaagcacccagttggtttggctcttcatttttctttttgagacagagtctcattccattgtccaggctggaatgcagtggtgcgatcttggctcactgcaacctctgcctcctatattcaagtgattctcatgcctcagcctcccaagtagctgggattacatgcatgcaccaccacactttattttgttttatttattttattttattttattttattttattttattttagtagacacgggatttcaccatgtttcccaggctggtctcatctcttggcctcaagtgaagtgcccacctcagggacatatattgtatggtactgtagagtgctttatacttatctttctcctaaccagatgttagctcttagaatctcatcctcctactttccaaggtccctgcacccatcaccaggcccccaagggatatggacagggagagccctctggccaaattctcgctggatctcccagtggccgttcagcttggaccgccttttctcctcttattccagtgatagtccaggatatctttttgccttttttcccttaagacttccctggtcttggtatttgggattttctcattttgaatctgggggtgaagaggggaatttaggggatattggtcacttgtcttctgtgtccaaatgtgagtgtcttgctttggattaggaaacccctaactaatgaatgttgttaggggctaagaccactccaacagtagaagctagaaatcttagatactaccttgcccatctctgggtgcagccaggacactgaatgtgattcaggctctgctgattagatgtgtccctgttagacattgacatagaccccaggagccagggttataagggacaggagtcctttgtcctctggcaagggtaatttcctcctcagaaccagtcctgggctatgttgatgggcgtggcccagttgccttgtaccaagtcagttttctagtcctgactagaaattgttagttctggcagctaacaattctacatgatccaaaaaagtgagggatatcatttaaggagggagggagacagcctctgccttggtgtctcaccttccaggagtaaagacgtgtcccaagtaatgggtagctccatgcacaagagaagagacagtggagaagataagacatgcaagaggaaggatcatggaagagagacccagaacatttgcttaaccagatctatttataagttttagtccttaatcagaaagcaatgtatctttcttagaacagtaacctcataatgcattcctgaggagcccagttagtccttgctcctgtccatcccacctccttcaggcggtagaacagaagaagggtcttcatctcaccccagctaaagcatctctgcttccagaaagtgtggatgagtgggagccataaacctgggaaataagccacatgctacccttttggttgttgtttattttaacaaaattctatgaccccaggaccatgtttctaagagtagccacttgaagcagaaggaaatatttagtcaaattctacaatcacagccaaatacagtctaatggcagccagcagacactgtggaaagagagtgtcacacaccattctaatgtggggagtaaggatgatgaagaatcagtcataggtccgtgttgtagctccgtctggggagtggaactcatagggtataagtgattatttcctattcatttccttagccctgaaccgtccaatgaccacacgcaacttgactggcaagaggtgtttagaatgttgagacacggtcagaaatgattggtggtttcatgtgatgcaaagaatttcccatactccgcctgttttctggatcacctgtccccagaaattgcctgaaaacaaatcacaggttgaaactagaaataacttccctctcctaggcagcttggagactggccaccctgtttcttggtttggtaagaatgttccagacacaaggaggggagcaacacacactggggcctgtcgggggttggggtatggggagggagagcattaggaaaaataactaatgcatgctgggcttaatacctaggtgatgggttgataggtgcagcaaaccaccatggcacacatttacctaagtaacgaaactgcacatcctgcacatgttaccccagaacttaaaatgaaaataaaaattaaaaaaaaaagaataatccagaaagtcaagaaaagcctaactaaaaaagtctttttaggcaagagagcatcgtaagtaggatgtagaggaagctcccctgcttaaaacctgttaatggtcttctgtagctttcaaattctagctcctcttgcctccacgactcaactccccagccctccttccgagtgtacaagatgactcaccctgagtccagagccaaactctcggtttgcatcccagctctttgccacttactacagaccatgtgaccttgggcaagtcacctaacctctctctgcctcactttcttaatctgaaaagggggggatgatgaccacccgtttcatcaggttgctgtgcatacaaatgggcgaatatgtgtaaactgctgagaacagtgcctagcaaatagtaagccctatgtaaatgtttgctgatgttgtgttccatgattccgtggctttgaagatgctgctctctcatcctgcaatgccaccttaccttacctagcaaattccaacgtgtccgttaacattcagctcaaggctgggcacagtgactgacatctgtcatccccaaactttgggaaactgaggcaggaggatctcttgagcccaggagtttgagatcagcctgggcaaggtagcaagctctcatctccacaaaaaaattaaaaaattatccagaggtggtggcatgcacctatagtctcagctactccaaacactgaggcaggaggatcgcttgacaccaggaatttgaggctacggtgagctctgctctcacctctgcactacagcctgggtgacagagcgagaccctgtctctaaaaagttttcatttttaattttttaaaaaatgtttttaatgtatctcaagccctacctccttcagcaaagtgttctgagcacccaggtctgatgtagggccttgtccatgcttcctgaaaatatatcttctgtagcattcaatgcactggaatgcctatgttagctgaaagttactgatcacaattccggtggcctggaggattggtgagcccagctgtgaagtttagaggcttgctatcttgcccaggctgatctcaacaagtaaacattagtttattcatctgtcttctccctggtttcaagcccctggagtgtagggccacatcttacttggcattgtatccagcagtcaacatagtcctagaatatagaaggccctcatgttgaatgaatagtaaaaccctcctgaaatccattaaattcatatgtttatttactcactcattctcttcctttgttcaaaaaacatctcttgagcctctgtgatgtaaaccaagtgctttttaaccagcagcttctctctgatgatctatctgcaatctctgtgtcagtcctcacatttaactaggacaaaaagagaacatagattcttagtagctttgctcatgacctgactttaacaagaaaaattttagagaccaaaagtctgactgatagctgagtgagttctttctttcaaactcaaagccctgtttgagcctctaaacttcacagctgggcttgcaaatcctccaggccaccgcatttgtgatcagtatctttcagctaacataggcattccagaagatgttctgccctaaacgtaattggaatcctttttgaatcagttgccacagtacttctgaagttttttatgctaacttcttgggtatatttcctcaagatggattcaagatgtggccagttctcttgtgagaagaatacatttctgttgtcctaagtgtagagaccctctagttcatgtaatagccctgcaaagcaatctgctattaccagtcccagcatccatttctccttccttccttagtaataaaaccctgctttggctgagcaccttgttgcccagaattaaacactgttttaccagcttccctgatgggtgtggtcaggttactaagatctggccaaagatgtgtgtatgagttttctatgctgctgcaaattactacaaacttagtggcttaaaacaacacacatttatcttataggtctggaggccagaaatctgagatggatcttagagactaaaatccaggtattggcaacagaggtgtattcctcctggaagttattgctttttctagcttctcgaggtcgcctgcatttcttgtctcgtggccctttcctctgtcttcaaagccagcagctctctggcatgtttgtgcttctcattctcattctctctctctctcccaccccgcccccgcccctgctgtgttatcacatctcctctctctgatccttctacctctctttcataagaacccttttgattagatagaacccacatggataatctctccatcttgaggtccttaatcacatctgtaaagtcccttttgccatgtaaggtatcatattcacagttctggggatcaggacatggacatcggggggacattattctattgtcatgtataagtagagtaagtaagtagagtatggcattttcagaaatgtgctcaaagggaggtgtctcaactgggaaggaccctctttgacccttctgcctttcctttctaaagctgagatatgatggctgatgctttagcagccattgtgaaccatgaggtggccttgcggatggaagtcaagcactaggatggtagaagagaaacattaagatataaattcctgatgatgccatggagccaccttttaccaaatacacttctatcttgtttaagctactgccatcttatttgtttttttttttctggaacatacagctggacctaatctcaatcccttaaaactatacatgactctcttcttaataaactgcaaggctggttctctcagcctactaccctgcctaaggaacagataggtagtaagcatggatatgaccattgctcagaaaatgtgttccaaaaacagacagtatgtttatcatttattgatcagttcagcctctggctctgcctatacactgagccatacaacctcaatattaatctgggctgttaacattcttccagagctttgatcatggtctacatcttactccccggagaatcaggtgggcagaaatgggctactgacctatcaatttctagtcctgattagctcaaaatgtggtcatttcctcttaacataaatgtatttaacaacctgaaatagcaaatagcaaggtaactttccactgacctgtcttactattaatatcagaagtcagaggtggacctaaaaagtaaccaaacaatcaaaaccaatgtctgtaaggaaaaccagcatcgttattagtgacaccaagattcaaatcattgatttagcaacactccttagtgtattcatcagatgtttattggaaatctatggtgtggcctctgcagtgagtcagagtgcagagttgaagagatgagggtccctcaccttaagaaccctcactgcattaatggagagacagaccaagaaatgcctttgtggtttcaagaagtgcctttgttctgtttcatttttttattgtcaacaatcatggccaggcatggtggctcatgcctgtaatcccagcactttgggaggccaaggtggggggaatcacctgaggtcaggagttccagaccagcttggccatcatggtgaaaccccgtctttactaaaaatacaaaaaaaaaaaaaaaaaaaaaaaattagccaggcatggtggcgggtgcctgtaatcccatctactcgggaggctgagacaggagaatcgcttgaacccaggaggcgggggttgcagtgagccgagatcatgccactgcactccagcctggactacagagtgagactccatctcaaaaaaaaaaaaaaaaaaaaaaggaaaaaaaaaatcacaacctagattctgtaagcacctacagcagctatcctttgctggggtttcctcattcagctctctcctcattcattatctgggtcctattgtattccctttattagttttagcaatgtttaaaattatttgctgcttgaaatctaatccattttgcaagtaaccagcacctgggggcaggggtagtgatgagaaaacagggctaaaaggaataaattcacaatgagttttatatttacaccatccttttcccattcacagggttttcccatttgggaacattcttagcgtgttctctgaacagaagaccgtttctcttggtctgaagttgatcaatgtgagaggaagatggcacattagaaagatgcctggctctgatgacattccaccccgcagtcttccagcacactgggatctggggcttgaagtcacttgtctggctgtgtgactgtatccacttggaagcagcgtcccctgctcctaagttgcacaagatacttcagggagtctgctgtgatttagtgatagacaagtcagaaaacaagtttaaacttgttattaatcagaagagaacacagacatttttagctgtctatctgacttggtcatagggcagagccatcagatgccatcagtggtggtcggtgtagatttttttgtgaatcaagacaggagcaggaaaaaggggggtggaaataacagacaggttccaggagggcctggtggagggttcagctgttggagctcatttttcttgctttttcccgagagaggggaatggactgccattgtcacaggttaagtcacagaagagtgaagctcaggtgacaggagacattccaaattgagaacagacatgccaggggtccctgttgccacctgctcacaagccaaggccttggttccgagcccctcttctctctctgcattttctccttgggtgacctcatccagcctcgctgcctgaagtgcattcctacacaccagtgactctcaaatactatctccagccagctctctccccacaaatccagattcaacagccactccatgtccctactcagatggctcctacagacctcaggcgaaacatggctagcacgcaagcccaggtgtcctccccatcctgttttctcatctcagttgatgtaagctccaccgtgcacccaactagttaagctagaaacctggagtcactcgagactcctctttttctcatgggcaagccccatccatcagagaggaccaggagccttgcctccaaacccatttgcttctcttgatttcaccatatcacctgtgcccaaccagccttccatttctctaacccagtggacacagttccaaactggtctccttgcttctactcctctccctttacaatccattctgcactcagcagctaacatcttttaaaaacataaactggaccccttaccacttgaagccttccaggactttctatttcttttaaaacctgacacagcccctgccttcctggtctcctctccactgtgttctgtgtggccaacctccaggcgtacgagcctgcctcttgccctctggacagatcaagcttgcttcctgccttggagatctggccttggctgttcctctgatggggaggctcttcctccaaagagtcacacgaccatctccttcttgttcctgagttctttattctcaatgaatgaagtttattgcactcccctccccaatctcagtagtccccagtgatcctctctcccaactcccattctagcttcattattgcgctgtttttccttggtttcatgcagtttccttgttcattgactcctccattacagagtaagcttagagaggtcagggaccacatctgtttctgtctcattccccacttcagcacagagaacgatatggggcacagtaggagctcgataaatgctttagtgaatgcataaacaaagtaagaaaccatgaggtgacccaaacctcggtttcttcagttataaaatgggcacatgggtgcaaaggctcaggtgtattgtaagggtgaaacgagaggtgatgcgtgtgaggcctttgtgagctctagatctctttgtagatgcaaagtatcagtgtagattgcagtaaccaggacatcagaagaaaaccctgctctttggaagcaaagtgtgccaaataacaaagcttagctctacaaggctatcgctaagcctatgcaataaatactttctctcctccacatctgagctggacattctccacttgtccctccagagccactctccacccttcttacctgcctctgtgcctcacgggctgtcactacagctgcctcagtaagctcccttgccctctgggtacaaggcttcaactgatgggtgacaccaacaggagatcagaggggaggagagggagaccaggtaacttattccctggcagaccttcatcagagagtagctgtgttctgctgaaggctgtggcttctgtctgtccaccttctcctagaaagaccacatcctgtgggttcctgtaactgttcctccttgctaccccattcgacctgaggttggaaacttcctctagttgttgctctagccgcaggctgctccacaatccctaacccacccaaacctttgtctaaagcaccttccttacaccctccccagctgtggcatttcggggccctgttagcatccacgtgatgctgctttctacaaatgtgtctatttgtggtgacagcacttgcgctttgctttcttccctttcttatcctacctgatatcccagccttctgcccctcagctacaagaccactccataaccatagaggaccaaaatcacctaggagcttgagagagaaaatgtatttgacatcttgaaaataatgcagtttgctcaggggatttatttctccctcccctgggctctgcgctcagaccctctttgcttctgtccgactactgcaagcaggcagttaagattatttctagcaaatggacttagagaagctgagcatatgagtgatgttgaaatttgacctacacttcttttttttttttttttttgagatggagtctcgctctgttgcccaggttggagtgcagtggcatgatctcggctcactgcagtctgcctcccgggttcaagcgattctcctgcctcagcctcccatgtagctgggattacaggtacatgccaccatgcccggctaatttttgtatttttagtatagacggggtttcaccatgttggccaggctggtctcaaactcctgacctcaggtgatctgcctgcctcggcctcccaaagtgctgggattataaacgtgaaccaccgcgcctggtgagctatgcttattacttagatttctagcagataacatatagttatttcctaaaactctgttcttaacctgagctgtttttgtcatttttcagggttttagggggtgggaacatattacaggagctattaggtgcatgagtgtgagttgcgggcatatgtgagggttgtgtgtcttgtgtctatgcacatgcgcaggtgtgtaagtgggtgtgaatatgtgtgagcgttgcatgcatgcatgagttgtatgtgtgttgcatctgtgcgtgtgtgcaggtgggtatgagttagtgtgagtgttgcctgcatgcgagttgggtgtctgttgcatctatgcatgtgtgcaggtatgtatgactgtgtgagtgtgtgcaggtacagcttctgtattaataagagacgggcaatcactgtgcactgatattgaggggtagggattagagggcaccttgtctatttgggaggtgaaggagggctggaatgagaggctgaaggggtacagaagaggaaggcagacccctgcaggcctcagggacctagcctccctcccttcagtgtcccttcctctccctgcaggaaccagaaaaagtgtggaggtctgaattgcagtctctaaaatctctcctcagtctcacatgactggcttcagttttctcaccagtcctgcaaagccaggccttgaccccttatctaaatatccaaagaaaaaaatggaattagggatcttagaaggaaagagtggggcaggaaatgcaccaccagggcagtgcagcttggtcactgccagctcccctcatgggcagagggctggcctcttgcagccgaccaggcactgagcgccatcccagggccctcgccagccctcagcagggccaggacacacaagcctttgacttcctcctgtcactgctgctgccattcctgttttgtggtcatcactccttccctgtcctcagactgcccagcactcaaggatgtcctgtggtggcatcagaccagaggcccctgaagaggagtgagttgggtgttttttgccgcgcccaaagcagctggctgtcccctgaaagatggcaagtggggaatgatgatggtgcaccatcgttctgcacaccaagcccttctggataggaggcccccagcagtggagggatgggggctgccaactggcattgcccagaggcccagctcctggtcacatagactgacctagcagtgcaccagctacccgaggcagcctgcaggaaaggtgcactcatagcgatgctggaatgccatgaggcccagccatggggttgagaactggaatggagggaaatgtttgcatcctgatgctgggaaacaggagatcagtcctcaccaacgctgagatgatttccctctggttcttaagctcggttctctttctgcttgatgcttgaatctctggtgtctggcagagagtctggtgtctggcatagtgctttgtatgtaggtcatgccagagcatgctggtgactttgcccttctaggactcttttccatttcatagggacttgctgtgaaaccccgtttgacctggatataaatgttagatgtcatggagtcctgttagcatggtgagctgcaggctgttctgcatgagtcctccttgagcctgcatctaatacccactgctcaatcaatctcttttcactgtttcccattgatcccaagtgtgtcctctgtgagccttttcttgacactgggtcacccagaattactcccctgtctgtgtccccatagcaccccacaaatagttcaatcatagcccttgtaacattctggtgcaccagtttaaggacagagccctgtcttattcatcattgctggtggatgaataaaaatgttcaagtcgtaataacggcaatgacaacaatgataaactcaccacttactgaccattggctgtgtgccacaggacataggactgaacatcttacaggtgttatcctcatgtccactctctcagactgcacttctatcgtattctacagaaactgaaggatggaaggtcacagagctggtgggaggggagcctggattcatacccaagccgtgtgcctcctggccactcctatgggtgaaggaaagcaaagggcttagctgtagctgggatggagaaagaggaatctcaggcttctcgtcatattttgcctcaagaactggaaattgatctgggagtagatcccacactgagggagaaggccccagaccaagaaaggatgggctcatctatttgattgaaaacagagaagcttggaagacccaaggtagggcaattcctgaaccgtccagggctggaaaacctgtagcaaaggcctggggagatggggcagaaaggctaaattataacttaggaatctccaccaggagatcagctccaagacagcttccagtttcggcagatggaagggatacttgatggaaaaggagggagggtaagtgtcagagactgctaaatgtctttacctacatttcctcatttcaaactctcacagaacagagtctgaggtagactctagggctggccccattttgcagatgggtaaactgaggttcagagcactatacccgtaagatctttgctcaagaacttgtatgtcccagaccatgcttgaaacctggtttactcacacaccctgctgtgcagacctcctccgttccaaagtggtggcagacttcagtgtgctttgcagactttcaatctcagcacatgctgtggaagtgctagcagtgttgctgtgctaaccctgtggttaggctgatcacagtcctggtgagtaactatggcctgcagccctggcatctgaaagatgaccccttgcctctcctgctgtcctcaagaaagccttagccccctagattattttcaatataaaatgttcatacactacttttcagattcaaatttgcacaaatgaagtgaccgttagacaccactggaaggtaataaaacccccaagcctgccagccatcaggtccctcccagccatcccagaaatatgctcagctgccctcgaaacatctgtcatgctctctggtgggtgctactgggcacctgacattagatcacttctctcccaaagctgcagctctgcttattcgattcttatttctgcctttggattgagtggaaggcagtcatcagtgacagccaccctcggggaacagaaacgatgtccacagtggcaacgatcctccatcttcctgcactgaggcctaatcaatgtagcccatacccagcctccatttaataagctgattgttgagctaaatcccgcacactctccccttgccctggacgcttttgattgacaaaactaatctctcctccacccccacgtctgctgctgcccacatcctcttgcaaatcatgtactcggctgctgacaattagatataagacttgggattcggatgtgggagggttatgaggttatgaatcaattgtgggggctcaggtgagataacaaaccaggggaacccatttcagacacctcgccacagccctcagagcctcctggttgatttatgagttggtaataacctcgctgggtctcctggcccctattatttttcataatgcacaggaaagctttaaatatcagagaatggggaagtgcacagtctgagtgggagggaggtgaggggggatggggcttgggggagaacagtggccaagggcttccccgcagctgattgtctctcctgccccatctccccaggccttcgctgcaggtcttctagtcctggacgtttcaggaattgctttatcttggctttttcaagcttctctgtttcattcaaatagatgagcccatcctttctcggtctggggtcttctccctcagcgtgggatctactcccagatcagtttccagttcttgaggcaaaatatcaggagaaacctgagattcctccttctccatcccagctacagctaagtccttcgctttccttctgtgggtcaccacggggtgccgttgtcatatacccatggaggccagcaagctgatctggccaacctgggagaagaccccaggttgatgacccctggtttaggagtgcatatggcaggatgcttgagggatcactgggcccaaaatcgtatttgctgtgtctggatgtaatgcctcccacctgttcaagaccacgtcagaatgactcagagacctgcctgttaagaagggaaaattatccgctggacaaaagccagtcaaaaagcaggctcaccctgcagtctggaagccagttgagcagcgaggacaggccaaaaaggtgggagggggccagtgagtgtctctcagcctggaggtaaagagctgaagactttacctttccttctgcctgctgtcctcttcccagtgacagccagtttttaataaggaaaaggaggaggctttgaattgctacctaatatttgtttaagtagtaatttgttgagatttctctgttttgttttgttttgttttgttttttgagacggagtctcatgctgtcgcccaggctggagtgtagtggtgcagtcggcttactacaacctccgcctcccaggttcaagcacttctcctgccttagtcatccaagtagctgggactacaggcacctgccaccatgcccagctaatttttgtatttttagtaaagacagggtttcaccatgttggccaggctggtctcgaactcctgacctcaggcaatccacctgccttggcctcccaaagtgctgggattacaggcaaaaagatgtgattttttttttttttttaacagtatcagtgggtgaaagaccctgaacctttcctctaaggcagtgtttgtaaactgcctatatgatgtctggtactagattgtgatgatgttttcaagggccacaaaacaattgaggaaaaatttaaaacatactgaatatacatgtgtgggtgtttatgtattatgatgtgtatttgaatacaactatcaacgaataagcattcattagaccccaactctgtaccagatgtttgtttactccatgccagggacagaactaacagggtccctgctctcttggagctacagtttagtgggcattatgggttgaattatgttctctcaaaaattcatatattgaagttctaaacactagaactccaaaatgtgaccttatttggaaatagagtcattgcagatgtaattagttaaggtgagataattagggtgggccctaatctggtatgactggtagtcttattaaagggaaatttgggccagtcatcgtggttcacacctgtaatcccagcactttgggaggccaaggcaggaggatcacttcagcccagaagttagagaccagcctgagtaacataaggagaccctgtctctacaaaaaatttaaaaattagccagcatggtggtacatgcctgtggtcccagccacttgggaagatcgggagaggcctgggacagattctccctcacagccctcaggaagaaccaacccgttcgacacctggatcttagctgtctggcctccagaaccatagacaataaattgctgttgtctaagccacccagtttgtgataccttgtcatggaagtcatagcaaactaatatagaagaggaaacagacatcgatcaaataattacattgtggctaattccaaactgagataaatgcttcaaggagaaagaaccttgttctcttgacgttgaaagccaaaggaccttgagccagtctggagggcaatgaaggccttcccgagggagttagggctgaaggatgtgtcagagtcagctagagctgtgttccccagcctttttggcaccagggaccagtttcatggaagacagtttttccacggaccagggttgtgggggatggtttcaggatgattcaagtgcattacatttattgtgtactttatttctattattacattataacatataaggaaataattatacaactcaccacaatgtagaattagtgggagccctgagcttgttttcctgtaactagacagtcgcacctggggggtgatgggagacaggaacagaacatcaggcattagattctcataaggagcgtgcaacctacctggcatgcacagttcacaatagggttcatgctcctgtgagaatctaatgccactgctgatctgacaggaggcagagctcaggcagtaatgtgagtgatggggaggggctgtaaatacagatgaagcttcacttgctcacccgccactcacctcctgttgtgaggcctggttcctaacaggccagggaccattacctgttgggaggctgaggacccctgagctagaggaagaggtgggaggaggaagggaaggcacgacaggcccagggagtagcagatgcaaagatcctgtggtgcaatggagactgttgcattctgggaagggaaaggcagtcccaaggcaggagaggtgggggaagaagaagagggtgttgggatggatgcaaccagagcaccccaaaccagaaagatgtttactccattaccttcaactgaattacagtggggtgagggcacctattttgctttctgccctcacttccgggaaatgcgcatcctggatcacagaaaagctgctgggcagaggtcccagtctctcagtgaggcctcaccagactagtagagttgtccagccacaatgccctcctcatttccccttctgtccaacaagctgtctatcggaagatcccagtctaaaagcaccagaagacattttgagtttctctaaggcctaaaatttaaaagctgataagtaacacaaggattccaagttactgctgtctctcccagccacgcagatgactgggttagacacttggctggtatgaggtccctgaaacatgggctctgtgagtagccaatgtgtattaatattaatgcttatgatatgtcaggcactctgcatgggttcattacccctcacagtcaagatgatgggtcccattattactgtcctgttttctttatttttgagacggagtttcgctcttgtttcccaggctgcagtgcagtggcacgatctcggctcactacaacctccacctcgcgggttgaagcaattctccctgcctcagcctcccaagtagctgggattacaagtgcccgccaccacaccaagctaatttttgtgtttttagtagagtcagggtttcaccatgttggccaggctggtctcaaaatcatgacctcaggtgatccacccacctcggcctcccgcagtgtactgttctcttttcatatgaggaaataaacgcacagggccagcagatgacttgctaacaaccagatcatttcagcaaaaccatgaaccaggcattgtgaagagagttttgtatacctggccttattcttaactagacagcacttcaccctagttgacgtatgaagaaatggagatcagggcaggtggtgggtaagggacctgcccaggttcccaccgtttgtaagtgatgtaccatgagttgctctcaagtgtgtctgactttataaatgctgcaccttatcatttcctatgcttggtaagcaagtgagtgtgaaatttgccacgcttttccttggaaaaactcaagcccattgaccaaacaatactacttgaaaatgacactgaacttttcatcactgtgtttctccacctgtgttcccttctgtcttactgccacctactcattgtgctcaccctccaaagcccagtttaacatttcctcttagttaagctttctctgctagctgatcattgcattttttttcaattaaggcataaaagaaaaaaaaaagacggtaaagattgtcctacttagaatatccttccattcatttgcaaaatggagataataatatgctatttacaacataggattagtatagcaggattattccagagcctggaatatagaaagtactcagtaaattattagttcaacagctaataatagtaccaattattattatcactaaattaatgcctctgtttcaggaaaaaaactgaatacatacagaatatcggttttctaattgttttttctttatactacttggaaagttatacagagttaagagacacagaatagtatagtggaaataatatttggcatgaaattgcctggattccatcagtagtagcctgtggtcttgagcctctctgggcctaatctttaaaatggatataataattatcatattggacacaattattgtcaagataacatgcgataacagggtcaagtgcccagctctggcctggtacaccatgggcactcaggaaatgtcactccgccttcataagcattggcctgtgcatgacatctatgtgataaggtggcctgaagctgtcctccccacccagaggtgcagcagaggcctggcaggaatgtgaaaatccaatggatcaagtcataaccttgactgaagagtatggtgagttcactcatggcaggaaccatctgatcattcatacggctccagaaacattttactcaaaagaaagtgtctttccccaacagtcaagattgataattagtttatgaattgcttcatttatcagtactatgatgtactgtataatccaccaggtttcaagttactggaattttgcaggtgatgggaaccagtctttttatcaactttgcataatctgatctgggctcagattgatagaatgctttgggaagaatcaggggagtgttttatactaggatctcctgcggttctgatgcgttaatgggaggaagctatccctgtcaaattctacaattttggaggagcttaaaacacctgaagacaaagccctgaattttatgagtgtctgcctgaaaccagaaacagaaaccccttacagcttactcaacagcgttaattcagcatggaaaggcaccaggaaaagatcactgcgtcttactcccaccaagtaaacaagctaacaaacacagaggagaggtgcaggttggcacccttaggccggactctgggtggacagccctgtcagagtctataaagggtcgctctgaggctccaggagtggcagatggccagagagtggccaactggaggcacactattgagcctcgggattgagcctcccactgtttacccctcaggaaaaagagagctttgagtctcctggccctttccccagagagcaggaaatggccagggcttgaggatagccagaggccgtccaaagttacccataccatctccactttggcctcagaggccagctctttcttctctctgtgctttttaaaataaaaacttatttttctagtgtaaaagtattatatgaatgttctatgaacttcaaataatacagaaatgtaaagaatagaaatttcccattatttgatgcctcccgctccccaaaataacctaaagttaacaatttaaatatatatccagaatttttcctctccatatttatatatatctatacatatataattaatagaacataaatattttacagtaaccctgttctcaagatgcttttccactgtagatgtttaataaatatttattgcatgaatgagccataatttatttattcagtcctctattagaggcctttggtttgttcccagtcatctaataaacatgattttagatataaaagacataattgaaatacatataacacatacagaaacataacccataactgcatatcataaatatatccttaaatatactaataaaacacgcatgcaatggagaggtgttttgggtgccgtctggtgtatatcctggatatccctggaatatatattgataaatcagcctcaaaaagaatgctttcagacagtgttttaggatctgtgggaacaaagggtggccatcctgcatttgttatgttgtttcaacatagcatttgttatgttgttttattaactttaagtccttggcaaagcagcttgactaagataagatccagaaaccagtcgtggtaacaaggcaacaattaatcttagatagaacagaaaaggaatccgcttcaaattctctttagaacaggaaggaaagggtgatcgtgggttagcaggaaggaaggaaagaggcaagaaaggaaagtgaaaaaagaatggaaatgctttctcctgctggtgatttggatgtttggactactcttgtcagatgctacagcgtaatcactgtaaatgttttaaaggacgcgatattatgacagatttccctttctgacttgttcctggggctgcacacacaatgatttactccctgccacgggctggaggcttggccactcctgggttggtccaaggaagcctggaatacccaatgcctgtgagagtgagcacgtccccctgtctctaggtgttgttgcttgtgctgaaatggagtctaccaagcattgccatggcatggaagggatggtggcggagtagatgccactgcagattgagtgcagtgtcccaggcagccaggggcagccgctcagcccttgcctggacctgaggactgttgcatcagtctccagatgagacagcagctgtcatggtggctgaaccagggaaaagaaactccactctgtggtctccatggggctagggaaaaaaggaaatgggtttttgtgattttcccttctttagaaacaaaagtgcttaaatgtgattctttagctctgtaaatgcaaaccacggcctggtggactggggagaacaattaggccaaaggctgagcacaggaagccaaaagcgggtggaaacccagacaacggtgctgagccgggggttggggtggttggggggagcggatatgatagcaaggaaggagtttcaatgtgaatgaatactaattagtgacatggatattaatgatgacagtaattaacaggggaaaggaagggctgtcattgtcccagggtgagtaatcaatcttggcaggtgataaataatggttcagcaagctcagcagaaagataatccgcaggcctgggggagaactcagctaatgcaggaaacctcacagtttctaggcaacccacagaaaagaactattttttttttcttttttgagacagcgtctcactctgtggccaggctggagtgtagtggcgcgatctcggctcactgcaacctccacctcccgtgttcaagcaattcccctgcctgagcctcccgagtagctgggactcaggcatgtggcaccacgcctggctaatgttttgtattttaatagagacggggtttcaccatgttggccaggatggtctcaaactcctgacctcgtgatccaccctcctcggtctccaaaagtgttgggattataggcatgagccactgcgcctggccagaactatttttcttttgaggaaaaaacagattagagtatctctcccacccccagcttgggactacagttcttatttgatttctgctttgttcttcatttcctgggacaaatgttgaacttgtataacttggaggaaagggacacacaggcacatgtacacacacacatattcattctctctctctctctctctctctctctctccaagaatacgaatgaatacgagtgtttttgatctaaagtttgactcacagatgctgtccaggagtagcaagagtgaggagaagcctagaagtgctgcctttgaggttggcgcggggaaactgcaaaattgcaaggctgtgtcggcagaactggggcacacaggaggatgaggatggccctgggggtcccactgtgcagggttacttcacctgccatggacccagagagaaacaaaatgtctaggctttctgtcctgtaccagtcccacttctggccaccagtcacatatctaagaaaactgatttctgggaagagggcaatcctcatgaagcccctctgctggatccccaggccttcagccaggaatccagcccaggagagttcttggcacatcccctccctctcaccaaagcctcagacccacggtaggactctgatatctaaaatgtctccccttgcaggctgtgttccatcaaacaatttagaggtgacaaagccacaccttcaatggtctgcactggtttaaagtgagatctttgggtggcaaaggtagattgaccagaaattcagaaccttccagaaaactgaactcctctactgccatgtacacagtgctgctctcagaacattgtttgcgggtcacattttcaaagagaggcagacagaagggaacttattcagaggattgggaacatatggtgaggaactccaggccacaccctgcaaggaagcagctgagggacccaggcctgttgcacttggagggaggacgtcgctggtatgccgcaggactgtctgaatagctgaagggctgtcgcacagagtggttaggttggggtttgtttttctatcatcaaatggcaaaactgaggccaaagggaggaagtcagagaggggcaagtttctgttcagataaatcaaggctgatttaactgggtcaggctgggtaggggggagtttgtgagtttccaggtactagggattctaaacacaggttacagcacctcttgtccagggtgttgtgaatgggacatgtattggctggggttggagtagacaagctttaaaagttccttcagggccgggcgcggtggctcatgcctgtaatcccagcactttgggaggccgaggcgggcggatcacgaggtcaggagatcgagaccatcccggctaaaacggtgaaaccccgtctctactaaaaatacaaaaaaattagccgggcgtagtggcaggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaaagttccttcagactcttaagatttatattcgttaaggtaatactagataccaaaacagctaagtcccaaatttcaggggcttaacacaacaaagttcagtcctttcagtcctcaatcaagtcagagccccacatgggcgtaatgtccatggttggaaccgtggctccctgcctattgtggctctgcattcccccaggtctttggagtcccccacatccagccagtagatgggattgaaaggggcagagctaaggagagccatgtaggagtttttatggtccaggtctggaagtggcatatgccatttctacccatattctattggcagaactcagtccatatctaagtgcaggggaggctggaaatgtaatctagctatggcacagtgaggagaggaaagaggtcttggtgaatacatagacgtttctgccacaaatgcagggacacattcattcaggataggcctgtgccggaagagatgagagttttgcaagaacctatgaggtcacctgtgttggtcagcccttgtaattgatggtagggagctgatgaggcctccttcttcaagaaatggtctgggggccaggcatgataaagcttcacctagcacgtctcagggaagtcctctatagacacttcctagaaacatgaatataagctcatcctgcatcatcagaagtgagtgttttttggacaagaatggaattgtaactatggaagtgtactgaagaatggaaagggttggttaggacaaaaaaaagtgcccatattatcctgctctacagtgtggactgtttggaattaggattctcttaggtaaacatgtttcttctgccacagtgttaaacacccaggaggtcttcagctgaaattgctttatcgttgcaggtactgacattgtgcagtggcttatgaagaacctttccattgaggacccaggtacttgacctttgaccccacccttatctcccctggtatcagtaaacatcccataaccaagttccaaactagattcccctgccctcctgagaactggtcttgtaaatgtgaattccaagacgtggaatcactctatttacaaataaaattaatttattttctccactgaatatttgtctttaaatttaaatcatgctttgaggaaatgagcaactttttagaatgccaaagagcccaatacaataatgtgtgaaatgagttgaattctcattagctgcagcaattaaagataagttgtagcactgtcactgaacagccttctagagccagctcttaaaattagattgcctgatccacaattaagatgtttaattatttgctaagactccctctgttttctgcttctgcaagaagtgaaggaatgattttttttcaactttaattgcgcatttcaattaggaagaccttaccaggaaaacaacaacagaaccctggccaataaaacaatttcccagtctgttctcccaccagaaaataggcagtaaaatttattttcacagtgtaattaggaaatggggggggtgttccagaaaaataaaaattcaagataagtaaagcttattcccatgtgctgtcagttaatacttttccgaatttattacatactcctttgccttgattaactgagtattcttgatgcctgaaggtcacatttataaagatccactaatacactctgatgttcttaatggacattggcgtgattagacttacctgccccaaattaaatggccctgaaccacaatgctttttgaagatttttttgaagtgcccattctgcatccgtgaccttcagctgtgagtccctgctggaatcggtgtgtcagcttggcactcctgtattttaacccaacatttctaatctgttgactgcaaaacaatacagtttctatgcagttcaattatatacagttgttagaactctgagtgccagaaaagcagatcattcatagaagtggcccgagtcttttcacccccttgattagtggctactctcacaactagtgaaaattcttaattctagtcaagttcttgattcacagggaaaaaactataaatgctaaccctttgtaaaggatagaacccaaagcaactcactatgtgttgtccctgatgcagcctgtacttctgagtgtccgcttggaaagcctggactgaatcagcatctacctgtttagttacatttatctaaagtcagtatttcttgtgattataatgctaaactaaggaacgtgtttcctcatggccaccttttctcttccaagagcactggtttctttgcctcctaaaataatcgttgtatttctgacatatattttattattactattatgagaaccctaaattggcgagcagtatgtgagaatgagcttcaggaatcctccagccctggcgtgagaagcttctgtgaagggtcctgaatgatgagagttatttctatgaaaatctgttatactctgatgcccttgggaagacatcatggtataggggcctgtttgggcttctgagaagtggctgaggagaagctaagaaccatttgtcagctgggaatagtctaaggggggagatgaggcaaaccgaggccttgggaaacagtcagatccagcatctgcccctctctcccttctttttcccatcagtcgatttcctgtggttattttttggtttttgaggcaaggtctcactctgtcacccaggctagagtgcagtggcacgagcatagctcactgcagccttgacctccctggcccaagccatcttccacctcagtctcccgagtagctgggactataggctcctagcaccacatccagctaattttttgttttattttttgtagagatggggatctcactgtgttatccaggctggtcttgaactcctgacctcaaacaattcttctgctttggcctcccacagtgcttggattacaggtgtgagacactgcacctggccccattggccaacgtctaagcaaaaacatttttgctcagagaatgaagttagagtcttagctccaagactggtggcatgaaagtcaccttcctacaggattttgttctttcttctctggggaaggagcaactgctgatgatgaaacttctgttctagctggactcatggttcttgaagcatatggactttaaaaagcaaaccggccagacatggtagctcatgcctgtaatcgcagctctttgggaggctcagctgggaggactgcttgagcccaggagttcaagaccagcctgagcaagatggcaaaaccctacctctaccaaaaaaaataaaaaaaaaattagacagacgtggtggcatgtgcctgtggttccagctacttgggaggctggggcagaagtatcacttgagcccaggagttcaagtctgcaatgagctgtgatcatgccactgcactccagcctgggtgacaagagtcagacctgtctctaaaaaaaaaaaaaaaaaaaaaaaaatagcaaattggtcatcactaagcaagtaaaataaaactctattcattccaattccaccagttacatgtatgtttctttcaaaggagaataggtggttcttgatacgcaaaacattgcattgtattcaacttcttgaaaagtttgcaagtaaagccaaaacaaactactttaaaaagtcagagctcgtgaaattaataattgctagaggctccctgagcacattaacaatttccatgtccaaaaattagttttaacctgtaacagtacttttggatttgtgaaagattgtgtgtggtagaagcattgaggtttgttattttttcttagctctgctcaggataaatctaaattcttaacttttttttttttaattgagacagggtctcgctgtgttgctcaggcttgtctcaaactcctgagctcaagcaatccgcctgcctctggattacaggcgtgagccaccatgcccgacctatattctcaactttctatgtgcatctatttatggctggtgccaaaggaacgaaggaacagattgactgtggcaaaaatataagtatttctatcaggttagcctctctctgtcactgcccacttcagtgtccttcctctaattttcaaaggaagtgaggttttcctctctgtccataagagaagggtgacacccttctcattcctgatgggactgtcatattggggaacgcactgggagtcctacgtctctatgggcagcgaggctgcattcttactgctggggatgatgaaactggtatgaatcagagctgctagcacttacggagtatttgacctgtaccagacaatcacttcatgtgaaatatctcacttagttaaatacaggttcttctatgccagaacttatgcccttgaccctgaagccagactttcttctgaaggtcagggtgaggaggggttaagccatgtcagactctcagaggtgggattcagacaagtcccagacacatagttgccctttccagccattggcatctcccctcctcacccccacactgagcaagggcaattgtatcatcaacacagacatctgggggtgatgacagttgacttctggtctcccagcttaattttcagccaaataacctgctttctaattccttctctctctatgcactgttcttacagttgaagcaatacacttggggagccttatcgctgcccagggctacatctttccaatctcagaccatgttctcaccatgaaggatgatggcaccttttatcgtttccaggtaagcctgctggctcctcctcctgaagaaccttttcttcacaacatcatctgatcttaggttagaactacaaagaaaacctagggatatctgagggagtagccctcactcctcatcagcactgggaaagccaagagaacttttctctgggccactgggtgacccacttagagaatagtaaaaggctgtcattgagagcctaccatgccctgggcactgccttagtcccttgggctgctacaacaaaatacctaaactgggtatcttataaacaaacaaacaaaaaatttacttctcatggttgtggaggctggcaagtccaagaccaaggtgccagcagattcggtgtctggtgagggcctgctctctggctcatagatggcaccttctagctatatccccacatggcagacaggacctggggcttatatcagacctcttttataaaggcactaatctcacctgtgagggcttcaaaggccccacctcccaataccatcaccttggggattaggatttcaacatgtgaatttgaggaggatgcagacattcagaccatggtagacactttgtacagatttcctcatttattctgaagagcacactttagggggtaaatattacccattttacagaggagaaaactgaattgctcaaagaattaaagtgtcatttagtaaatcctggagcagccttcatctgaacctaagtgagcctgatagcacagaccttgatctttctactgtctcatgttgccttctcggagtgaagtttctatttgcgacctaatcaccctccccacccatttcacactccttctcccagatccttccgtagagggaatgagggcagaggatatgggcttgaatcaaggtctaaccaaagggtgtgggagaagagttcttcagactaggttaaagggaggaaaggaacatgggcttaggtgcccagtaagttatgccagcctgacttttgtacttagacctctattgtctcaggataagaatatattgccctgtgaacaaaacttaacatttttgcatttgttttgcttacttacattttgcttctcaatgcctaggttaaaatgttgactcaccttagctgaattagagaagaggagagaattgtggggtagcatcagcaagaaggagatgggggagagcctgccatcagggaggctcctccctgggtgtgggagggaagcgcaggcatggcgcgcccctgagcactaacacccatgctcctttgcaggctccgtacttctggccttcgaactgctgggaacctgaaaacactgactatggtgagaactgaagccactgggaactctcaacttcaacactgtgtgtcacttctgggggtgcagaagacaaatgcttggtgtgggccatggtggtacatggggaggagggtcctttctgcttagtcctttctcatattgttgctatataacaaatctcctgttccacataacagaggaaggcccagcttactgaaagatgtagtccttggaggggaagcaggagagggaagaaaaatcttatcaagggtggtcagtatgttcatcttggggccatggagaaccaggatcccacagcaacactatcagatggtgacttttaattgttctttccagggatagggcttcagggagggctggatcaaggggctacctcctcctggccctttctgttctcatagacttgtcaaaacttactaagaaccttttggtgttcttgacagttgcaatttagaaaagagacagagaccagggaggagtatacagaagtcactctggactaggaaaatagagtgggtgaagttgagagttctgtctctctagacagggacctacaagacttctgccagatattctcagtggagattatttaatattcctatatgccaattctctgaagaagttttattatcgctatgcttaagagaaagaacctgaggcccagaggggccacaccctcacactaccacattgtctgaatgctcccttgattataagcctcttgagggcagaggctggtccagcttatgcattctcatatctccagggcatagcctatgtctgaggcagaattagtgctcagtaaatatccactgacagttctggttctttattgaaggtgaccaacagacactcactagagggagcagaacttgaactcagatctgagtggctccaaaacccatacttctttcacggtcccatgtgtgacatgcctgaaggttgtagctgcagcactgcccctttgcatgcatccttgctgctgactcagctgctgtggcagtctcatctgtggctctccttgggactgggacactcaatgagacctgcagcttctttgcagaattgtttaagacaagaaggcagatgcagctgtggtgagtgggagggagatgtgcagctgggtggtgatcaggggagcctgtctgggagacccatgggataagatacaaccttggagtcacacgtttgagcaagaggaaaccaacaacagggagccaagctgaggatggaatacaagcgagttgtacctactaaggctggagttgttccatggtcaagtgtggaggacgtcagtcatgcagaagggcaggctctggggctgtctgcttggctatccacaggcaccactgtgggccctctgacactgtgctgcaccctaaccaatgtgataagtggatccaggaagacttccgactgcaagtgagagctgcatttgaccgctcataaaactagtgcttctggggctgaaaagactgctcatgaaagcccaactcagaatttgaataattatagctcagttccatgcagcaacgtgtgcccttgtgaatgtgaaaaccagtatttttccaggcagtggagagggtgggaggatggtaagaccagatacctgggcccaagtaagattaaaatatttacttccgtaaagcttagggcatcttatgctgcatactaaagggcatcatctccctgttctacaggtgttcttcattttataattttaattgtgcatcatgaacagggagagaaataatagtttgtttcaggctctcattaaacaaaaattattttaaattcctgtgcctcaatttatggcaaatcagagggagaaatcaaggttcaggatgcacaagtgttcaccagggaccaggcatggtggtgcatacctgtaatcccagtgactcgggaggctgagatgggaggatcacttgagcccaggagttcaaagctgcagtgagctatgattgtgccactgccctccagcctgggtgatagaggaagaccctgtctctaaaacaaagaaaaaccagtactccccagggtttccaaagcagtttagttagaaaatcaggatgtatttatgaagagagaatccagcacaatgagcccccaggatcaacccgttccactagctgggtgatcttggcaaattacttaacctctctgtgcctcagagacctcatattaaaattagagtagtaatggcacttgtctcctagtgttttgttaggattaaatgaaatgcatgtaaggttctctgagttaatacggagtggtggttggtatcactactggggtggggtcggtattattgccactgggatgttggttgatattattatgactgaggtgaccgtctcaccaggaagcatgtgaaactgaagctaagaattcaatatagtatgatttggactgatgaagtaccagaaactttcattcaattgacaaacgtttactggtccctactctgtcaaattctatgtcagagatttgaataagtcacagcctttccccgcaagcattccaggctgggagaggcagcatgatgcagggaagaaaggcatggtgaggatctggcttgagtattcaaaggttttatgtgatgaatgactgagaaggctgaatagcttgggaggggcaggtttataaaaaggccttggcagtcaagtagagacatttagaatggattcagcagtttggggaagctattgtgggtccccaacaatgaacacactttcccaagttttttccctacttgggaaaaaattggttcatctataagatgggggtaataacagaacccacctagtagggttattatgaggattaagtggactgtggaagattaagtaagggctgtgacttagtcaaatagttcctgatattcagtgggctcaatggaagcagtagctgctacgatggtgatttttccagcacctaaaacggtacttggcccataggagacactcagtacatttttgaatgagtgactgaatgaataaatggatcggtgaatgtcatagaggaaactctgcactggtcctcgattctaattccatctccatcactaactagcccttgggtccatcacttcatttctctgggcctttagtttccccatctgtaaatgaggggcctgtacttgatggttgccaaggttacctccagtctaaaattctttggttctaaaaagtcatcagaaagtatgaggaaaatagagaaataagtgagttataggttccctagtttaggagattgaggtacataatgatgttgctagtaaaggcagaaagtaaagaaaggggtcagtttcttcagtacattgaaactcgataagctcaatattttttaagaaatttaattgcacatataatacatgaatgtgttccctttatacaatttttaaatatgtcccagttttgtgtggtgacacatggtgaacttgagatggcagtggatttctctgagtgagatgtgagatataggtaagggtggaatgccagatgtaaggacaaggaaatagaaatttttcggtaagaaattaaatatccaagagaaaccaatatctgagcttaagacagttcttccagatgccctcttgtagggctggctattgtcaccagtagtcactagagtcggttggaagttagagcaagccctagtgagggcactctgggatgcagacaagccccagggagttctgtgccaagaacagccacatcccaccttcctcattgtggtgaaaagattccttgtgtgactttaggcacagggacattagctagtagcatgtgaccctgtgactcatggccatcaggagtggccccagctctgcattccatgcatgataactcacttcacaaccccgctgtcccattttgaccccgcttacccatttggacatttcttgggatgactctgcctgcataaaacccacagtcaaatccaggttagccttttctgagttttacatttggccagtgcaaaatcctgtccagggcagcattgtcaaagcagctgccacctccactgacctgcactgctcaaaggtaatcatgacctggcccagtcgagctggtgacatgtcaagcttcctgcctgaggttgtccctaattctgccaggggtccaagagactgaaggaggtactttgtgatagatcggacacccctttatcagacacagtgaagcactatagctgcttggttcattggaaaagttggtaagtagaaaatcatttttaaaacgacatatgcacaccttaagcacctcatgtaaaggtaagatatacaaaggaacactcatttgacagccttgtgaagtaggaccaaagtgttctctttgattatgagctgaataattttagtttcttaaatcaaccgcactcaaaataaactaccctgttttggtatctttaaagtgcatcaagaatgtaaagacatttttgtagtcttttgtatattggcccctcctagatttttattatttttcttactttttcctgttatctcacctgtatcaaattcaccagcaattgccttagctaactctccttcattaaattgttccaaaccattcaactgagttttcatagaagcaacactctctctcttttcacattaatttcattgagacgtgtgatatttagtgaacttgtgtgattaaaataacagatgtgcctgatataagcagatttgggaacaaccacaactgactcctatgagcacacaattcgccgggtggaagcagaagtgtgggcataccagagggtaggctgctagcttccaggctccaaaatgtcataggtatcagtaaatttttcagaacaaatgaaggaagttggttgatccagcaaagagttgactagagatctcttagtaaagagatcttgttgtccaacaacaaaatgatcacaggttctctctggccctccctcttgatcattctgttgttcatttatttatgccattcatctactgttttccctggattgttccacttggctctggagaaggaggaagacattgaagaaggaaaggtagggagaagaagtgatgatgaaggccatgtttgaggaagaaacagggaaaccaggggccaagaacctttccttagcctgagttgagagacctaaattgtcttccctttccatagcctttttactgcacctgacaagacaggctatggtgctagcaacagggatgaaagctgagcaggacatagcctctgcccttaaagagacttcagcctagagcaggggacagtctagtaaatacaggatttcagtgcaatggaatttagttccatggtcaaggacatgtagatgctatctgaaacaccaacttgggtcttcaaagattagtaagaggttgccagatagagggaaggagagaagagagaaagactttcctcaaaaaggacacatatgcaaaagaatgaagctgaaaagagtttggtggcctcacagtgcctgcatgagggagaagaagttgatgagataagcagtgagcagatcataaagaaccatatttgccatcctaacgagcccaaccttacttctgaggccattgaggactccaggcagagcttttaggcactggagtaatgtggtcatgtttgtgaaatatcactctgagtgtaggatgttcagggtgaagcagagtgaggaggaagaaggggagttgtcaggattggaatatggaggagtcctcatttgatcatgactatgaaaggatttatagaggtcaggggtcatgaggtccacttagaaaacatatttttcccaggacagtgctcatgaggtccacttagaaaacatatttttcccaggacagtgctgggcacatagcaagggtgggtgggcgggctgtctggatggatggatggatggatggatggatggatggatggatggatggatggttgggtggatgggtggatgggtggatggatggatggatggatggatggatggatggatgggtgaatgggtgaatggatggacagatggatggatgggcttataattccattgtgctgctggttttgtacatgttgtcatttcctttcttccctcagccatctatctctgtaagaggacaatgcaaaataaagcaaggctggaactggcagattatgaagcagtaagtatgattattttccaggatacatataagaagagagtaaaatcatatctgcagctccgtctaagtttattttttttttcttttgtcccccttttgtccctttcagacagtggaagggaagtatcttctatttctcctcccttgttctcagctcctctgaccatcacaataagatggtgtttttacataaataactcttaaaactcaacaataaaaaaataagcagctcaacttaaaaataggctaatgacttaacagatattttaccaaagaggacacaaggatgataaataaacccatgaaaagatgtccaatattattagccatttaggaaatgcagattaaatccgtggtgagatactgttacatacctattagaatggccaaaataaaaaatactgatgataccaagtgatggtgaggaagtagaacaactggaactctccgctttgctagtggtaatgcaaaatggtacagccactctagaaaatagcttggcagtttcttataaagttaaacatacacttaccatataaccaagcaatcccacttgtatatacataccctagagaaatcagaactcatgttcacacaaacacctataaactaatgttcatacaagcttaatctgtgataaccaaaagctgaaaacaacccaaatgcactttaacagttgaatggttaaactaactgtggtacatccatacaatagaatactactatgcagtaaaaaggaatgaactgttgatacacacaaccacttgaatgagtaccaagaacattatgttgggtgaaagaaaccaatctcaggccagccattccatttataggacattcttgaaaagataaaactatcatgatgaaaagcagatcaatgattgctagtggttatggatggggtagggaattgttggaaggtgatggaactgttctgtatcctgatcgtggtggtggttgtatgaatctatacatgtgttaaaatttacagacttgtacaaaaggaaaaaagtcaaatttactacataataacatttcaaattaaaattttaaattgcacctttatacccactctcctgtgcttagtagcagaggcagaatctaagggtaaaattcaattcagaaaataagacaagatgtgtgtcacatgaggtatctacttcccagctttcttaccttccttctctatctttcttcataagatgagacttcttgcaaaaattagaggccccaccaccaaacttgggtccattcccatttgacagagcccagaaaccaaagcacttgaaaactcatagatcatttaattttttttttaacttttggttgcaaaatttttcccccaaactgaactttacatgggtcacagagaatgggagaaactggctaaactttcttataccttctacttccctctccctatatgtcttccaaaggatgtgctgctgagccatgaatgactgaagggccagcagctatggaaggaggggcaacattaaggggagcagagaatccttccctggatagtccagcattaacagcatcttcagacccacccaccgccaaagcccttcctgcttttactgcctcagtctttcaaaacaagtgtgaggccccactctgccaggccttacctctcctaggttcatgttcccaagcctaccaagcctaccaagcctaccaagccagctgggccatcgctcccctctctacagcccaagtgtgaatgcgcatgccattggggagcaggacgtgtgcatggtccttcacctctttgatcccactggcattgtggacctgtgaatggggtgcagggggccagaagaggaagaagcagtgcagcagtttgtccagagccctcaggacctggctagagtttgcattatcagatgatcatatgttggaatattatgatctccccagataaaccttggcctggttgttctgtggctctggacatcctgggagcccagtcatgcccctgtctgccccaatgcccagcaatcacagcacccctccttcaaaagactgctgttgtactctttgtgcgcccagtgcaagtagctttgacatgatgacattacctccttaacacaaccttgaggaaaggcccagacagtagaagcctggggcccctccctcctgtgtgtctcttccccatattttcaatgttttggaaaaaggtcccatacagaaatcagacagcatcaactcctgctgtatttgattcaatttctcttctcttgtcccttaatgttctgctctggtatttgtaaagaatatggcattgaggccaggtatggtggctcatgcctgtaatccccaaggtgggcagatcacgaggtcaggagatcgagaccatcctggctaacatgctgaaacccgtctctactaaaaatacaaaaaattagccaggcctagtggcacacgcctgtagatccagctactcaggaggctgaggcaggagaatcccttgaacctgggaggcggaggttgtgagccaagatcgtgccactgcactccagcctgggcaacagagcgagactccgtctcaaaaaaaaaaaaaagaatatggcattgagatgtgctctcaggttgaagttctgcacaaaaatgattcaaaaccaaaaaagcattttgcttccaaaatgcaataatttttttatgaattttctgattacatattctttttacaaaaacaaaaattcaaacagcaaagaaaggagagaatataacctgtgactccccctcacctaagttttttctatgcatacatttttttctttacaaaactatatcagaatcataacataaacattcttgtggcagctgcttctctttccccagtcattatactgtaggtatctcggggtctttaccatgtcagtaactataatctacgttattgtgtttaatggctgcctagaattctatgctatgactgtgtcacagttgattgacatttaggcattaccagttttgcttcctatgagcagtggaagagtcacaaagacagtttttagaagtactttcacaccaagcctgggtgataactgtgagctcatgtgtggtactctccaactgaagctccttttatattaataatccattaatgagggtaatcaattcgtgttggcatgagctctatgaaaatacatagcataatatgggctccggccttgcattcatcagaattaggaggatcattagggcgcctgtcaaactcccctcctcgccgcccatcctcatgttccattaggtaactctacagacttagagaaaatacttttctttttctctaacggcagccctcaatgacttttctttctgttttgggctttttctttcatgaacatcacaaacgtagacactccgtttggggcacttttttttttttttttgaaacagtttcattcttgttgcccaggctgcagtgcagtggcaggatctcggctcactgcaacctccccacctcccgggttcaagcgactctcctccctcagtctcccaaatagttgggattacaggcacctgccaccatgcccagctaatttctgtaattttagtagagatggggtttcaccctgttgaccaggctggtctggaactcctgacctcaggtgatccacctgccttggccttccaaaatgctgcgattacaggtgtgagtcaccacactcagcctcggccactttgaatcctgacattagaaaaagcatgaaagccaggtccctttggttttcctttcctgtgtccttcccagctccccactggaagaggagtcctgagaaatccagcctttggttttgctcctggagataccagcaggtggcaaagactcgttaattccccaataaccacagacaattttcccgattttcagcaacctttgaaacaagtgctgtgtgagttgcattcttgtaaaacaccttcatgaagagaggaatcaggtgaaccatagagacttcagacttaatgggtgtgtaaatgaatattaatagttcagctctgtacggagggtctggcgcaaagtcaaatgggatacatgtccaggggatttaaagcaggtcttgctattttgttggaagtaaccaaaattgatggatgccttataataagcataggtgtcgatgtgctaatttacgatgattaatgccgccttgttgattttcatttctcattaggaaaacttagcaagactccagagggcctttgcgaggaagtgggaattcatctttatgcaagcagaagcacaagtaaagtaggtgaacttgatagagaccttttcagagaggaaaagactctggaatttggaaatggtgtgaaggtgggattgtcaaagtgaagtttccagatggcgttagtatttctaatagggcctgagagcaactgagtagaaattaaagtcaggatggataagttttgtcttcataatcaatgcttctctaaagcaatttcagaaatgtgtgtttcagcagacaagggagatcctcccaaaggtagaactctggttataagaaggtgtacctatttccccaagagatttccagttattttctgtgttcaaaggctgaaatcccattttacccgttggactggagattttgtcttcatgggaaaacaggttggagttttaggaagaacaacaagtagcccctgtcttcttttccctgacaggggaggagtttagaaccaacagaaaaagaaggcacagaagtcagacagttggagtccaaaatatcagattattacattaattaaaagcaagagtaaggctgggcatggtggctcatgcctgtaatcccagcactttgtgagaccgaggtgggggtggatcacctgaggtcaggagttcgagaccaacctgactaacatggtgaaaccccgtctctactaaaaatacaaaattagctgggcatagtggtacatgcctgtaatcccagctactcaggaggctgaggcaggagaattgcttgaacccgggaagtggaggttgcagtgagctgagatcgtgacattgcactccagcctgggcaacaagagcaaaactccctctcaaaaaaaaaaaaaaaaaacaagattatagggcgtgacactggatatgtggccccaggtgaaaattaaatctgcccttcctgtacagaggtgtgtatctataggcctcctctccccagcatctccaccccaccccaccagggcataggtgacccctgtaagttttctgcatgcagagagcagctatcctgagcacaggctgacccagatgggggcccagagagggagagtctgaacttcttcaatttcttctttcaagtctaccaattagttaagtcatttttcctccacaaaggacaagagatgaaaggaagaaaaaagttggaagggtttttcccagatttttttctcctggatacatagtggacatttcttcctctctaaggaaacatgaggaatgggtactctatgttccccaccccacaaacatcgttgtcaaccagatccatttaattctgggaaacagaatgattggatctggatctcccctgtccctcccagggatgatgtctaggttagccaggatggttagttaacaggagaagtgggacaggagcaggaaagggatgctaagctgggagaatgggactatgtttcctctgggtaccacctgcatgtgagcagccgctgagtcttcagagcaacattcctgggcgatgttgcagcccgtggcctggagccgggtctcaggctgtgtgggtgtagactcatcacagctatggtcacagttggaagtgacctgaggccatctggtccagtggcctgtacactgccattgctgtgaacctccccccacagtctctgcctttctcctgtccatgatgccagccacctcctgaccacccagcagccccccggggataggcgggtaccaggcactgggtgcccccgaagaggtgcaggtgggagagtaggtaggatggaggctgggattcaactggactaaggcagaattatgcctgtgtactcagaagccactggaaagcaaagaggaacgctaatttgttcttccagaatcaaacagcatcacaagttataaacagaggggaaattgttacttcataaatacatggtatttctcgattaacttttttgattaactctgtgattacattataattgtgggccacctaagtacacagtaattatcacaaaaatcgcagggtgattatgggtttatttcagtccagtaaagtaaagcgttcccgagagagccgagacctaggagttacacggcaattaatctgagttgctttttacttgaaataaaatgaagtaatacatgcttttttaagaaaaaaaaaaaaagaaagaaaaagaaaaaacctcttatctatgctgcagatcagaacaataagaatctgtctttgtcacctgcaatttccctcttgcaatttgtgcctcccccagctgaggccagtgatatttgcctcctggatcttgtctcattctagggccattattctgcctttagaaagccagatggtgtaagtgacttataaaacacataattgcagcattttaaagacatttatttctactgattctaaatctaaagcaaactttcaaatttgaacatggaacactggcaagatggtggttacattccatcttataatttgtatatgcagtatcctttttgataagggggcatatcaatggataattcagtttttaataatccaaatcttaatacttcagatgaacagctgcattcttattcttcccttaggccaccatgttcattacacatgtatggcaatctgtaatctagcctaaaacaagttctcttaccatgtgtggaattcctgaggttttcggggggggaattatacacccctatttcacagctctgcagagagcaggcaccatgcaggtaccaatggccttgtgttcacttagcccctagcaacaggagcaaacgctggagcaagtgtcagaagggaaaacagaatacagagcttcttatttccttcctctctttactctttcaggattgaccggaaaaaagacaagacagaaaggaaaattttggatagtcaagaacgagccttttgggatgtccacaggcctgtggtgagaaagcgctactcaattctctagatttttttttcttaattgttcatttttatctctataaagaaaagaccgtctttagccaccaggtgtctcattcttaagaaaatcgctcagctttgtggaactggtttcgccattcatttatataatctcagtaaattttctggaatatatgtaagttccaccttttaaaaattattcattcggccgggcatggcggctcacgcctgtaatcccagcgctttgggaggccgaggtgggtggatcacgaggtcagtcgatcaagaccatcctggctaacacggtgaaaccccgtcgctactaaaaatacaaaaaaattagccgggcgtggtggcaggcacctgtagtcccagcgactcgggaggctgaggcaggagaatggtgtgaacccgggaggcggagcttgcagtgagccgagagcgcaccactgcactccagcctcggcaacagagcgagactccatctctggggaaaaaaaaaattattcattcctgaaaatatggaattgcaaatggagaagctatgggaattccaccaaaagacctttgtgtcccgaaggtttacattccccaaattaacaatttccatttccactgctattcaactctgaatcttcaactattctctgtcgaatacggttaattcttgttatccatggcagttatgttctataaagtctttgcaaacactgaattagcgcacattgaagcatcactcccgtgggaactaccaagctaggtccccgtgagcctgtggccacaacatttttatcagctgatcgatacataaccttttaaatgtgtttctgtataaagacagcttatgtaatatatatcattgattcattaacattaaactcatggccaacagcactgttgctcatgcctgcatgtttatttcctcctaaggcacatcagagaatggtgaacagcacttcagcactgtccttggggccattttaaacagcaaaatcaccaacaaaaagtacagaaatgcagaaaagttggcactaaattagccctaaatagaagggtctgaaacaaaaaggcaggacgtcaccttgttcaatttcagtgggaaacacacatatcaggctactcaaggtacaactactgagtaaggagttataaatgaaatttagcaagcaggcaaattcacaaatgcaaaatttgtaaataatgaggtttgactgtatttctgatttcacgttattaaaacaaatcttgcattttcctcatgaaatggaactaaaaaataaattattggtcttcttaaaatttgattaaaagcaaaaaataaataaatagctactcatcctgatatcgtggagtctttttcaaacggttaagtatgtaaaaaaaaattttaaggactgtgtctgaggcaatcttgccacttaaatagctaatttgctcttagaaactgtacactataccctctacatatcatccttagattatgaggtaagcttttctagatcgtatgggaactccacagaggaatgcatattatggcaaaatggaaaaaaaaatcatgcattgtctgtaatggaaaaagataaagattggtcctgatggtgtgacatgggctaaattggaagtgtaattttcacgtagtaatttatatgatgtgttttttttttctcagccaggctgtgtgaacacaacagaaatggatatccgaaaatgtcgacgtttgaagaatccacaaaaggttaaaaaggttcgctagtttagctgagttaaaaattcctgatgtgaatagcccttccagttctagtactattcaaatagtaatttgctacttgtaattctaccaccttttgtcatttgaaaccataaccatttcacaaatattgattgagcagctgatgcatgcttggcgctgtgctcgtgctaggatacagtggcaggtcctcatggagcccacagcctggcaggagtaaaacaagccaacaggcaacagggccatgaatgctgtgttaggagaggtacaggacagttgaggagcccaggaggggcagctaagccagacctggagtgggtgggggtggggggcttcccaagggcttcctgaaagagggtcaggtgttctgaagggtaagttgcagttgtcctggggaggtggcagggaggggaggaaacaaaaggagcaagaagtggcaaagctcacaggtgaaagcaagctttatacttagaagcaaataaaagtcttttttatggtttttttttttttttttttttttggatagagctggatcacccaaactcaaaccaccatcttgtccaactgtgaatgacccagtggtcacttgtgtttcactttactcaaaggagtagtggtcacagcatacccgagggtgccatgctcagactcccccacgattcatatgtcccaccctctccacagcaccagggacaatattgcaggacagcatgaccagactccgtaatattaatttccaaagagtgggccaggtacggtggctcacacttgtaatcccaacacttgggaggccgaggtgggcggatcacctgaggtcgggagttcaagaccagcttgaccaacatggagaaaccccgtctctactaaaaatacacaattagctgggcacagtggtgcatacctgtaatcccagcttcttgggaggctgaggcaggagaatcgcttgaacccaggaggcagaggttgcagtgagcagagatcgcgccattgtactccagcctgggcaacaagagcgagactccatctcaaaaaaaaattccaaagagtggagatgtgtccccaaacattcctatttcttgtgatgaccaattagctctctctcatgtatgcattaaaaaaaaatacacgcacacacacacacacacacacactagacatggcgtatgtatataaacttctttaatctacttacatattttgttcgtcactgacttaacaatatccactgtattatattttaaaatgttagtcctaaaatgtcctcatttcatcttcaagagccccataattctaacattacagaatttcatggagtcacatccaccttatctgagcccttctgcattttgatgattttgactacacattgcatgcccttcagtgtttcatttctttcccattgcaaagattgtgtttagtctttccgtaatacgaggaacagctttaaatgtagctatagctacggacatgtggaaaaacttaggccagaaaactgtttaacttgaaagggaaaccctgaaatgctgccatcccagttttgtaccagatgggaatctgctgaccaacggaaatgtagaggggatcttttgtgcatactctttggcagtggctcttgaactttctttattcagaatcatttggggcatttgataaaagtgcagatttccaaacccacccacaaagattctgatgcagtaagtccagggggcgaggggatactcagcaacgtgtcttttccaagcacacccaggtgattctttgcaggtggtctatggaccatatttggagaaacactgagatacaaggaggctattttcagcccaataaaagataggatttgggttatagtggtaccccaaagatgagatgacatgccttaagaggcagcattctcatcattgaagaaataaaagcagagaccaatctcttattgtcatgaggggattcacgaaattggatgagtcattggactagctgacccctaagccaccctccaattctgtgggtggatgatcctctgtgcttgcttcttctcctagtccgtgtatggcgtgactgaagagtcccaggcacagagcccggtgcatgtactcagccaaccaatcaggaaaacaacaaaagaggacatccggaaacaggtgaatgaattgacagcttgcactctcaggaggagacgtggccagtttaaaaaccctttcaaatgttcaactctgaagattgagcaagctttgagttcctggaaaccacagtggaacccagctgtgggtgattgaaccttttaagtgctgtgtgtgaacaagccacggaagcttgagagaaagaattctctacccagttcctccagcagttactagaaaagggcgtaaatgagtcatcccatgccttggggtaactgctgtaatggggtttcccacagtccgctgtgggagctggaggaaggagggggctcatgtcacacagtccttataattggaatgcaccagctcaggatggtctactttattgctgtgatttgaaaggaaagtttaagaataaataaagctctactcccaatgccatttcagcattacttggttgaatgttattttctttcatgatgagcagcccaggtcaacagacaatggctaattatattacttccttctgatatttactggtaacaaagcaacctactgtttatattatgccttgctggttcctagagggcaaaacccaaaggagtaaactttgaggtgcttgcccttgacaagtttattatctgatgggtaagaggtaatggatatatgaaaaaaaaaagctatttggcggggctcggggctcggtggcccacacctgtaatcccagcactttgtgaggctgaggcaggtggatcatctgaggtaaggagtttgagaccaggctgaccaatatgatgaaaccccatctctactaaaaatagaaaaaagttagccgggcttggtggcgtgtgactataatcccagctactcgggaggctgagacagcagaatcacttgaatctgagaggtggaggttgcagtgagctgagatcatgccgctgcactccagcctaggcaacagaatgagactctgtctcaaaaaaaaaaaagaaaaaaagaaaaaaaaaccacacagaaaaaaagctatttgatgattccagtcaagcatgccaaggacatgggtgtgacgtgcctgtgaaaggtgggcagaggaggggtcactggggattgttcaaaacaggtatttatggggcacatttcacctgtccatgctgttgctaagctacgtagaaaatacattgcctttaaattttggaaagcaagacttaaatcacaccacagtataggaggagatgagacaaaggctaaattgcagaatatgaatcttgtatgatagggatgtccagaggcacaagtaatttgctggagggcagagctgagggagttggagatgtctggccagaggaggtatttggatcttggtggaaatgcaggatttgggtttgtggagcgaggggaaaaaaataattttagtttggtcttaacatctgtgttctctattttcccagataacatttttgaacgcacagatcgacagacattgtttgaaaatgtccaaagtggctgaaaggtatgttttcctttaataatattactactttcttctaatttaacagggaagaaatgttacagggttatggttaacgaatgtgttcaatgccaagagttagactgtagttattccttagactggggtgcagaaaaacccacaggctccatgtgagtataactaagataacagacctcccttgagtgatgtcaagaaatgttccgttgctaaggctttacagggggtggccacgggaccttgtcaatcaaggaagaatgtcctttaaagctacataatgcacctttgccttcagcctctggattaattcaaatggaaattgctcccctttcagctataaaatgcccagattcactttataggggaaaagaaattatgtgtgtcctttgaggtgctggctgcatagacaggaggggactggatcatcgggaagtgttccgcctccacacgccatcaaccactgaactgcatcgaatcagctgtaaagaaaatatttggcccctccagcctggcttccacagcggtgtgtgtgcttcattctgcaccagtagctagttccactccgttaactcatgggagactcaattttatcaactaaatggtctgtttttttaactcttccgtgaagatgggagaccacatggggaatctatatggaataaatctaaccaggcagctcagtagtgaacatttattcatccatatgctaccgttaaagcaatgaccaattgcttaaggaatcaagagcttaagttgggtcttggtatttattggatgtcagataaactgagtcttttaagcccagctcctacagggggctggctgtgagagccatctataagcctgtaagcctttctctgctggctcctgggttgattcacatcttttttctagataaattacaacaaatggaaggtataaaaactccaaccccaaacaaagagtctgattgaataccctaccttcaggggctaaggacatccctggacttgggctcacgtctttattccagggtttctcgattgtggcactagtgacattctgagccagataattccttgttgtgttcttaatgtcctatgaattataggatagttagcagcattcctgacctctccccattagaggccagtagtcccccaccaccacagctgtgagaaccaaaaatgtctccagacattgccaaatgtcccctgggtggggtgaaagtcactcccattgagaatgactgacactcctgctttttctatgcaaatgtgctggaaagttgccctggctggagctcagcttacactgaggtactgatcactctggagtcgctgtttcagctagctgtgtaggctgcagaatcacctcatacctcctctctcatcatgtgtggcttctggccagagtaccaggctctgaaaatgctttttaggtctcactgtggttcctttgccccagaaaggtggctgtgagtgaaacagcagcatggcctcaactctcttggtgtcatccatggcctgtgaggaaccacgagcttctttctctgtgaactagggacagaaatggctgtcctagtatactttgagggtcggtgtgctagcaatgctcatgtctggccttggaaggtggaagagctctttagggtttgcaatttagaaagagcgtatatatgggagcatctgtttctttggatctatttgctcaggtccagtggttctaagtaccgtaatccaggtgagggagggggttaaaaaatggaaattcccaagcctcagccctagggattcagattcagtggttccagggttgagccaagaaatccacattctggataatcttcaagtggactgatctggtctttcaggatccggtgaagccattgcctgctactcaggctgacctgagagctcacatccaatttgttatatctttgggatgcagagaaagagcctgaacctgtcagcatgagggaggcagactccagggcaggtgtgcagagagtccaaggaatggaggaaaccaaggtggaggcggggagcccggcccatcctattgtttgtttgtttccttgctgtcagggaggggccccacctggtaccacctaattatgcttgagaggctgctcatattgaaggattattccaactggctactcctcggtgcccagctagaagctttcatgagtctctgcccggcagaggctggattttattcccagcagcaataactggcaacttttcaatgcgacacgagggtttttcattagagccacaaggaaacccccagataaggaggaggagggaaaggagacgcgtgttagctggagataaagcagctgggagccgggcctgtcagtggctctgtgaagatggggccagggaggaggtgctggcagctggtgagaagctgccagagatgcaggctgagctctctcaggtgggcacgcacatccacatccacatccccatcctgatctggcttccctgggcctgctccaggtgataagtggcaattccatatcccccaggaaaccgcatcccccaggaaaggtcttcatcatttttcacccagttctgtgagaactaatagtgaggagaggcaggagggctggggacagcgaggctgggctctgggatgtctacagtcagggttggactaaagggtgcatccagaccagcagggagggaaaaagggaactttgcaaactaaaggggcagaacagacagtttaggggatgggtctgaaaccgaccatcgaggtttgaaacctacccctgccatttcctgttttctaactgatgaagccagtggcttcttctctcggtgcctgtttttacctctttagaggggagatagtagttgtatttaaattataggattaatgagttcatgcatggcaaaagtatggtccagtccttgggactcagtctgcacactgggaatgtgaataataattattttccagcatgacacttaacttgtgctttggaagagagcagaattcaaggccatgagacagaatgaactggatatatggtgcttaaaggagcaaacaaagggcaggccaaggagggaggctgctaatgcaattctttcctgcaccctctgtctccccccagtctcccacacagagatctctgcaggctgcccaaggctgaccttgcactgcatgtctccttccactgcctcacacgccatcactaatctggggctttgcgggagaaaagacttgctcttctgcacagaatttctcagatcatcccagttccaaatattctgtccattgtcttcctgagtgcttaagtgtccccaaaatgccagcatcgtggcaaccaaactgcatttcctaggctgccttttgcacctggaagcaacacaaaaggctttctgagctgttacccaatttttgttgcagaatgtattgtctctgcacacacacacatgagtgtctcagataaatgacacttaacaccctaagctttttattttaactttttttttttttttttttttgagacggagtcttgctttgttgcccaggctggagtgcagtggtgcaatctcggctcactgcaagctccgcctcccgggttcacaccattctcctgcctcagcctcctcagtagctgggattacaggcacctgccaccaagcctggctaatttttttgtattttttagtagagacatggtttcaccatgttagtcaggatggtctcgatctcctgacgtcgtgatccgcccgcctcggcctcccaaagtgctgggattacaggcatgagccaccgctcccggcctattttaactattttttaatggcagtgtttcttaaatatggttcatccactttacttcctaataaaaggacactacatttcagttaattttgctagatgactcaagagtcagtagtcttctattatgctttaaaactgtcagtggtcaggatcttataaggtgccctgcttccccttccctaaatggccccagataataatattctttgaattcctgtttctgccttttagttgtctgtctgtctgctttctctactaacccttccccccaacacccaacccctgctttccaatctgtagcataccatgtgtatcagttagctgtcactgagtaacaaaacaccccaaaactcagtggcttaaaaaataggcttttactattgctcacatgtctatgtgccacctggctccactggtctcagccatgtttctctatgtggctatgggttggcgaggcagctctgctgatcttggctgggctctctcacatgtttggcttctgctggtttaggatggcctcagctgggacagttgagcactccttaatatggtctctcaccctccagcagactagtttgaccttttccacatggggatagtgggattccaagagagagaacagaagcatgcaaaactcttgcagattagaactggcattctgtcgcttctgttaccttttattggctaaaacaagtcactaagctggactagattcaagggcagaagaaatagactccttttttgaaactgaactaccacaccaggaaatcaaataaccaaattgattagctttgatcctaaagcaagtgtgaaaagtcttttttgtgaggtgtgttgttcccgataacaatgaaccttgaggcatggtgtttatttcatctgtagactatgcagaggctcttatgctcacttatctcatttgtgttctctggatacttgaagttgccagataaacaaggtcctactcttctctgcaagcgtccccaagggagtccctttttttattcatctaagccttatagcacttgacaaaccaactttgagaagcaacactccatgcattttagtcccaaactgtctagtctccatgtttggctgcgattccccagagacttctcccgacccatagcgagcttacaccacaatcactgcagctatcccagtgcactgctgcacacagagggatcaaaatgtttcattccgtacctgcatctgtacttggctcatcctcaccctattactgggagccattcgtgtgtcacagctgactgctgaattgattttttttagcatcatctcacttgcctgtatctgagattgccgctgctccctgaaattggatgctggttcttcctccacctcctgaccctcagtgatcatgaaatgtaattaatgaaatgagataagacagcaagggactggatacccctaagggtctattaaaaacctgctagggtgatagaggtttgggaacttaatgtctaattatagtttcaggggaggaaaaaagagggtcacagaagtcattacaactttgcttttatgggatttcagaaaccatggggtctttgctcctcctttctcctagcctgttctaggtgacagaaaaaaaaaaagaccggaggtatcattacagccagggtgactgtatctagaccaagatatggaatctgtagcatgtggaaaagaaggggcctccatacctggcctggtgtaagctcttcttcctgcagggctgaattcaccttcatgctccttcactcatcccaagtttctctattgaatgtgttttctctgggtgacttgcaattaaggagttctctttttatattttccctacttcccaccttctccaagtgaaaaaaaaaaagctagattaattaattaattgctaggaatcaaactttcttctttcctctccgcagtgctgctctgcttctcattttcctttctaatcagatccttcctgtcctggttctctgttgtgcatcacagttcagaaactgcatgtagcagagcgaggcgtgccagcatgctctcctcttcaccccctttaatattccaattccaggtcttctcatgtagaggctctgatttcataatgaatgctttagtgcatttgtactgtatttctaaagtaggactaatggtcgtatcccataatgctttagattccaggcctcgtttttgttggattttgtttgtttgtttgtttgttttcctggatagtagtttcccatagctgcaggccatacttcactgtccctttttcctggagcctagccatgtcagtatctcttcatcttctccccacctgctccatatatgtgtccttagctctagggattcctcctaggcattgcttaactcaggatggacagcatttcttcttcctccaacttgtcatagttttgtgtggtttttttttggtggggggcggtcacatctatacaatttgtagcaaaattataagtcttttgttaagagagaaaggataaaatctacaacttttatttttgtcatattttctcaagtggttggactgtatgtttactaaattctctttcattatttccttcccctccatgtttatcaaaggtagaccctaattagcaatctaaattgggaaggttttgcattaataactgtcctcctaccaggattggttactattgttagaagctgtgactttgctgttagctcagctctaacaactctctgagatccagagagctgtttgctatttaatggcatagtaggctctgaataatggctactaaatgactgaccacagagtgtacccctggtagccatctggtagattttttttttttttttttttttgccattactaaaggttcatggggcaggagtatgtgaacaaatagccagttccacatttccactcaagacccagttcaaagcccacgacaatggtgggtagcacatttgctaaaggttcacagatcagcatcttctagtgatgtgagaatttgtcatttgaaaataacaaaagcatataccaatcaggagtcagggataaagggacaagaatgctaaaattgctcattgagaaatattgttcctaatggacttctgaatttcctatatttattttatttcttccatctcatcccaattctgcttttctgccactcacacccagcggttggaggaccattgctgctgtgtactgttatatgctggacatcctacaaagctctttacatacctctattttcttctccctttttgcttctcctctcctacctctagtctttctgtggtcattggtattgactttggactgaaatggtactgtgcgttggccattgctgcctccttcattggcctgcctggccttctcattgtcttgtgtgtcccaagcagactctgttcatcttgtaatctgtacactaccaggaagcacatgttctgaaagagacaacctctctggctagttctacaaagggctgccttgatgaacttgccttcacactcccatcaccttcattcccttttcaactgtattggtttgattccaagcaataaaaccccagcttgaacctggttctgcaaaatagaagcatgccttggctcccagaatacaagaaggggctgtggaattgaaccctgggaaaggcagcaatgctactgagctcaggaaaagctggagccagggccttcagtgcctccaagacccattcttcctctctggtcctgcccactttccatgctgaccttattctctttcatgacagacatgtgttaggaaacatgacaccaccagcccttgaactttgtgactatacaactttgatatggtttggctgtatccccacccaaatctcatcttgaattgtagttcccataatccccacacgtgatgggagggacccagtgggaggtaattgaatcatgctggtgttttcccccatgctatgctcatgatagtaagttctcatgagacctgatggctttataaagggcttccccccttcattcagttctcattctccttcctgtcaccatgtgaagaaggacatgtttgcttccccttcccccatgattgtaagtttcctaggcctccccagccatgctgaaccatgagtcaattaaacctctttcctttataaattagccagtcttgggtatttcctcatagcagcaggagaatggactaatacaagcttctactgctgaagctggggaaagaagatatgaacctcacttgcgtcaggtatctgttcctggacaaatcaaccatggccaggagcagggcttataaataaatacatggcagctcctgaagtagccttgtgtacatgtcagagtacaattctcaggagacaagcagaagtgagcagaaacccatagaggccctctatgcctgctcacccattttggagtactcaccatccagaatccctatctgcttcactcagattcccaagagacccagcataagggtcaacccttgtacattcactgtattcctaggcagcacttctatctccatttggatctcctttcatgcctaagaaatggtgctggacagcctaggcacaaacccaaaagccttttaactctctgcattaagcttagatcttatcctatgtggccaaccttcatttctttcctgtgtcccaccttggaagctctagctaccaggcataaggcacctccagcccagactaaagagacaggagagcaaggaaagggtaaggagtccttgctttcatttcttgtgctgtttctgcacagtctgatgatgttgagaagcataagggaagaggagatcgccttccctctctgcccagcgtggggtgttctttcacctcctctcagtctttggctaccccagctgtgaagttaaccctctctgctactctctctgggaaggatcaccctcccctcccaccaagaagctgggagagcagttgaggcagcagactgctaaatgcccaggtcacccatgggaaactccaagatgcactttgctgtctcctgtcttttccatgcaatgatgatggcaaataggacaaatgagggtgcatagattcatgaacactgggtttatttgcgtgggttgtgatagtggcagcaaaataaaacatggcggtgccattatgcaccttttatctactgccacactctcctccaggtgactttattttctacatagataaatatagtaagaaatacataataatacatttattttttcacataaattgcagtcaaactacacctgtggtaggcagaataatgatctctcaaagatgtccatgttctaatccccagaacctgtgaataggttatgttacatggcaaggagaattcaggttgcaggtggacttaaggttgctaatcagttcaccttaaaatagagagattatcctggattgcccagatgggcccagcataatcacaggttcccggaaatgtggaagagagaggcagaagagtcggtgtcagagtgatgcagcatgagaaaaccatagctggctttgcagatggaagggggccacgagccaaggaatgcagggagcctctagaagctggaaaaaggcaagcaaatgaattcttccctagagcctccagaaggaacatcgccctgctgacaccttgattttagctcagtgagacccatttcagacttctgactcttagaattataagacaatacatttgtattgttttcagctgctaaatatgagataatctgttccagcagcccttagaaacaaatataaaaccccagtctctccccttctcatagaatctgaaggccaaattgttcatcctctttgtctttaatataccagcatctccgagcaccccgctgactaggagtgcctcttatagccccaatacgtgtatgtctcattctgatgattcaatacttccttttcccatcaataaaatacaacattcaaaatatgtatgcccatctaattttactgtttcctttacaaagcctctgactttatttatgtaacttaacaaaatagatttccctcttctaatacaataaatttcccttccgaccagtaccactcatctctgacactggccagcagattagttgctcgtaatgactttggctttgttgcctggttcaggttgtcaggactttctgtgttccttctccacgtgttcctctatagcatgtcttgacgcctcttgcctagaccttttttagagaaggcatgacatggcacaagctcccaggaacaatttcattcatgcttaatgcctgttgcaaagtcatattttttgctcttatgttgggtggtcacaaaaatctcaccttgggctctcaaccacattctcctaaaccaacatcaccatgagctctcaccacctctcttccacccacttctctaatgatattccaggatttttcttaaagagatctggctatgagcctgtatttcattacagcttaaataatcatattatttcccatttccttagttgctctctggacttttaagattctactgccttaggctggtcagcggacagctgccttcattgccatgcatatagtaataggcagctggagcctgcaggctcctcttgggaccaggtgctggctgaactctcaccacagcctctcctgagccttccctattgtcccctcagcccagcactcactcagggctccatatggggacttgtccacaggacctgacctggctggttggaccccacttcccaggttggagatgtgaccacatcgaggatctgctagaacacatttggggaggggtctgataaaaaccccagcctgtctcattgaaatctaaggaagcaagagggaggaggggaggacatttcatttttcaatccctatgttctacttcagggaaatctatttctggtcttaaaaaaaaattccccaataacgtaattaattaaaagaggtcctaccttttgccttgagctgccaagtggatgtcttttatttgagattcaaagctaactaaggctgagattattggaatggccagggcagatgtcctgggaggacaaagggggcccccccaccggctgtttgctcatctcagattttgagaatgccatggatgctgaaatgcctcataattgggagaaccccccaatatgtcatcgtgactcagatcctctggggcacctcagtacaactcgtcaccccctgaacaggatttcggttttctgctgctggcttgtctttgtgctgatctgagcaaaggagacaggtagcccagtgttctctctgtatccccacatccagcttgctctctcacattccctgtagtgggttgaatagtggagccccaaaagataggtcctaggccttacctgtgaaacctgtgaatgtgacctcctttgggaagagtctttgcagatgtaattcagttaaggatatctacataaatcattatggattatccagagactccaaatccaatgacaagtgtcctcataagacaaaaaagagagcggatgacacaggcacagaagaaagccatgtgaagacaaagacagagatgaaagtgatgcagccacaagccaaggcatgcctggagccaccagaaactggaaggaaaagaaaggaaaggaaaggagaggcaaggcgaggtgagacgaggcgaggcgaggtgaaattatcccctagagccttcggagggaggatggccctgccaacaccttgatatcagacttctagcctccaaaaccgagtataaacttctgttgttttaaccatttgtggtcatttgttattgcagccctagaaaactaacatattcctcaacatgcaatgccatttcttttataaagaattcaatcagcccaagtagctaagaagtggcttccaggtgcagcaccaacttgtagcctggtccttcctgccatagtgctttcttacagctcccttgcccaggttcattctgcctgagatgtcgtaaagctcttgatatggtttgcctgtgtccccacccagatctcgtcttgaattcccatgtgttgtgagagggacccagtgagaggtaattgaatcatggggcaggtcattcctgtgctgttcccatgatagtgaataagtctcatgagatctgatggctttaaaaatgggagtttccctgcacaagctcgctctctttgcctgctgccatccatgtaagacatgacttgctcctccttgcctcccaccatgattgtgaggcctccccagctacatggaactgtaagtccattaaacctctttctcttataaattgcccagtctcaggtatgtctttatcagcagcatgaaaacaaactaatacagctcttattggtgaagcctggccccagggaagatgcataccttgcaggagatttataggacagaggatgtgcctctagtgtgcccgtggtttcgcttgtctattttatatttgtagaggattgtcaagattctttggagatgctttcccattttctatcacaatggtcctgagtgctcaacaagcctgttatataacatgatgaacttgacaaagatcagttaaatgactcaaccaagaattcaaactaaggcttttcaactgggaccactgctgcttctaccccaggggtcatgataaacacctgggacagcgaggaggctctgaggtgtccgaaaatttacatccatcttcaaaaccaaaattaccaggggctctttcattttgatttgatgaataaaacatcttgtgtcctgaatgtttcagaaaattgaggaatgagatatggttctctcaaacttggatgtgcatatgaatcacctgggggatcctattaaaaagcagaatctgactcaggaggcctgggctgggacctgagatcctgcattgctaacaggctcccaggtgatgccagtgcagctggtttatggatcacacttccagtagcatgagatggcacctctgactaatttctctgcctgttcagcattaagctaattggccattattgccctttgcaattcagtagtaggaattgtggctctgactttgctgttgtgggagaagatgctgacacacaagctggcaatgcttaaggaaaaattttattgtggatcgataaccataaaaatattcataccttttggtcaaataattctgcttatggatatgcattctaaataaataacccagaagatgaaaaaaaaaaatctgtgtgaacaacggtgttctaccacagcactatgtatattaaaaaagaaaaaaatctgtgtctaataaaaaggaaacgattaagtaaattgtaataaagtcactcaatgcaaccaagacaatattgtagacatatgttcatcttctccctttcctcaaatgcaacatgtcactaaaggaacaaaaatggcatgaactcacaaggttaacaaactattaataatttcaacacatttgtccaagatacaaagtttacgtaattggggaacataaccacaggcccctatgtctgtatttgttattttttatttttttaattggtcagcgagtacaaggtatcaaagtaaaatcttacaatttttatacatttctgtatgcctgaaatatttcaaaatttaataaaaaagaaagtgcatagggacagagtaaagaacattctaacctacatgttgggggcagaagtgatgtgacaaagtgagccagttttcgcaacaaagcctggccttggctcttgaaggcactagggaccatggaaagcaggaatgaggcatggggctaacagcagaggaatggtcaagtctgtcacaggagactttgcacccctagatctcctgccctactaggaaacaatccttcccacctaccaccactgcaggagatgggcagttttttcttgagagaaattgagccacatacgctcagatctcagacacatcagatctcataagaggccacctgaaaataagagaattaatggaagctctacgcactgaactgtggggcctgtagggatggaaagtgtgatacctttcctcatctaccataaggattacggccaacactgctataacaaaagaggttaacaagagaaaagcataaatgcatttatttcatcagtttcacatgacacagaagccttcagaaatgaagactcaaagacccagggaaaactgtatttgtgcttaggttccatgaagaatgggaagccttgtagaaatgtgattggacaaaagggtgtgatctactggtaacagactgaggggaggaaacccagcaaggcctgtctgttcagattcttcttagtgtctctgagtagcattcctacctcccaggtaggacctctctggaatgagggttttcaagggagaagggagcgagtgacctttctaggttttgtggcttgctttgcaggagaggcattctagtttctatgacccactttggcgaaaaagaattcttgtttctatgacttacgtcgggggagaaaaagggatgggagacgggggcaggagagaaggtgaaagccttggcttctgaggcccttccattctcctttagttcaaagtactcagcatgccaacatactatactttagggtatcatgttctgagccccaacagaccctcagcccctccccgaccctgctctcaggcctccaggagccagacatatatacccacaggcaagagactgtcaaagtacaacctgtgggccaaaccatactccattctgtttttgcaaataaagttttattagaacacagtcacacgcattcatttgcaagctgtctatggctgcttttatgccacagcagtagagctgagtagtggcaacagacaccatctggcccacaaagcctaaaatatttactatctaggccctgcagaaaaagcttgccaatgcctgccctagggaaaaatagacgccccagaggaaagactccagatccctcatttggagctcccattaaaatactggtaaacttccctatgacaatgaagcccatcagtgacaagccccatccacacgcccactgagccgccaagcaggtttcagtacctcagtcttaagtacaaatggatgtccaaagattttccagacactccaggaaggctcagcgtgaaagagtataatcaaaataaaccgacagaaaaaaggaacttggaagaaccaaaataattcaacaactggaagaaacttacaataaaagtatagaactcatattatctgagaaatgagaaggtatttcatccataaaacaagaactagacactatgataaccaaaagtgaactctgaaacttagaaagtaatggctcaaaattaaaaaataaataaatagttaaaagagagtttaacaaaaagacaaggagatgaaaaatgggagggaaaataaacaattcaggatgtccaatattgaactggaaaaaaaaatataggacaagcaaacaaaggaaacaaagggtttaaaattagtgatgaatactataaaattcctgataattattttcttatctatcacacactgtgcccagcatagtaaataacaacaaccagcaagggccatcatgaaattgcagaacactctagcaataaagagatgattctaagttgacagagagaaaagaaactgaaccaaagaacgagaatcaaaatggatccaggcttctcaatagtaacactgcataccagaaaaaaaaaaacatggagtgatgcctacaaatttctaaaggaaagagatttttcacctagtgttctatgtctagcactatcagtcaagtatggagataaaagcatttttagacttgcaaggattctcatgcatcctttattacgaaactactaaaggatgtgcttcaacacaatcagggagtaaaagcaagagatagacatggaatccaggaaacatgggcttttcaacacagaagtgaaggaagtcccaaaaagatcattttccatcaagtctatagagcaaatgatccagtttcgagcaagaagactaaagacttcaggaaagaggatctctgggaaacaagaggacagaactgctcaattatttgatgtgtttaaggtataaaaaaatgattgctagatgttttacaggtttgttaaaacacttgcttggaaaaagtagtatgatatttagctgaacagcaaacaatttttatctagtttaataatgttacactgaccattgatttaacaaaaattgtaacacaaatctatttggaggatcacgtaagaaaaggagggagttgaggactggtgaatagaaagataaattcttgtctaaaataaaaaaatcaggaatagatataaaagcgtataatttagaaatatataggtagcttttagaaaaaacataaggtggaaagtagatgcctctctgagaagggatgggaggaaaaaataattgcttttgcttttttagtatatataatcatttggtactattttattattctaactattcacatacattttgataagaataaaaattagtctaaaataaattatatcaatctataagatcaacatatctattagatcataattataactagaaaagttgcttttttggaaaaaaatgcaaatgtttactccttgtggtctgctgatatttaaaagtctttatcataagaaagtccttccgttgggaatgctgagctggcagtctggtggagctgtagtgtcttttgtgtgttccagatgcctcgagaatcagtctttgtgggagggtggaacacaaacagttttgaccagtgtattagtatcagtaaggctagcataaccagggagagatgcaccaaggttcaggtaaagaatcaagtgaggaaaagatatataaaatgcatgtatatatcatggctgcaacagtgcaaaaatggtatgttcgttataagaaggaaataaggacaaatgaaaacagtttgatgtgtcagaagtgggagcggaaataaattttttcctttaatttagaattatgtgaagactgctataatgtttgtgtaaaacagaataaaggggttttctaaggaaatcagtggcattctttgctctgcctccctcctgcagtttaattgcctacacggaacaatatgtggaatatgaccctttgataacaccagctgagccatccaacccttggatcagcgatgacgttgctttgtgggacatagagatgaggtaaaaaatgttttaaggtttgggagtgggatgaatgtagacaaaaatccatgagatcatgagattaccttatattctatcttaatttgacattttttatcgctagaacagaaacccctcaagtagcctcccagctgagttctacttacagtttctacctccttatagctttgatttgtgcatggatcctttgtggctcccctctgaccctttggataccatgataactgagacagtccctcaccattccctagttctgattgctggaagaaaagaatctgttgttccaattttttttcctgttagacagcaacaataatgataatagctggcacgtattctgcattggccacatcctgcagtaagtgtctctcactgaatcccctcgacaggtaaacattactattctcaccactcagcagttatggaaactgaggcacagaggagttaatgaacttgcccaaggtcatactgctagtacagcagagttaggactagaactcaggcagagggctccagaaccatgatttcatcactctgttcttctggagtaactgccagcaacgattccagccagtttctccttccctgtgagggaagccactgtgtttacttaagaggggaggaaccaaagcccagagggacttggaccactttcagaattacagaaggaaacacacagacaaagctagtgtggtgtgccttcacaccccctgcaccttggctggatgaatttttatttcccttttcatgtctctgtcactcacattgtctttcacttttgccccttttctggctgcttttcctgaaatggaaaaaatcttataaaaataataaaagtcgcagatgctcattctaaaaagttcaaattatccagatgtgcataaagaagaaaatgctctcttcctccaacccgatttcaccttccagaaagaacctttgtttatagtctaatgctgtggttcccagagtggatcagagcaccctgagcactgtggggaactcacagagttaccactggatagtccaaattttttatggaaacacagcgatggttgacacatggcagatactgcataaactactagcttaagatggttcagtttcaacattagagcacgttacatcccttatgatgatacgcatctttgcaaatctggcttttcggagcagtcactatgataaaaagcaagaactgcacaaaaattaacatggaataagaaatagggacggtaagttccaacctaattccaaaatttaagaaaatgcgtagtgcccaataggtgcatattgtagttatttaagaatgaaaacaaaattttcaatttatgtgtctttcaaacagctactaagttgttaggatacaaatacatattaagttgattggtcctagccataataaatgacactgttaagtatttcttttggcccaggggcactgtgaaaaacttactgagacgctaagggtaccatgagctcagcaaatttgggaacatctgatttagtgtctattactttggatttttatgcacatataacattctatccttttgtataattgggttcaatatatatacccaaatatgtacatatatatatatagtccaataatttttaaattaacaataggtcgtggcagtctttccatgtaaacacatatagatccaccttactctttttaatagctacatactatcccctggcaccggtgaagtaagatttattttaccagtacctggatcataaatatttagcttatgtcctccttttttgccaccataaacaatgattccgggaacatctttctacacaagttcaattatttcatcagtatatattttccaggagtagaattcgtagaaatggtatgcatattttaattttagttcgtaggtccagattcctcttgagcaaaactgtaacacatctttttcattcccttagcttaaaagtgcccatttccccacattcttaccatcccaagcatcatcaatcattttgtctttgcaaatccaaaaggttaaaataattctcattttactgttttgtttccttgttaatatacttgagaatcttttcacatgtttattagacagattctagcaatatgttttgctttggatatttggatataaaacagtcacatttacttgaatcatatattttatctttttcctgatatatttctgaatctcattctttgttcttgtttctttttctcttccctgacttttactttattaatgttatattaactttgtaaaaaccctagtttctattctagttgtattaacttttaaatgttttaattaaaaacatcatcgatttaaacaaacaagagtgaagtatataaaatagtgaagttacctttgcctcccttaaatcccattcttcccagaggtatgttaacttgatatattttaaaccaacatttttgaacttgtatttctatgaacatttaaagaataactagtatatagtacgtatcttctttctaatatttctgatgagccctaggtagttccttctaagtcaagaacttaactctttctttaactcaggattttttttctcttttttaaaaattattgctgctttttttccattctatcctcacttttcaggaaatccttttttaagaagtctgggcctctgggatggagttgctacatcttttatattttctctattataatttccatcttttagtctttttattctatattcaaaggatacaatttcctgaattgctcttcagaatcactgctttgattttcactggtgtccattctgtgattttatactttagagagtttttcttttcccactgagtgttgggagagtggttgataatcaagcttttcatttccaagacttcttaatacttcttggactgttcttttcttagtagcctgctctgttctattggtgtttatcatgttactccccctggagatgtgatatagatttttttcatagtttatattttttccatattttcatatctcctctctatttctgccgcttagttttattcggggttattcattagagaatcatcatttctgctcattgtttcattcattcctctggtcactgctcagagcagatcattctttttgtatgcccagctatttggaagactgctcatttttataaatgaaggtcttagctttcaatcctgccatacattagaaccacctggaagtttctaaaaaatactaatgcctggtcctcacacacagccaattaattcagaatttctcacaattgaacattgttttttaatctccccacatttttttttaaatctccctttttaaatcagggagatttaaaaagtctaatgtgcagccatggcctaggactctatcagtagctggtgagggtgctctcagtgatggtatgggccaatggttctaagccatgctgtgcatcagaatcacctgggctcctctttaaaaatacacgcatactggggtggctctgggcgtctgcatcttgagcaagcaccccaggcgttctgaggcacacgacagtttaagaagtcctggtttggttcacggagttccccggcaggctttcccctgagcagttcacacaggagcagggctgcacctgaatgtatgaatggatgggcatagatcaattgccaaggttcccctctgggtcccgggtatgtggtccaagaacagattaaaagattgggccctctcttacagtgagacaggtggcaatgggagtcttggggaggtagacccccacccttcctagtgtgacatccctgcagccaagtgttctactctgtgggtcaagccctgatggagtttctgatgtctttctatttcctcgccaaggtactccccaacaagtcgactcttctccctccactaatgggtcttaggggaacccacttggatctgcgaaagccaatgagaggtggggagaaagctaatgtgtctttaaaatctccctggttcccaagatgttttttctctgtgtgtgtgctgtgctggcaggaacacaatcctctggccttactgtccatatgagaagctggccgggaaacatcccccttaacttagcaaacccttttggccatgtggaacctgatccatgttcctgagttgcttccatatgccccttgtctgatgccacccactgcctccacttccaatcctgctgctcagagctcggggtttcccaaggcttctgttggggacactcagctattttcttctctgatgcctccactggaatcgtaggctgctgtcgatcagatatgtcacaagttcagtctatgtgcttcgtgccttcctgaaatttctcaaagctctcatctgctgataggaaatttctttgcctctacatactgtgtttagtttttttggggtttttttgttgtttgtttgttgttttttttttacttaactgagctctgggcttttgcctgttccctcctcgttggccacttgtcccccagatcctcacatggctggcttcacttctcattcaagtctcactcagcactggtgtcccttcctcagaagggctttctgtgaccaccaatctagagtggccacctcatccctccagctgttctatatcacatcctcctcctggttccctttctaaatagaatgatttcagcgcctaggcctatctggcatacagcgggcaccgtgtgggctggagggaggatggatgaacaagtcattctttatttgatcgtttcattggtatttgggaaaggaggagaggcaaatgtgtgaacctaattcacaatgataaaatgaacttcctcttttgttcttgaaagtcagcaaagaagtatgtaatcatgtaggaaaatggggtcgcatggcctattggtttattccaacctattcagcactttttccccaaggaggtgctacctgccccctactactcatgccctggttctactcctgttgttctagcttcgactctgaacttcatgcctaatctaggatagctacagtgttctgtccacttacaggcagaatcaagtgttcagatacaagtgaaaacgaagccctgtttcttctcccaacagactactcctacccacttagttgctggcagtgatgttaggaaaaaacagggtggaatcagtgtcaacatcacactccagccaagggatggtttctgtccacaaaacgaaggctgaagatgaccaataaaataattgagtcactttctctcggtttcagtttaattcaatacatttgtatagtagtcaactatgtgctgtgttctgaacaagaagggctctcaagataacaaatgtagcaaggtaaataaaacatgctatcttaccatctggcaccagaactcctccttgcttggcaaaggacattaagccacttggggcagaaggtaaggccctaagggcagaagggttggcagagactgaaacaacaaagggagagggttgtgctgtcctgctgagaaaacgagacaaatgtattctctgttcctgagaggggagaactaagggcaggggaaagcaggggagggagagaagccagaggccaacaaaaactaagtctctgtgcaaggccagggaaatgcctagcattgaggtgaccagggacttttcaaaagcaggaatgtctagtatgtgcttttttaaatagtaggctgccaggaggtgcgatatgtacccatttttcaagaccctcaaattcctgtaaggcccccaccctcccaaacgcttcatgagaggaggggtttggtgggtgtgggtgaaggtttgtgggaaaggagagacagtgagaatgcaggactcccttaggaattcctgccaatctcaggtgggctttggacttcactgggctgggtgaaggggtccaggcaggctcgttatgatttccagggcccaggatgtcaccgacaatgtctaaattctgcaaggtggagaatatactgagtctgccgtggggaggttacagacagccaaatggaggatggccatagcagctgaatagaatcacggataagatgacataggatatacaataaatagcagaaaattgtgctttaattctttctccttctcagacaagctattcgatctggaagtccaaggataagaaagttatattcagaggggaaaaaaaggcaactgttttaaaggatgggcaaactacacctcaagtttatgcaacatagtgagctgtgatcgcaccactccactcccgcctgggtgacagaacaagacccctaaagaaaaagagtaaattctgagaagtaaagtttaattaaagaaaatagtgattgccagggcttctcattgaggagaagtcagtcaaaagttgccagatgacgtaattctttatgtcatctgaaaaccaccaggagagtgtcccagggatacgtatgtaaagtatttctggtggtgccactaactagatgctggagtctaatgaaacctggtgttgtcagcagaatgtggtttgtgatttgctctctccgcatgacttcagtttagctctccctctctgctgggtatcaggcacatgagcaaagagctacaaggaacctggcttgtccagcttggccgtaggcattcactcccagccaacctgacctgctgagaggcagagatcatccctgagctgcccatgcacagcgagtttgacagaactattaatccggaatattagtcaagctcctttcttatggtggtggatctccaaatatggccccattggtgccttccctctttacatcaagtaggacaccaagaccaaggccagatgaaaagagagggagcacctttttccctctctcaaactatttgagaaccagtaatccagaacccctgtggtggcttccaccttggtcatttgaaatatttgctcttgagacattccttcttggaatccatctgccatgcttggagaagcccaagccgttggagaggccatgtgcagacagtctggtcagtagcctctgctgagctcctggtcagcaactagcatcagctgttaggtgatgagccctcctggatgcacagcccagtcaaatctccaaatgaccccacctccagctgccatccaactacaaccatgtgatccccaagtgagaaccacccagtggagcctagtcaacccataggagagtgaaagagactaataaatggcttttttaagcccctggattttaggatggtttgttacacagcgtaaataactgggccaggcgcggtgacttatgcctgtaatcccagcactttgggaggccgaggcaagcggatcacgaggtcaggagtttgagaccagcctggccaacatggtgaaaccccgtctctactaaaaatacaaaaattagctgggcatggtggcaggcagctgtaatcccaggtactcgggagcctgaggcaggagaatagtttgaacctgggaggcggaggttgcagtgagctgagatcgtgccattgcactccagcctgagcgacagggtgagactccatctcaagaaaagaaaggaaaagaaaagaaaaagaagtaactggaccactcttcattggagtattcaggaccctcaggttgttcttgaggtattaaataaaattatgattgtttctttagtagccttggctctgagatggggacattggattattttctttttaaggaattgccttatttcgtaatttttctaataacttgtcttagtctgttcaggctgctacagcaaaaatgccatatactatgtggcttaaaaacaatataaaaatttttttcacagttctggaggctgggaagttcaaggtcgagatgccacagattgggtgtctggtgagggcctccttcctggttcataaatgtctgggtcctcacatggcagaaaggcaagagagctctggggtgtccttttataaggacactaatcccactccacgtgacctaattacctcccaaaggcttcacctcccaaaaccatcacattaggggtcaggatttcaacatataaatttgaaggggaacacagacattcagtccacaacattctacctcaagatccccagaatttatgtcatcttgcatgcaaaatacattcattccatctcagtagtccccgaagtcttaacttgtcctggcatcaattctgaagtccaaagtcttatctgaatatcatctaaatcagatatgaatgagattaaagataccattcatcctgaggcaaattcttctccagctgtgaacttgtgaaaccaaacaagttatgtgcttccaaactacaatggtgggagaggtataggatagacattttcattcaaaaagagagagagagagagagagaaataggaaagaagaaatgggtaatgggttccaagtaagtccaaaatgcaacagggcagaaaacattaaaccttaaggctctaggaataattctctttggctcaatgctctgtcttttagacccactggggcagcagccccacctccatagctctcctgggctggagtcatacacccatggctttcctgggctgatgctctggtcttccaggcccatttgggtggcagcatcatccccacagcttggtgggatggccctacagcagctttctcctggggtccctattgctttcccaggctggggttcctcacctgcagctcttctgggcagcccagtccaccatggctctgctgggtgcagcccatattgcagctttctgtggggaccccatcccaagtcactgggcaggagcatcctgatctacctaaattgaagagacgagttgatcctttaaaactgttctgctctcctactacatgtcccttgaactctgggcctatggtgcaagtggcagccctgatgaactctgaattgcttttgagtaattcttccattgtcttgaagaatagttcctggattctgttaagatgactcatccatactaatatacttatcaaacagtcacttggccacactattagtggtctcattttttgcatatgaatagacaaagaatttttcagatcttcaggttctggtttctttttgtgcttaacaattctgtctttaagtcacgttttactataagtagtcaggaagagccaacctgcaccttcaacacattgcttagaaatttcctcagctaaatatttaatttcgttgcttgcaagttttacctttcacagaatactagaaccaaataaaattcagccaaattctttgccactttataacaaggatcaacttttctccagtttctggtgatatatgtctcatttatgtctaaaactcatcagaatggcctttaccatctatatttctaccagtattctgttcaggattatttaggtattatctaggaagattgaggctttctttatagctctcctctttactttctgagccctcgccagaatatcctttaaaggcctggttacagcagtttaggttcctctcccctcctctcccctcccctcctctccccttccctctcctttcctttcctttcctttcctttcaagatggagtctcactgtgtcacccaggctggagtgcagtgtcgggatctcagctcactgcaacctccgcctcctgggttcaagcaattctccttcctgagcctcctgagtagctgggaattacaggtgcccaccaccacgcccagctaattttttttttttttttttttttttttttgtatttttagtagagacggagttttgccatgttgtccaggctggtctcaaactcctgaccttgtgatccgcctgcattggcctcacaaagtgctgggattacaggcgtgagccactgcacccagccaatttaggcttttgctgacatatatctcaagacccttccagcttctattcattacactgtaagccacgttcacatttttagttgttcattacagcagcttcccactcacagtacgaacttctgtcttagtctgttaggactgctgttacaaaaatactatagactgtgtggcttataaacaacagaaatttatttctcacagttctggagctaggaagtccaagatcagagtgctggcaaattcaatatctggtaaggatctgctttctagttcatagatggctgtcttcctgctgtgtcttcacatgacagaagggaaagggagctctctctggtctcttatagagtactaatcccactcatgacctaatcacctcccaaatatcctgcctcctaatacgatcacattgtggatcaagatttcaatgtattaatttggagagggacacaaacatttagtccttaacataattcttaagtgttttgaagatagcttgtatattccccaagtcttagtttagatattgattgaggcaaatgtagtagaaggcaaggtaacagagtggaaaaaaagaataggctttggagacaggcagtcctgggatccaggtcctggctgccacctaccagctgtgtgaccttggacaatctgacctcttttgaactctggatgtttaaatacaatgtcagcctccctggcttatattaagatttaaatagggcactgtaaggaaagctccttacaccatgtgtagcactatgaagctcctgcagaaatgagcattgatatagacaattgcttcctttgaatctggctttcttgtcctcagtttggtaactttcctccatctctagctgggggatcagcagaaatgaaagacagacacccttggagagctttgctatgtgttggtttgggctgtccagtgggaggcaggaacttgataagaatgaagaggcacagaggacaaataagagttagaaaaaggcatccagctagcgattagaaaacactgtcaggataaggacacttcatccacatcactatacacatttctaaactgatttcattttagtgctgaacacttgccatgtgaaaagtcctatgctcattacaaagacacatgaaatatggtccctgacctcaaagagctaaaaaaaaatagctggaaagacaatggcataaactctcgaaaatccaaatgctgacataaaactctactagagaatatgtcccaaggaaatatcgctacacaatggatgtaaagagactgtgcttctgtggattgtttgcttgaatttggctgagggacagttattgtaccacttacctggagatggatgttgaaagatattttaatttgcagaattattttataaccataagagaccattcagtggtaacaacatgttcaagtcttttcttaaaccttgaagtggatgatattgggaatactcaagtgatacagaagagatatgtatagggaagatgtatctaggaagcttttaatagaacagactcccagtagtgaaatcgtactaggaaaataaggaagaaatgtggatcatccagttgtagtaatacaattgtgaataatggatagttgagggaagccaagtatacatggttacattgtatcgactaaaaattcatgtctttcccagaacctcagaatctgacttatttggaaatagagttgttgcagatgcagttagttaagatgaggtcgtacttgaatagggtgggcccctaatccaatatgactgatgactttataagaagagaaagcaggctgggcatagtggctcacgcctgtaatcccagcactttgggaggccgaggcaggtggatcacaaggtcaggagatcgagaccatcctggctaacacggtgaaaccctgtctctactaaaaaaaaaaaaaaaaaaaaaaaaaaaaaaaaaaattagctggccatggtggcgggtgcctgtagtcccagctactcaggaggctgaggcaggagaatggcgtgaacccaggaggcggagcctgcagtgagccgagatcaccccactgcactccagcctggacaacagagtgagactccatctcaaacaaaaagagaagagaaagcagagacacagacacttacagagcaaacaccatgtggagacacagaaacacaggaagagagagtgcagtgatgcatctgcaagctgaagaatgccaacatcagaagttaaggaaaagtcatggacctggttctcccctaaagctgtccaatagagcatggccctgtcaacaccttgattttggacttctaggctccagaactgtgagagaataaatttctgctgttttaagccacccagtttgttagtcctttgttatggcaatcctaagaagctaatacaccagggtatcctgtctctctagacccatttatttctgctgaactatgaccttgccattttccagatacccccaccttctgtcctaagcatccctctgattctacatctacagtgacaccccaagatttctggcccactccaaaaattgcccttctcccactcttgccaccaccaaggaatctggtggaatgaatgtggactcaccacttgggtaccagaaaggggtgacactggtggtgggtgtgcatccatgaggcagtcactacaaagtctgagtgaatttctacagctgctaatatgggcacagccctcattcgagtacagctgccactagtaccatccctggagagccctgaatcctcctctggtaaagagtaaatggttgggtccatccttggtcatagcatgaccttggcagaaagagacaatgtcctgcagtctctggggcttaaatttactgccagcctcaaccccaggggaattcttccacaaacagtatttttggttcccttgaaagttattgagtttgattaggtctgtggcttgcgtttgagagaatccaggatttgtcttcatgtcttgttgtgaaaggcctagcctggtactttggaagaggtgtttcatggagtctcccattgtttgacctgatggggttagtctaccaccatgaccctattggactatgctggaaatgcagagttgcaagccagaggctccctgacctccaggctcatgatctattggtcatcatcattgtaattagaagatactgctgttgctgattatgtgtgttggtgaagaagtagttgggtttggatgcggtatgtctagagctgcataccaatatagtagccactagccacatgtagctatttaaatttaaatttgaatcatttaaaattaaatgaattttaaaattcagttcatcagtcacactagccagttttcaacagcccaatagccacatggggctagtggctgccatattggagagcacggttatgggatattttcatcattgcaggaaattacactggacagcgccagtctacagttatttgctttcccaagctttccacgcacacaagctcctttttttttttttttttttttttttttttttactaagtggaattttccaagtattgagaatatgtcagctccataataagaggaaacatgatttaatctcttactgtctgttggaaataataaaatatatgcatctattttttaaaagaggaaaaatgagtattgctagaccaatgtttcccaatttgtaatgtggacataaatcacctagggttcttgttgaactgtaggttctgatttagcaggtgcaggtggggcctatggttcttcttctggttcacagaccacaccttgaatagggaagagttgtagcatgtgacttgtgagttaggaccttatcactgtttaaagggccaaggacataaatacagcaagtgaactttaaatggaaagacagaagctgaaggaaatactcttatcgcccaacaccagaagaattagaccaatgcccattctttagtctgaatgtgagacagcatagcaaagatgagctatgcagcatggcagaattaagaactggggccgggtgcagtggctcacacctgtaatcccagcactttgggaggctgaggcgggtggatcacgaggtcaggagattgagaccatcctggctaacatggtgaaaccctgtctctactaaaaatacaaaaaaattagccagacgtggtggtacgcacctgtagtccccgctattcgggaggctgaggcaggagcattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcaccttccctatctggaaaatgggaatcatactagtacatttttcacagagcagttgtgaggactcagtgggttaacagatgtaaaatgcttgagacggtgtctagcacacggtaagcactgtgcatggttgttaaatcaataagtgcatgtaacattctgcttctaacaagagaatatgctttactctggatgtgtcaatacatttctgaccagttgtacatcacttggcttgaaacaggaccataatttctcccctgaggattgaggaaggggtgggaggtggaggatagtgtgttttgatgaaagattgggtccatgaagcatcctgggttatagtactagtgaaaaaattagagtcaaaagttgagtccataattgataggaatggtccagggagtttaatcaatggcatggtagacagcagccatttgaagggcatgccggcaaccatcacttaacatgcctccttaaagaaactgttcatcattggttactgttggtgtaccaaagtctgcatttggaatttgtgcagcttttgtagaatctgccccttaaatatgagatgtttccctttggtgagtgactgcaaaacagacttgagtcactgaagagaatatgacacgagcttttctctggtattgatcttctttaaaccttcttccttcaccccaaagcaaagagcccagccaacagcgagtaaaaagatggggcttctctttcgatgagatattgaaggaccaggtggggcgggaccagtttctacgattcctggagtccgaattcagttcagaaaacctcaggtaaatctctcaaagtttgagctgtgtgcggaatgtgtgtgaagaaatttgcataatcggtctctccatctctctctctctcaatgaaacgttatcagggttcaaattcaaatgccagctaatctggctgaggttgaaatggagaagaacaaattaaaatatgtaactctgtcaccaccataatagcacctactaacaccagcatgtttcagttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagtctggggtcctgaatatctgagaagctaaacggaagagggagaagtcagtgggctcatttcagaatttcaaagagcaaagtaaatatcactcagtaactggtgatgtaactgtagcagctacgtaacagtagcagctaataaaaacatgcttttttcttttagaatgacttctgtcgactccaaatagtggttactctgatcatctgacgccagtgagaacacctgattgttcctattggtctataactaatacttgatgagggaaatgtattaataattactatttaataggagaaaaaaataagatattcaaaacctcaggtccaatatgagaggaagaaaagggggtgaattgaaaggaaaagtctccttggttatgaaaaatttgggaacttgtttatttagacttttatggtattagatgaagaatcagaaatctgcagaaaatgtgacttatctgagacttatctagtgatcttagcaaactggtgactttttaatgggtaagatggaatctctctctttcttttttctttgtaccagattttggtttatatagtagagtaacacccatcttccagtgctgttttctttaaagatgtcttaataatgtttcaatattgtattactttaaaaactcagagcatgtgctgcgggcaaaggactgcccctccaaagttaatgtgcaacatccatgcacttatttgaagttgagaccatcggtcccatacgtcaatcaagtgatatttatgctacacctgtgctgtatcaagccctgtgagagtctgctgagagatgcaagtcaagatgtgtgatctttgcctgtaacgaccttgtaggtccttgaggaaaaaacacaagaaatgattaaatcattgaatgtctataaatgagtgtaaactctaagaaccatttcgaaagcatttaaaggagaagaatcaaagctgaagtagttaaatcataagctggactttgaagaatacacaggataatagtagacgaagaagcaggagagagaatattccaagctggaggaccaaatgaggaaagaggtggccgtgggactctcccactccataaggtcctgagaggacacgtagatgccgactagctgtatggagcgtgctgttctaggcatccacgtgtctgttataaaccagacaaggttgagtatcttattttgggttattatacaagagcctttccttgtgctgaagcatgattccaaacacatctcagagcttcatttcaatgcctaatgaagcatttgtaacagaaggcttgacttctaatactcttcactagggtggtgctcagactagcctccctgtataggaaggaaggctctctgtggccagcttgatggacccaggtggcctctctgtgtagccagctcagtcccagtttccaccccctccatggtccctatgagccacccctgggagtccttctcatcttcccttcttacctgttccccttgggtctccaagatggagcggtatagaggccccctttacctaactacctctaagcccgtaagtagcctcaggaccctctgctgcctgcactcttgcagagagcttgaagaatgacccagagtttggtcattgtgagggtcccaggagcatccactggctcagctgccaccttgcctggtcagagcattcattctagaaagtcccgagtgtagccagaaccacatatcagttcagactagtttcacaaattatgcatcacacttaaagcccagagtgcaccaaggagtgtgtccctggcaggtgttcagtgcttcttcctgccatcacctcctgcgcctctgccagctcctttccccatgccaggagggctacatttaatcttgggtgaaagcatgcatgtgagcatgtgttcatgtgccagagcctaagccacacccccagaatgcagaaatccagacttcagagggtcacccctgctccatgacaggaaaggaaatagaatagcagggaggaaaaggatagccaagagcctctaaaatcctctctggatgcccaaattccatttttatgatattcagcataactggatacatggtgggtgagagagaagctcagtcgtaaatcacataactgtaggactcttcagtcacccatcacagggcagccttttccccgttccattgcgttcatcccttcagctgcagatatcatcttagcaccaaccgtggcacagggctggcggatttagagctgactgagtaaatatcagggtggccaggcatggctatacagatgcacctccactgtggctcatgccatggaggcccctgggagttgtgcaatatggcacaacttgaggatcctgccaacctgtcatgttggccgtgctggagtcgtcccttctccgcaggattggtgaggggcccaggccactggcattggagcatggcaggaaaaagcctgaccagaactcacctgggtaaattacaaagtgcttctccacttcctctgtcctcctgtgctccctctcatctctccagtgaaagggctgcttagatcataacattcttgcacaacccacggggtgccagttaagtagccaagtggctgaatttctatcagagcttcagaatgcggaatggaggagccccaaagtgtcaccctggatcctttaaggaacaatttctatgatgatgtaatagaagttgacatcccctttgatcagtgtcttctgggtgggtctgtgagatgagggtgggggcatcatctctgtggactgggtggggtatgaccagcagcgcattttgctgaagctgtgagctctctgtggcagggtctacctctttttctccttttctgacccacctgagctgggtgcaggctccctttgcaccgagtggacccacagacagctgtttgttgagtgccttgggaatgctcatggcttctgtccacaaggcaggggcctcacagctctgatgcagggagctccgctcagtttcttggcctcatccttcttcctgctttgtgcattttcccagaataatgacagtcactccttcccatctttgctccctctcccacatctcccctacacaaatctttgtcctccctggcttgacaccctctgctgcacagcagagaatgagttaaaaatcaaaacccacagcaaagagtgtcccccgtacattttttgtgagctgtaacatctcctgagagaaggtagttgttcttctaacctgcagattgatgatccgagttccacacagtgtcggctgaagggagaagcaattaaaagagaacacagtggggcaccaggttcatctcgagagctcttgtctctggcagttgccctgagtccaaggaagacctcagaaggttcactaggcccagcaggatccaccacttaccaaacccatgattaataggaacagaggtgactcccacgacaccacaaccatctgcagtgtttcagtcactgcccagtgaacagaactcagcttcagtggtgctgggggtggttactaacgtaggcaccccggaattttagccccaccgggaactaaaccaagtttaagctctgctgcctacgtctctggttgaccagcagagggcatagaaacactttcttctctcctggagtttgctttttctctgggagcgaaccaaaagctgtattttctaacccatgaaaattctagtttatgaaaagatatgtaaactggtgactgagggcctgcccagacctcctggtaggatggagaatgatcaagggccaaatggtttgtcttacccagccagccttgagaaaatcctcttccttgaaagcctctagggagaaaggaggctcccactggggcagcccctggatggtcctccagccctgttctccactgcttcgccccagtggtatctgagcccaggctgcctcgctccaaaagctagtttccccgccagcatttctaagtcatgaacacggatcaaatgcccgcacaggggctgcctccctactgcagctatgacaattggcagagaccaggggcaggtcaggacaggtggtctcccagatattagtccttgtggcctgccagtcacaacggcccttctgctgcaagccatggaggctcagtgcaggatggatggatttgatgcagctgctggcatttcactccctgccgctgcccttggggaggagcggtacctgcaggttttttataagagcagaagcttccaaagcttcaaggggcttcccatgggcagcagatgtgcagagaggagctgctgtggctctctgcagcggggaatgtggcctgggctctgagttcccagctcaggcctgtggggctcgaagatggccaacactaaccaaagcctgttctgaatttcaaattgacacaaaggttcctcaaaaccagtgatggtaaacacatacgggatgtcaggatgctgctgtgacagcagttttgctgttgcctgagagagacaaggcaggtcaactccaaggcagacagaaggccagggagagtccccagtgtgtgcagggagagaaaactgctgtctagggaatgttaccccataccttccccctctcccttcttgccctttccccctccttccctccctttctctcccctccccttcctcttcctccagcatgcctgttgttttcacttgtacttaaaaaaattcttggttttatgtgacaaagaaaacctttttatttttacataaaagtttattaaatttgattccgcggcctggtgcaatggctcacgcctgtcatcccagcactttgggaggccaaggcgggcggatcacttgaggccaggagttcaagaccagcctggccaacatggtgaaaccccatctctgctaaaaatgcaaaaattagctgagcatggtgacatgcccctgtaattccagctactcaggaggctgaggcaggagaatagcttgaacctgagaggcggaggttgcagtgagccgagatgtagccactgcactccagtttgggtgacagatcatgaccctgtctcaaaaaaattgattatgaaatttgtatttccatcagctccggtcatctctatatccagctgagtgatgtacattttcatgtggcacccaaatcatcctgcaaaaaggaccctgagccctcaggaaccgcagggagcctgcagagctcccagggtcctcagggccttcccacaggggctcagcagctcctcctcagtgctgacagaggtgacagaaagtgacctcccatgtggcattgattgagggggcaggaaatcacccaggtgtcatccatttgtgtgagaagttgcaggggcccagggggcgtgggaagacgctgacccagaaggttgcttccagccagggattcagcccagacggcctccctctgtgaacctggttctcctgtctgcctagcatggggctgaggaagcctcactgacttcgtctctggacatttgaccccttctgggccttggaaaagccaacactggcttcttcctatagagccaggttccccgcatctttcacctactggtcagacatggccttccaggcagagaaagccttgtaggtactctcaccagcagatggccattttcacttggcaagcctcccggccacttccttcttttcacagcagacctgagagagtggacagagagccctacagaacctagggcaggcctgggagatggaggagacccatgccccagctcaagagtcaagggcccacctgaacaatgaggtaggggaacagctcctttcaagcccttccttccccaccctctctggactctggataaagaaacacgactgctttcctctcacccagaagccagaaggacctgagcacccaggacttgtggctgtcagagagctgtggaagggcaggggacaccagatggcagcagcaagagctgggcggcagcatctgcccaggccacctgcggagagaaggctggaatccgagggatcacactgggccagcattgagcctgtggccaccacactgacccctcctcagctccccctcacaggacctgaaagcatttctgagttaagtctgcataggaagttttccagagccatgccacatatccctccatccactcagtgcccattttacagatgaagagagaggcacccagaaaggtacaccaaggcaagatatggcgtagacaggatgagggcagagccagcttcctgatctgatggaagtcatgaagccttctctgccttacgcttggctctgcagggtcgctgagaggttcctttaaggagatcatcagaatcctaaatggcaaaaaatggcaaatcaggggaagagttggagcccagcatttggggacacacacacacacacacagtcgtcttgccttgcagaaattgggttgcattactccagtctgccactgagtggcacctttgggccatgcacttggctccaaagacatttctctgaacagcaacagaaaaacatgtttaaccctaaaaaaaaaaaaaaaagaaacaagtacatcttactttggatgaaatttgatgacagattgaatgcactgtctgcactttccaccacgtcatgtttcagcttcgcttgtccctccctttctgttgactagactacctgtgattcccgctgctctcggaaccagcacaggacctactctcttactcactgatgggggagctggcctgtccatgcacagggcaaaggatatgacacccagacctggatcctgctgcaaggctgccttgggaaccatccttaagacccggtagctgttgtccaagctttggctctggctgctgctgctctcagcagaaaagagctcactgctcccatgcggatgctgagggattaaacagaggcaaatacggaagtgagcagatttttctctcttgctctcagcagaaggagaaccattctgcagagaagttttcaacatatgcctcttcagcattgctccagatgcgtccgtcttcactctgaaacccatatattgagcacctactatttgccaagcaccgtgctgagcactgatgtgaattggctcagtttctccatctataataggaatggctggttcattcttacacagatagtctttatgattccaggacactgcctgcttctgggatctctcctccattttgatgccatcacttgatcccaactagatttgacaaagggtctcacactgtctgcatggtggcatgtatgtagcactggggttctcaaccaggaatgagttcatctcccaggggacattgggcaatgtttggaaacatttttagttgtcataacttgggaaggggggttgctattggcatctagtgggtagaggccaaggttgctgctaaacatcctacatttcacagaatagcctcaacaacaaagaattatccagcctgaagtggcaatagtgctgaggttgagaaaccttcatgtagaaggagagaaatcccgttctgataacgagaagcacattgatcttttaatatgcaattcttttctgttctgcaccataggaacacctttgatgttttcacaatctccatggtctttgcagctcatgtagtggcatcagggcaggctgagagatgcagcagaatgggtttcatgggacatcagctctggggccatctcaggcaacatcccgatgctgagccccctggaactgactgtgtttctgctcccacttcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggtttgcttatctactcaagtggttgtcataaggtgttcatttgtccccttcattgcctgacctattaacacaagttcaaggcattgtgggtagttaaaatttcagatttggttatttttaagttcatcagtggaaaccatttcagataggcgcacagcaaaatcccaggatcgttttcctagatgggttatgtattacatagaaaccaaaatgtgcagttatatgctttatttgttccaggaaagcctcaaagtgttttacaaaatctgaaggcttgtaataagtcagtgatagaatctggaaaccagaacacagcattggggaagtgggtgtagtgagttagcagggccatgagtcaaacccacatctgtctacctctgaagcccacactgataaccacctctctacactgcttccgcagtgatctccagctctgcagtgaatattttttaagcacatctatattccaggctctgcgctatgtgataagataccacaaagaacaggcaaaacccctgttctcaccgaggttgagtgggagacagacaagtaaatgggcaacttcaacagtgtgaaaagtgccccaaatgggtgaaccctaggttaaagcaagcctgcaggagggactcccaaccctgtaggacacaattaagatgctcacagatgctagtgatgctggctaaagaaacaggaaccaccctaaccagcagactaaattttgacggctgggaggtgccatttctaaaaataagcattgggttggtttcttacttcctggcccctaatttctatttcctgtcaccatcccacacccagtgacagggcttaagattttgcttatctccttgaccccacttacttctctcacctctggggcccccagtagagaatttgggtggtttgccccttgcagacattattatctgatttaggaaactcagtgtagctgcaccaatgcaaataatggcatgagaacagtgtcccttatcatccagaattaccttgtcatttgctcagaacttcaagatggaaacacctaccaacctcaacaccataactatctacttctctccccctggtcacgagctccatcaaatgcctgtgccaatcacgaaatcatgactccttcatataccccttgcagcttcaaagcagaatgtttgagtcatgagagctctttgctgagatatttttgcttatgtgtatgtacgtatgctttcaagcaccatattgacatggccagagaggagagtgacaggggagttccgtgggggttccctgcatgaacaagctgaagctcaaactccaatatttatgaaacacaagaagagggatactggtcaaaaccttgatgcatctagcacagtattaacactccaagcatgacatcaggagggatttattttaattttttattatgaaaacttttaacacttggaaaagtggaaacagcaaaacagcaaacatttatagaccctcatccagcctcaaaaatcatcagtacacgtctgatcttgctttatctctagccccatctactttttcacctgccaccaggttactttacaacaaatccaagatgttgcatcatttcatctgtaaacttagatatgtatctctaaaaaaaagatccttttgttttaatattgccacaatatcctttatctccctcccttcctcacatccccttgcaatttatttgatgaaggatttagatcctttgtcctgtaaagagttccaagctctggatttttctgattgcagccctgtggtgctatttagcatgttcttctatcatctctctttcctataaattcgttttataagatatttaatcagatttaggtttgatttttatggacaaaaccacttcatggattgtgtggtgctctcctatcagaaggcacatgtctagccacctctctttttgacctttttgcagatattgatgtctatcgcttatatccattagttaattagaggttacaaaacaacaacgtactaattttattctttcttcacttattagctggaatactttcataaagagaaacttccctccaccactatggtattaactagcagtacaattcacataagaaaagcaggataaatatttgattctctcccttcatttgccagttttcaaaatgagtggtttgctattatcttcctatggtaaacattagggtctattttggttttactatctttgtaaactcatgagtttaaacatatatgctatgttttaatccattttgctgattacttttattgatgcttggattgggccatctctggccagttggctctttctgacacagccctaagagtgatctttgacatcatccaaatagcagggaagctaagatattccagtctttgcccttacccagaataagctgtttctccaaggatccctgattcctcttagtgagaaatggtatttagagactaaaatctaggcacttagagtgtttcattgttcctggattgtttatcatttccagcccttttcagtcgacagagctaggaaatgtgttgctgtttataataaaaatacatcctgagttcatactgatacttttaattcaaattctgacctacaggggattttatttaaccgcttgtttcttacacctgtgcctcttttctctatgctgacaatcctgactttcaagggcactggatgatagcataattactcatttgctttatactacacagagcagtctctaaaccacaatgctaaaaatacagcaacagtatgattatcgcctggttctttaattgttgcatagtattccgttgtgtggaggcaccatagtttagtcaaccagtcctctcttcttggacatttatgttgtctctacttcaagaaagttttgatggaagaagtggggaagtcagcctaacgaaggttacatattgacaagtatctcaatatccaacctacagtgctctaccattttccaagtacttctaaatacattctatctaatttctacagcaatctagactagacatgaggatgtcttaagcatccccatcttcttcattatctgctaggattagtctcccatgaattcaaataaaacactcttcctaagccaatccctattttcagaccaatttcctattgcttctgaagtgtatttccaccataaatatacaaagtgttcctttctagcagagtgaccttggacaagttgcttaaattccctgagtcttcctttcctcatctgtagaacagggatacaatggagcctacacataggggtggaatggggaccaggtgaaaggaagcatgtcaaccactaacgatgtctggcccacaataagacagagtaaatactaccatcttatttttctaatgtcactaatattctctttttaagccgtagtgtttaatgtatttggtaaaaatttttaaataatttcacataaccttagcacccagagataacccctattttggtgtattttcttccttgatttatgtgtgtagctacgtgtaaggtctgctcaggctgctaccacaaaatagcacacactgggtggcttaaactacagaaatttatcacagttctcgagactgacaaatccaaaattaaggtgtcagcagatttggttgctggtgagggctcacttcctggcttgcaggtggccgccttcttgctgtgtccttataactctggtctctcttcctcttcttataagaacactaatcccgtcataagggcctctctcatgacctcatttgaacctaattacctctcaaaagacccacctccaagtaccaccacactgaggatcagggcttcaacaatatgaaatttagggagacacaacattcattccacaacagggcgattttgcaaatagcgtgatcctgtaacctgccttttacctaaaacaggggtcagttaaaaaactatacttttcctaaaaagagccagatagtagacattgcaggctttgtgagtcatgtggtctatgtcacaactattcgattctgcatacaaaagcagctacaatgcaacaacatagcaatgtaaacaacataaatgaggacctatggctgtgtttatttatgaacagtgaaatccaatttcatataatttttcacaaaatacaattcttcttttagtttttttcagccacttaaaaacataaaaactgttcttcgctcatgggatgtaaagatctagatcacaggtctgtatctgtagatttgaatcacagactgtagtttgtgaccctgtgctaaataaaatctagcacatggtcatgaaaattattgaaatgcttcaagaaatccagaaagctacaggatagaggattgggcataaaggatcttcagtttttgggggagagtaagttagaggagacttggttttgacgcagccatggcaacacagcaatctgaattgtgaatgtttctacatgaggattgagtgttgcggagcagaggtcagcaggtgccaagagactcacactgccttaccttcctggacagcactggctgcctgccccagcaaagtaggtgcagttcagaagttcccaggtataaaaaggaggttaaaatcctcagcagcccatgaccagccaggacttgcactcagatgtcctcgcttgctggccaagattctgctcagaccacactgtccctggattgttagtgctgagggcttggtggtcgcactgagacctggagaagttctagtccctagagaaaggccaagagtctgggagttccttctagaattatccatttaagttctttaaactttctcttctcggtttgcctctctgttaaatggggatgttaacacctcagcccatggggctcaggggctctgggtggcttcctcagctggtcatgatggttctcataaaccccctgcagtggtcatatgctttaatattagtgctcagtagcctgagagaaagtacagccagatttatggattcactggaagcagggactgggggtggggtgcagcctctctccaatgggttttgtttcttatttgaccacacgcattgttagagccaagttaattgcctgtatttgcttcctgtggaaatatttcacaagacaccctgttatcgtgggcccagcatttgtacttgtgttttgctgatccgtttagcttttttgaaaattttgggccaagaccaaatcttccataaaggtctgtgggctgtgaccatagtcctcagctgtttgctgtgttgttccaatttcatagatttagccttgtgaggggagaaaaatatataggccatgattatttttttttaaggactcagttctttatgctatggatttaattctctgttcccaaccatgtggccttaaaggacctgcattgtcacctgcttgctatgtggtctgaggcaagggccttgaccttttgtgccttagtttcctcatctgggtgatgggggtgatgtcttctttacagcccgctaaggatttcagagaaatcagatgagctaatagccctgaaaaatctttgaaaaagtaaaaagtgctatatatttgtaagtgtgaactcacaaaaattaatgactttagtactctctggggtttcgtaattctaagctggatccaaaagaaattctctcaaaatatctgcccttagatgggaaaaaatgccagaaaaggatgtaagaactgaattttcaggtcctggaatgcatcctaaggaatttgagcttctcatcctgaagacagtagcaaagcattgcaggcttttacctggaagatggtgaatcccatggtgatgggcatagtaggctggagccaagagagagttctgaaccctggggcatgtcatataaagctctgctggcagttgttggtggagagaattaaaccacaggaagtattgagaaccttcagcttccttgtagggcatttgtctctttccaaagccttcacaggctctagatgagatagaaatcaaatgccagcacagtggctgcctggcttccattttaaatctcagagtaccaaggatgttccaaggactatctccctggatccattcaatcatttgtccatctgcccatacacccatgtcatgaacatccattctcccattcaagttgggaaaccttgacccgtgcggcataatattctgtgcagagggaaataacatgagaaataggaggcccagatggctttttttttgccatcaggcagagcttatctaaaagcacatcattttcaaacaaaacaaaccagacctaagaaagcacttcattgagataggattggattggaaatctgtcctttaagtggactgatagtggaataggacaagccagtccagccccattggctttgatccttgcagtttcccacctcaccttcctactcgtcccagccccactgctttcctgacctgtggtacctgctaagatgccccaccctgccctgtacctggagtgtctgggccttccagacctctggatttgaaagttatttcatgggagcagaaatttggtcttctttaccttttataagttcctgcatcacaaaggtaatgctgaatgctgaatgtcagctaaatgctgataattcattccagaattataacattttcagctgtgcctatcaaagaagcgggggacaatttgtcccttagctttcaactttggagagacaaccttggggagtacacctagtagatagtcaagaaaagcaggttaaattaaattcctacaatgtgccgattcagcaaaacttggaatacccactaagtgtcagatgttctaggcgctgtgaatatacaaatgcgtagggaggttcctttccttaagcggccctgggtctgacttaccacagctctgcttggccttgatgaactcacaaaaggatcaaagagcatgctcaaggccagaatgaggtctgcgtgataaaagagctgagaaagataccgtcaagtccacatccgccatgagcagacaagaagcctctagcaaaacgtttatattattacctaagtgtagatgtttaaatgcaacttgattaaggaatgcaaggtttctaccatttgctttgtttaaaagccaaagcccagtagagtatgattttaggtttgcccagattattcagaagtagaagtcttcccagctgttcatctttgctccagtggtggaggtggcggcattgcgtgccagtatcacaagaccacaccaagtttcctggtattaatcctctattggaaggcatttcctggtagactctcatgccagacatattttaataaggaattctgtgacactgcttgctctgggggttgctcattttatcctgtaggtggttttatttttgggagatgaacagcagagggagggatgcattttgcagagaataaatcagtcatttgtgatccagttctgtttattaccacacagactagtagttcctgacagctactgagagaagacgtcaaagagttcaattccaaaatttcttggttgctacatctaagcatagattccttataccaaaccccatgacctccttgaggaggaaatgaaaatacttttcttcttttttttttttttgagaaggaatcttgctctgtcacccaggctggtgtgtggtggcacaatctcggctcactgcaagctctgcctcctgggttcacgccattctcttgcctcagcctcctgagtagctgggactacaggtacctgccaccacgcccagctaattttttgtttttttttagtagagtcggggtttcaccatattagccaggatggtctcgatctcctgacctcatgatctgcccgccttggcctcccagagtgctgggattacaggcatgagccactgcgcctggccaggaaaacacttttctaagttaacatccctggtatttgggtaggtgaaagacaatatgcaaagctgtctttgaagctacacttttctaagagtagggattgaacagcatgaaaatactgtgccctttggccagttaaattaaatctgtttttatagatgctttgcagagtaaaggcaaaggatcatttactctcacatcctcttatgacctggaatgatgccttatgtggaaacacagggctcccatgtcctacttaggaggctaaggaaatccaaagggggcacttcccattttagatccacatgatcccaggttgttcatccaaagatacatccagaaggagcaacagcttcctatctttcacttatgtggatgtccatattgttgcggtatcttttctgttgcctcttctatgtttgttaagcagatactgatttgtgatccacttcaagtcctcaccactgtgctgtcctgcaagaaccgtgctgaagaaaagctcattttccctaggcttcagctaaccatgcctaaggtctgaggacctttggtcaaacatattcaagtctcttgaaaggtgagactcaaggatacagacttatgacttcctaagggcccatcagccctcaacgctttaccaggttgggaccttgtttccaaagatgttcatagctcccttcaagtatagatggcaagttgtgcatggactgcctgttaagtgagaaaccagagcctgggccatccctggtgtcttggccattaccattgctaacagcagtgatagtgaatagtacccaaaagggaattgtaagcagtggccacaccttctactaggatgactcagatttaggactcaagaggaggctcctaactttcctgcaaccacacatggagggattttgtctcagccaaccagtactgactccccttgggacccaagtaaaggacaatgaaaagcagcacttcaatgtgagaagagcgtgagctttggggtcacagagctctgggttcaaatcctggttccatacttaccttgggtaagccacttgacctgttagagtttcagtatcctcatttgtaaaatgggggtgtttaaacctaagcactacttcagagcaaacatcaccaacaactgaaatagtacagctagactctgctcccaaatcctctttgcttctttctccagaatctctctcatcccacaaatcatcccttgcaaggacagtcacagcatgaaattattattgccacttgacatgtataatcatttttgtagtgcttccacttctacttccacatttaattgtgtgattgacaggactagaaaggtgagcttttggctcccagtccagttccttgtccatcaccccacacagcaacaccacattctgtccacacagcctcattttccttcaagagactacatgggacccaaaagctcccaaagtctggatgtgattctaggcagcttaggtatggagggcagagatgaggcacacacacctacaaaaagaaaaataggatacttgaaaatcacaagaagagctcttggccgctgtgcaatgctccagctgggtggttctccactccaggaggacgttctgaagctgggaaatgagatctgtgctgtcttaggagcccacagcacaggggaggacataagggtcttcttgaggagttcagctgcatgcttgtggcccagggccccagtcatttgtctgattagcttccccacctcttgagagagtcactgtgttttgtctaaaaagaaaggagatttccaaatgaggactctctgagcaaaatattgattttcagcaggtgtggttttgagacagtttgtactgcatgctctctccagctctcactgtgcctcggactctattgattctagttggttttgatcctgccttagcattccaggaaagcagagctctcctagcccaagaagagaaaatgaaggtggagtggctcatcggggtaacatccctccactacagccatcaaccactccagggatatgatgcctcccactgctgaggactctggctaagacactggtgtgatttagagccctagagcattggtttatcatcatatagagaaccaccctcatcttctttggaggaggtgcctctccactgcatcccaaggtgggagtgacctctggtagttctgcttgttcatagtcagcttagtcatctctgttgtagaaagagaaagagagagagggcaagaaagggaaagacggagggagagaggaaggaagtgggaaaggagggaagaagataaggcaagacaaaataagacaaagcaagaaagagagagagcacgcgggccagcacgctttttctccatccccttaggaatttactctcagcaggggcttggcttggctggttttgccagtgactcccttgcactttgcagattctgaatatacatttcccttaagactggttgtctgcagaataggggaaacaaaccagcacccccataaatcagcagaggtcactgccaagagctttgtacacttgctgtccctggcagtgataaactcattgcatttgggaaatggccaaagaccctgagtccaatcttaattctcattcccagaaaaatctcagttttctgttcacccacccccgtttactgtctttgtgtttcctagacaaagctggcaaggaggaaagaacacagttcaataactggatcatcaaaggctgcatttcgttgcttgggggaggagttgcagggcaggaaagagtcacagatccctaggctgtggaaaagagaggcccaggccagagggaggctgaagccatggggtctgcatggggtgtgagagatccgcagaggttctcagattctggttttctcagacccgcaccttggatctgctattactgctgtggtcggttgttcccttgaagggtggttcaggctgttataatggtggtcaagggctagcagtgggattggtgtggtgagaccacctcatgggactcatgctccagtaggttgtgttcttattctcttatctttctccccacaccatcctcaccttggtatctggctttggagttggccatatgacatggagaagatgagagtggtgtccaaactgctcctctgacccacatgggcctcctgagagtggacaacctctctctgctgccctttcctccttgccccttgattgtctttctcctctgattgatcagactgtgaagctgcaagaccagacccccccctccctgcaatcccacagaattaggagacatatttctgtctctctacacagatctttccactttgatgaggatctttctggttgagagaccaccattccccacttgtagcaggataggtcatccccaggtatacacattcataccctgtgcctgtacttcatctctgcagcccttagctgaattggctaaatgcgtctctgtgcaaagtctatcttgcctagttggatctaagctttatgacattagaggccgatttgtcttattcaggctgttatctcagcgtctgacacagtgccctggcacctagtaaatgctcaataactatttgctgaatattattttgattcagtgtttagacatctgctttatcctgctctattttgattgacaagttctttctcttcatgaaccaggcttttccctcctacaatgagtctataagaattagctagatcagaggggaatttggtgctgagccagaagagctgtctaggggaggtttcctcacttcttatggggcagcagaggggtattgtgagatattgagaagtcagaacaagaagcagggaactgttgctttggagaagggtctggagaggttccaggcactatgataggcttttccagatgactcaggagccacctggctctgtcagccagaaagaagtgatgcctgacacaaggagacagtgtgtcatttttactgtggactaacatttgtacctaagctttaaatgttaaaataatttggctgggtgtggtggctcatggctgtaatcccagcactttgggaggccgaggcgggtgaatcacttgaggccaggggtttgagaccagcctggccaacatggtgaaacaccgtctctactaaaaaatatataaaaattagccaggcgtggtggtgcatgcttgtaatcccagctacttgggaggctgaggcaggaggattgcttgaacccgtgaggtggaggttgcagtgagccaagatcacaccactgcactccagcctgggcaacagagcgaagactccatctcaaaaagaaaatgttagaacaatttaaagagacaacaaatgaaaccaaagaccaatgatacccctcagcctgggctctgagaccattagggatggctgagccaagattttcatgctcctctgagctgagtgtaatcctcattctccttctgtgcagagagcaggaacttgatgcagtcataaacccaagcaagtatggagccagtaaacttgctgaacattaaattccaaccggcatttcagtgaacatgtatattcgactaatatctgagcctgtgctagacagtatgcatctgtaaaaataaacacatactgttcctcaaggcacttaaacaagagtgagctggatttttgtctgaaattttcagaaaaacacttagtgaagtgtgttcacactaagtttgttaaatcagaatacgtctggactatccaagtagtctcagaaccaggccactattggaggctgggcgcggtggctcacgcctgtaatcccagcactttgggaggctgaaacaggtggatcacttgaggccaggagttcgagaccagcctggccaacatggggaaaccccgtatccactaaaaataaaaaaatcagctgggtgtggtggtgcatgcctgtagtcccagctactcatgaggctgaggcacgagaatcacttggaacccgggaggcagaagttgcagtgaactgaggtcacaccactgcactgcagcctgagtgacagcaagactttatctcaaaaaaaaaaaaaaaaaaaaaagaaccaagtcagtatttaatttcatttgagtccttccagtgggtttattcccattagtggggtaactcccctgcttttgtaaatatgagggtatctcaggaagaataagtcccaaaacaagattctttgggttccaaccaaagatgaaaccaagagggcctcacatgtgaccaagacattttctgctttctactttcactttctttttgtttattttttaaattgagatgtaaaagttgtatgtatttatggtatatagcatgcaattttgatatatgtatacattgtggaatggataaatcaagccatttaacatatgcgtggtctcatacacttattgtttgtagtgagaacacttaaaatctactctcagcaattttcaagtatataatatattgtttttaactgcagtctgtagtcaccgtaatgttcaagagacctcttcaacttattcttcctctctaattatgtggtgtcctttgaccaatgtcttcccagtccttctcactccccacagcccctggtagaatggccattctgctctctgcttctgtgagtgtgattgtcttagattccatatacaggcacatctcgttttattgcacttccctgtattatgccttatagattctgtgttttttacaaattgaaggtttgtggcaaccctgcatcaaacaagtctatcagcaccatttttccaatagcatgtgcttactttgtgtctgtgtcacagtttggtaattcttgcaacattaagcttttttagtatgattatatgtttatggtgatctgtgattggtgatctttgatgttactattgtaattgctctgggggtgcccaactgcacccgtataagacaatgaacttaatacatgttgtgtgtgtgtgttttctgactcctctaccaaatcagccattcccccatctctttccctctccttgggcctctctactccctgaaatgacaactatattgaaattgggccaattaataactctgcagtggtctctaagtgttcaggcaaaaggaacagtcgcatgtctctaactttaaatcaaaaactggaaatgattaagcttagtgaggaaggcatgttgaaagccaagataggctgaaagctaggcctcttatgccaaacagcctaggtgtgaatacaaagaaaagtttattgaagattgaacatgctactccagtgaacacacaaaagataagaaagcaaaacaaccttattgctgatatggagacagttttagtggtctgaatagaagatcaaatcagacacaacattcccttaagccaaagcctaatccagagcaaggacctaccttgcttcaattctatgaaggctgaaagaggtgaggaagctgcagaagaaaagtttgaagctaacagaggttggttcatgtggtttacaaaaagaaaccaagtccataacataaaagggcaaagtgaaacagcaagtgctgatatagaagctgcagcaagttatccagaagatctagctaagatcattgatgaaggtggctacagtaaacaacagatttgcagtgtagattaagcagccttatattggaagaagataaatctagggttttcatagctagagaagagaagtccatgcctggcttcaaagcttcaaaggacaggctgactctcttgctagggctaatgcagctggtgactataagtcgatgccaatgctcatttactattctgaaaatcctagggccttcaagaatgatgctaaatatattctgcctgtgttctataaatggaccaacaaagtctggatggcagcacatctgtttgcggcatggtttactgaatactttaaggccactgttgagacctactgttgaggaaaaaaataatatttctttccaaatattgctgttcattgacaatgcaccaagccatccaagagctctgatggagatgtacaaggagattaatgttgttttcatgactgctaacacaacatccgttctgtagcctatggatcaagaagtaatttcaacttttcaagtcctattatttaagaaatacatttcataaagctatagctgtcacagacagtgattcctctgatggatttgggcaaagtaaatcaaaacccttctagaaaggagtcacccttctggtggatgccattaagaacatttgtgtttcgtggaaagaagtaaaaatatcaacattaatgggagtttggaagaagttgattccagccctcatggatgactttgagaagttcaagatcctagtgaagaaagtaactgcagatgtggtggaaatagcaagagaactagaattagaaatagagcttgaagatgtgactgaattgctacaacttcataataaaactttaatgaatgaggagttgcttcctatggaagagtaaagaaagtggtttcttgagatggaatctactcctaatgaagatgttgcaaacattgttgagatgacacaaagaatttagaatattacatcaacttagttgataaagcagcagcaggatttgacgggattgactgcaattttgaaagaagttctactgtaggtaaaatgctatcaaacaccatcacatgctacagagaaatctgttgcgaaaggaagagtcaattgatgcgacaaacttcattgtcttattttaagaaattgccacagtcacctcggccttcggcaatcaccaccctaatcagtcagtatccaacaatgtcaagacaagaccctcccccagcaaaaggattatgactcaccaaaggctcagatgatccttagcattttaacaataaagtattttttaattaaggtatgtaccttgttttttcagacataatgttattgcacacatcattgactacatatagtgtaaacataacttttatgtgtactgggaaacgaaatatttcttatgacttgctttattgtggtggcctggaaccaaacccacaatacctccaaggtctccttacataagtgaagacaagtggtattttgtctttctgtacctgacttatttcacttaacctaatgttctccaggtttgttcatgttatcacaaatgacaggatttccttctttgttaagaccaaatagtattccattatgcctatatactgcatttcctttacccatttatctattcattgatggactcataggttgactccatatcttggctactgtgctctccctttcttttgtgctgggtaaggagtgagtcttggtgaatccttgtcattgctctgtctttttctggccaggcatctctaaaatgtgtcccccagctgatgggaggtctgtgcctcctccttcgatcccttccctggaaagagcaccaaggaagaggtccttaatgaccagtcctgcctctcagatgagcactctcctcctccctgaccagctctccatccccctcaccactagggcctttgtctggcttcatgagaagaacaatgagcatacatgggggaagatgcttcctccaccaggacagccattaactaacaagcccgccctccccagtgaaggccaacctccctcctaacacattctctcttggaacagccaagctttcctgtgcagctgagctgaattccacttcaatggataaataatcttgcccactgacaagtcctcttttctaagggaccaggattttccaacccttgatgaggacagatctgtttggaagggaccacaagattctaggaattagctggaaatcaggggtgaaattatttgccaaggccagaatgtataacaaatgcccctgggagccgaggaaaagaggcggcaccttgctgcagcacctgcccctcctgggtgttagttacatgtcctgtgatgtggttgccaagaactccttccaggacgaggtggtggccctgaaatgcacaaactgacccaattgcattattgcctgtttttttaaattaaactttttattttgagatacgtattgattctgatgcagttataagaaatactgtgctgtttacccagtttgccccaatggcaacatcttgcaaaactatagtaccatatcacagccatgatactgacatggctacaatcccctgattttattcatatttcccagttttacttgtgccccatgtatgtatgtgtgcatttagttctatacaactttatcacgtgttaagatgtgtcaaaatacagaaccattctgtcaccacaaagatccttcctgttgccttttataaccacacctcccttgctccctctacttcctcatctctaaccccaggaaccactaatctgttctttgtctctataatttgtcatttcaagaatgttatgtaaatgaaataatatagtttataatctggagcttggcttttttactcatcctaattcccttgagattcatccaagttgttgttgggtgtaagaacagtttgttcctcctcattgccatgtctggttttaatcattaagcaccccaacatggcacccaagcccaattacaaatccctcaggacatgatcctcagggaacttttattctaagagagcccatatgttttgtttggtgctgctgagtttgggggtgtggggatggaacatgttgcaagtttttctaggtacatgcaaacatacctaggttccttcatctccttccccaaaacagtgatcaattggattgtaatattctttagcactggttgacagcccttccttgtgtctccttgtcaccttcctccccaggagcacatctacaagctgatgaagagtgacagctatgcccgcttcctccggtcaaatgcttaccaggatttgctgctggccaagaagaaggtatctttgggaagggcaggcttgctcttagcactgttgactcttgcctgctgcttgctgctggtttgaaatgagaatatcatcccttgggttttatttatttcctactttcttctttcccttctctatctgctcccattctaatggaaaacagttaggattgtcaccaccccagccccactgcaaggtccaggatggggcatcctacctccacatccctactgcctctctctgcatgttctgcccatggtgggggtgggtacgtagggtgacaaaagactaaggccacagtggctcagcataggagtgcagggctggcagtaacaccagcaaaacccttaggacactggagagagcccctcactgcaaagtccagccccttcacctcagacttctctccctgaccagcccagagaggagtatgaggccagggttggggcagctctctcactggtcagaaagccttgtcagtttcaagagcacaatcaggtacctaaagtcatcctggggtttctccctccttgacacccccttcctctcccgcacctgccccacggtgttgcctttctctcttaaccaagaagtaactgcacccagctccttcctcctcctccttagaactcagccatggttccttgcagcccatggagtcatggatttgaggtgcaggggccctcagcatgcaggtgaggggtgacagaagcaggaataaattcagctagattcctgggaagagaggaggaagagtaggcaggagaatagggtccaggaagggaatggaaggcaagagagagggctcctggtttcagtacacctgcccaccctctgtgcttttcagctctgatctgaggcccatgtgtggttaagtgtggctcaacttgcaccaaaccctatgacttctgtgccatggcacttagggagcacaggcatccctttctcctccctcctggactcccagccccaggccctaagcacgtggttgcccatcacatgctctccgctgggctgcctctcagccacgcaagccttctctctgtgtgctgtcaccctcatgtgccaggatcctgtctgcgtatctggttgggaccacacaactccagagtcctggagagcatttataacctgctctcctgcccttgtgtagccctggaaagaggccatggagtctgagaaaggaaagaggacttctggggtatcccagttgtcagcagctctctgggtttcctgcatccctccccacaggtgtggctactgtgatgggcagtgtggagcctggcctcctgtcgattcccctgctggaggatgccaatggaggggctcctttggaggaggccgacaccctcatacatggctctaatgcccattttttctaagaactagaggaaagaaaaattataggaacttttgataactccagcccagatctcatggatgaaggtcaaagtaagtttttcttattttctgtggctcaagacccctgatctgatcacagtttggtgactttctaaggctctggtagtttaaccagtctaggcctgtctacacacctagaagaagagaagctagaggccattgattctccttgtgggtttgaacacaaaggaaaaatgcaccccaaaccaggctgagacccctgtggctgcagatcctcccttccaagaagaaaacctctcagaggaggtcacttgagtgaggaaggaactggcaacctgcctgggaaaagttccttagagttatcctcccagctcccgaagtaagggatgttcttgagacagaaagcccttgcagataccaacaacgtctcaatactgaggagttgtttcccaaaacagtgacaaaacctgctttctccttctgtttcttcctgagagtctccaggtatggatctgatttgtaactcggcactttcaggtaggcctagagtattcttctgatttcagggacgggttcaccgtatccaggtcataaaaggtatgtgagattcacaacctccggcggagagagggaatatgaatcagcctcacttttctgctgagaactgacctggacggagtcttgaggcacagccttctgatccttcatccctaattcagcctcttttctaatattttccaaataaatgatagtcacactgaagaatcaggttctcagggggtaggtgagctgagtcctgagggctactctaggaaacttcagtaccagtgatgatggttttccagggcagctcaatggccagtgcaaggcagaggagccaagtgagccagaccaatggccaccctctgtgagccagaggataagaataacaggccgacaatgccagctgcagggcccaggactggcctgacttgagccaagtgtatgccacccaggctggccacagggttcaagctgagtcctgccatccccagaatagagacttggtatggtacccggggccaagcatgagtccttcagttcctagtacaagaagaaaggccagcccaactctgtggtgttatgtcgtttgtgttgtattttccttctgcaacctcatatctgtcttctggcagccagctgagctgacaaggggcctggctgccaaggaagccccccaacttcatccacacaggcggctgcctttggcctgtcccctctgctttcagcacagtccgcagacccacagacctcaggctgcctctttagctccctcatttcagttatttgctgggtgtatgtttgtgtctatgtgagtgtgtgcactctccgaacttctcagcctcgggctcaggaccctggaacgggatccaggatacactagcaggtatttgagcggtcattctactctcccggaacccctgcagctaggaaatgtggggtgaaaggaaagtcaggagcaccccacacctctcttcctcctgtagtagagggaggctaggcctggaaagacattcaagggctttgcctctcctcgctcctgttctgggaaccccagctaagagttccccacaatggtttctgagcttcctctagcctgtcgtacgtacatcttggcaggtgttatgtcaccttttggatactgagaaaacacacaatccccatgttattgtcttctgagacccaagaccctttgtccatggcaaaggctatgagtagaccctccttgctctaaggacacagaacgagggtcactaggaagtcactgaagttagcaaactttctggctgcctctgggcaggggaatctcaagagagaaaacagtcctaaggcagactcatggatgagtagataacttcgcttccccggcagccccttcctgacgtccctcccacaccctgctggctctcagagccagtctgttctgtgtcaggacttggggggcccccagggccccagggccacaaccaccagggctcctgcctgtgggcacggcaggttgaaagcagcaagcaagctgctcaaacccaccgactgtggtcctgcagcaaagtcatgatggttctgatccaagccccgcaagcaccattcatggcccccggagaagcaaagcccccctctctgctccctgctccaaggaggcggcaccatttctcgtgggcttctgtcttctgtctctcccattgactcttccaacagctctggctgcttctcttttcccatttttcgccccattttgctttggtttttgttattctttagctgcagctgctgctgtttgggaaccacgtataagctgaagattttttttttctgtatttttctccctacccttttttttttttcctaaagccagaaagtgagcaaggtcgtagaacttccctagaaaagttcactcgcagtgtggtaagttcagtcggttttcttccctcagcttttcttttggttttggttttttctttcttcttcttttttttttttttccctttggttgttgtttcctttggggtgggagggagtccagtgctttctccctcgactcagcccttttcttttgcgagtgtctgcagcttctcttctag

SEQ ID NO: 59 - DNA, 11042 bp, Homo sapiens
ggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcaggtgtgtgagtcaccccaaccgcactgaacctgggcaggctgcttcccagtgccggagggctctagagcccggagtgagggcctgcaggtccctgggtggcacagagagtgctgggggtgcagggaggcctggggcaccatctgcttgccccagaggccggaatttgtcttcagacactttctttctccaaaacccggaggtctaaggactgagccgactagaacttcctctgcctcagattcaggccccagcccctcctccctcagacccaggagtttaggtcctagcccctcctccctcagacccaggagtccaagttcccacctcctccctcagactcaggagtccaggcccccagcccctcctccctcagacccaggagtccaagttctcacctcctccctcagacccaggagtccaggccccaagcccctcctccctcagacgcaagggtccaggcccccagcccctcctccctcagactcaggagtccaggcccccaagcccctcctccctcagacccaggagtccaggccctcactgcactcagggaccagtgctcccttccctggaggcctggtcaggggtcaccaagagcagagcgtgggggcgggaggaatgtgtgtgggaggcctgggtaaggaggaaaagggtgtagccagtctcctggctcagggacctgagagacaggggttaaaaggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggagcccggaggcctgcagcaggtgagatcacagacatcacagaacctgccgggtgggcggggtgggtggccattgcgcacagagccaggctccgaggaaaactcccatacagaggaagaacgctagggccccctagggtaaccctctcctgtcgacaggaaggcaaatcagtgcccaagaaagtagaaagatctaatcagaatctcaccatgggttactggaccagtggacgtagttctgaattctctttggcactgttttcgtgggatcctctgatggaagatgtgggctgaggaagaataaatcaggaggctagatgggaaggacagaggtcaaggcaggagaccatagcaggccaggaaggaaggagaggatgcagagggagcagacagagggatggggggagggtcgaggcagtgactaatggaccatgtggcttcccctctcaggagcggccatgaagaagctgatggtggtgctgagtctgattgctgcaggtggggaaagggcatttggatgggggaggcttgcagacagggttgggcttgttgatggagaagaggctggtattggggatggggatatgcacagggttggggtgggggagctttgaaatgaggaagacgttggggattaggctaagggtggggaatacagatagggagggtggtgggaggtgggtttgaagatatgagggtttggggtggggttggctttagggatggggatctaaacatagaagaggtaggaggtaggttggaaagttggagagagcccgggaataggggatacagttgggtttgtaatgggaatggggtaagtttgggagtggaaatacagagaagctttttttttttgagacagggtctcactctgtcacccaggctggagtgtagtggcatgatccatagttcactgcagacttgaactcttgggtctcaagtgaccctcccacctcagcctcccaagtagctgggactacaggcgtatgccaccataccctgctaatttgtgtgtgtgtgtgtgtgtgtgtgtgtgtgtgtgtgtgtggagatgaggtctcactgtgttaccgaggctggtctcaaactcctgggctcaagcgatcctcctgcctcagctgggattacaggcataagccactgcacctgaccaatcttgactggagttcatgttgagggggatgcgcttggtttctccagaactcctctctgactcagatcttctctccctcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgtgagtctacactgtaaatgaacagcagatgcgactgaaccctgagggtgtcttatagatgtcaggcaggaggtgacataggcatcccccccatcccagcacgaggccatctgatagccaggtgcattcggctgttgcttaattgagtacttaatgtgtgccaggccctgcgggcatagcagtggaaaagaaaataaaaaaaagaaaacaaaaaaaaacaagcaaaattgctgttttcctgaacttactttctaatgggggaattggatcatttggggacctgcagggcgtgatgggcatttggatttaattctgagcacagtaggaagccactgggcagttttgtttttgttgtttgtttgttttttgagacacagtctcgctctgtcacccaggctggagtgtagtggcatgatctcagctcactgcaacctctgcctcccaggttccagcgattctcctgcctcagcaccccaagtagctgagattacaggtgtgcaccaccttgcctggctaatttttgtatgtttggtagagacggggtttcaccatgttggccaggctggtctcgaactcctgacctcaggtgatccgcccgcctcgccctcccaaagagctgggattacaggcatgagccaccaccacacccagcctgatttacatttttacaagcaccctggctaccacgtggaacgtggtctgggcaagagagagggagggaggcccacgtgggggctgttgctttcatccggcgacataggagggtggcttgaacccaggcggtcgcagtggggatggagggatgttgaatatcttgggatgtggaattctgagactgagccagcagaatctggcaacgaggaacaggagggagaggaagaagcacggctggcttccgtgtatttgtcctgaacaactgggtgttttgccacgtctttctctgagttgtgggagagggaaagagaaacaggccgggtgtaggcaggggagcatctgacattttgctttagccacgatgagttggagatgccggggagatgtcccagcagggaggccagggaggactctggagctcagaggagaggtcagggctggaggttaaaatgaaggcatcgtcagcaaacaggtgtatttaaagccatgggactagatgagatcatccaaaaagctggcatagttggaggagctggagggcccaggacaaaaaccctgggcgctgatcctcactagtcagattcacgacagctgccacttgtttgatgctaactaccaatcaggtgctgagtgaaaccatgtacacacctttcctggaatgcccaccacaagggactcttggcaccattttgcaaatgaggaaactgaggtgcagggaaatagcaagtgacaatccctggggtggttcccctgaccccaaggagaccttggatgactctcaccaccatcattcattcctttgatgtacattgactaagagcacctgctaagtgccacattcgagttgggcagtggagattcagcaatggatgggacacacacgtcatccctgccctcgggagcacaaggacagaaaggtgcagacaagcaaagtgagggctgggcatggtggctcacgcctgtaatcccagcactttgggaggccgaggtgggtggattacctgagttcgagaccagcttggccaacatggctcaaccctgtctctactgaaaatacaaaaaattagccaggcgtggtggtgggcttctgtaattccagcaacttgggaggctaaggcaggagaattgcttgaacgtgggaggcggaggttgcagtgagccgagatcgcgccactgcactccagcctgaaccacagagcgagactctgtctaaaaaaaaaaaaaggaaagaaagaagcagcaaattgggctggccgtggtggctcatgcctgtaatcccagcactttgggaggccgaggcgggtggatcactcgagcccaggagtacaaagctgcagtgagctgtgatctacagaacaccactgcagatccagcctgggtgacagagcgagaccctgtctcaaaaaaacaaacaaacaaaagaagcaaacccttcaaaaccccatataattacaaattatgaaggaaaagaatacgggtacctactttagatggaggagggtcaggaaggactttctaatgagataaaatccaagcggaggcatgaagatgggaaaaggaatgttcagggcagaggaaaggctgtgataacacccctgaggtgagaaccgtcttgagtattctcagaaaataaaatttcccgttcactggggggcagaaggtgctgggagataaggttggaaagtgactacagccagatcacacaggggctccagtgccaagtggaggagcccaggctttattcttaggacaatggggagccatgggtgatgtctgagcaagggagtgactctctgtttcaggaatatgtatcaaacacctatcctgtgccaggtgctgatcaacgcactggagatactatatctgaatagaacaaaaatccccatcttgacatcctagagctgcactgtctaatatggtagccatcagccacatatagcaaattacattgaaattaatgaaatggaaaatccacaagccacatttcaagtactcagcagccacctgtagcttgtggttcccccagccacctctggacagtgcagatcgagatcatggcatcgtagcatttagtggacagcattgctctgcaaggaggagaaataacacaatgagtaaatatttaacaataaatatatagcaggtcggatgattgtgataggttctctggtggaacagaaagcaggggagggagataggaattgcctactaacaggtatttgtattttaattgggcaactaaggaaggcttccctgagaggcgacatttaaaggaagtgagggagtgagctatgcagatacttggaggacagacttgctggcagagggaacagcagtgcaaaggccctgaggtgggaagatcactattgtgttcaaggcaagacagggaagccagcgtttggctggagcagagggagagaaggggagagtgggaggagaagatgtctgtgagatgatggggcagtgcttgcaaggcctggtgtgccacgttgagaactttggctttgattctgagtgagatgggagtcataggaggggctgagcagaggaggcacaggaccaacttacattgttaaaatatctctggttgctttgtggaggatggactgtgggggaccagagacagagcagggagcccagtgaggaggctactgctctagttcaggtaggaagtgaaaaggcagctcaaaccaagatggtagccgtgggaaaggtgagatgtggccagattctggatatgcttcagagaggcaaaaggaattctggacagcttggatgtagggcatgaaataaagagagtgaagaatagcccccaagattattctgaaaggatggaattgccatttacccagctggggaagactgtgggaggagcaggccagcgattcatgacttcccagccctctctgaagcctcaactgcagcccaagggctccaggtgagacccagccctcttccttcccaggaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtcagtagtgggaggctggtggggagcaggctactggctacttggggaagtgtgccaaaggatggggagtgggaaaattggtgaggggccatgggaagatgggctaatggtgaggaccaatgggacagggtttcaatgggagaaaggtcaagggggagggagagtgaatttgggagctgggccagtgagtgaacagccaatggaaaatgtagaccaatgggtgaatagcatgggagagatggaacataagatgaaggttcaataaagagggaaggtcagtggggagatgctaatcaggaaggatgtcaaaggtcaaaggggactgatcaggattcattgaacagcaggaaggaataatggagaaggaactgatggaagaagagaaaccaataaagcacaaaagccaactgaaggatgtgaattgagacagtgaatgggggtatagctgatggaagagggactaaggggaaaggatcaatggtccagaggagtcactagaggaaaaaacaggtccaatagatcagcaggatccatgaaggtgggcctgtgtgtgaagggccaataagaaaggtgaaccattggatgaagggccagtgggaaggcagagacaatgggggaggatgcggcaagttagaaaaggaccaatgagggaggtggaccattggatgaagggctaataggaagggagagccagtgggggatggtgaggccagttagaaaaggaccaaggagggaagcagaccaataggaagagagagccaatgagggagggcagggccagttaggaaaggaccaatgaggaaggtagaccattggaggaagggccaatagaaagggaggatccatgagggagggtggggacagttagaaaaggaccaatgatggaggtggaccattggatgaagaaccaatagaaaggaagaaccaatgggagagggcatggccagttaggaaaagaccaatggtcacagagtgaccaatcaagatgaatcaatgggcaggaagtgtccaatgaagaatggactactgatcaggaggggtacagtagaggagggcgtaacagaggaagagtcctccaggtcaactgaaactactgaagaaggtgggaccagtggaagagagaaaagtggaggagggacctaagagaaaaggaaaaccaataggaaatgaggactcctggagaagagactattaatgaggaagacagccaatgggggggaagaatgatagaaagagggaccaattaggaggcagggacgatggtaatgagatgtaagaatgagagacaaacaggaagaggggtgccaatagaaaagagggaccaatagaggatggaggacttataggggttggggggtgactggggaggatgaggggagtgcaaggcctgggctgagtctggcccatctctcccctaacaggtgatttccctgacaccatccagtgtgcatacatccacctggtgtcccgtgaggagtgtgagcatgcctaccctggccagatcacccagaacatgttgtgtgctggggatgagaagtacgggaaggattcctgccaggtgaggtgacccggatctgccacttacacagccagggacaggacgaagtcacaaaaacatggccagacacaggaagagagagacacaggccaaaagagagctttacagagacagatagagacaggctgagggagaacccaagccttgaaaagaagagacttagttcaacacacagagacacagtcagggatatgcagagatataaagacacagccagcagagacaggaagtgcagagacaaggatggaggccgcgggatcaagaaccagagaggccaggagcagcggctcatgcctgtaatcccggcactttgggaggccgaagcaggaggatcacctagggtcaggagttcgagaccagcctgatcaacatggtgaaaccctatctctactaaaaatacaaaaattaggatgggcacagtggctcatgcctgtaatcccagcaccttgggaggccgaagcaggaggatcacctggggtcaggagttcgagaccagcctgatcaacatggtgaaaccctatctctactaaaaatacaaaaattaggatgggcacagtggctcatgcctgtaatcccagcaccttgggaggccgaagcaggaggatcacctggggtcaggagttcgagaccagcctgatcaacatggtgaaaccctatctctactaaaaatacaaaaattaggatgggcacagtggctcatgcctgtaatcccagcaccttgggaggccgaggtgggtgaataaccaggtcaagagattgagaccagcctggccgatatggggaaacctcatctctactaaaaatacaaaaattagctgggcgtggtggcaggcgcctgtagtcccagctactcaggaggctgtggcaggagaatcacttgaacctggaggcggaggttgttgcagtgagtcgagatcatgctactgcactccagcctggcaacagagcaagattccgtctcaaaaaaaaaccaaaaaacaaaaattacgcaagcatggtgggacacacctgtagtcccagctactcgggaggctgaggctggagaattgcttaaacccaggaggcagaggctgcagtgagctgagatcacgccactgcactccagcctggggacagagccagactctgtctaaaaacaaaaagaaccaaagagaagtagtaaggaagcagatggtgtgaggggactgtccttcctcaaacagagcccccacgagtcctgctcagaaacgaccaggctctggaggagggagacactagctggggaaaggggactccctcccgaatactttaacttgggtttcctccattgtcatccatccaggctctcctctttatgccagaatgactaatgcactgagggatgtgcagagaccaaccaagggggagacacaggcagaaacggagacacaggcagaaacagggacagagacagggaaagcgatacatagcaagttggacgcaaagaaagggcaggtgggcgagactgtcctcaagacacgaggtggagaggtgtccctggacagaatagtgccaggcatatctctccctgggccctccctacctctcccacctgggtcttatcgtctcctcctccccctcctccccctccccatcctcctccccctctccatcctcctccccctccccatcctcctccccctcctcctccccctcctcctcccccctcctctccctcctcctcctcgtcttccccctcctcctcctccttctcctcttccttctcctcttcctcctcctcgttctcctcttcctcctcctcctcttcctcctcccccttttcctcctcctccttttcctcctcttctcctcctcttccttctcctcctcctcttcctcctcctcctcttcctcctcctcctcttcctcctcctcttcttcctccttcttctcctcttcctcctcctcttcctcctcctccttctcctcttcctcctcctcttcctcctcctcctccttctcctcttcctcctcctcttcctcctcctcctcttcctcctcctcttcctcctctccttctcctcttcctcctccttctcctcttcctcctcctctctctccatcggtctctacacctctgcctctctccacacctctcagtctccattcttaaattgtttctctttcttgctctctatgttcctctgcatcttggcattcctatctctgtgtctttgagtctcctttattctctctctaccattctctctctgtgcctttgtgtgtcttactgtctctctctctgtctctctgtccctgagtctttctctccatctttcagtaagtacctctgtccctttctacctctctctctgtcacacacacacacacacacacacacacacacacacacacacacacagtctctgggtttctatctgtatctgactttctccctctttcctgcagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatg

SEQ ID NO: 60 - DNA, 108718 bp, Homo sapiens
atggatgtgaggttctaccccgcggcggccggggaccctgccagcctggacttcgcgcagtgcctggggtactacggctacagcaaggtgaccgggctgggccggtgggccggggggcgggggccacctccccatcctgggcgcgccccgcgctcgggctcaccgcctgctgcacttttctttggcctctttcctcccatgtctcttctacctttgagccttcgtctctgtccagctctccccgcttctctttctgccccatcccacgccgctttttgtcccccagccggcgctctcctcagcccctccgctccctcccacctccccgccagactctcctttgctgcccccaaaaagcgaagagagcccgaggactgaaagaagggctggcgtgtgattgtttgttgctgttattagtaaacacgatcgcagcccccctggactgagtgggggctacgcaggggtccctgatctcctggtccgatgatcttgccctcccccacccccagtccttcttacctcccccacctactccagagccggcctcggggccgcttacggacggaaaggaacaaacttttgagtatgcctggacaggggagtggggggaagtggtgggaccccgcaggtggcctttgctgccctttcgttagggcactttggacctcggaaccggggtgcccgcccctccccgcttagagtaagtggcttctttcctctcatttttttgggggggctaagttttgcatttcggggagatcgggattggagacctccacaccacaccctggggtcactccaccttctccacctccccctgcgccaacttcgaggaccgagcgttccaggtggcgaggtggacctcagaagggcagcgggcgtcgctcggagcagcgaggcgggcgagagtcgcagccctggtacccgggccgcgcggaattcccccccaccatccggtgtcctctgtcctccctgaagcccccagcgccgaatttgtcgaaaacatcaccctgagggcgagattcagagaaacagccgggctctgaatggcctgtgccttttgaatgtggttttctttccccttcctcctgctcctccctcctccctctctttttctttcaaatcgtagtttgtttgtgattgcttggataacaggaggaaataaggagcctgctgaaagaaaggtgctaaacaaaactaatgaataaataacaggaagaggaggaattgcatctagagtgaggaacagtttgctgtgccccgtggctgatggaggctcgtgttcctttctatttgtttatactgcgttcccaactctagtgctgaagtttgtaaaagaccattagggtctctcttgctcgccctcgcgtgtcatcatcgcccagctcagcgtctggcacagaggggcctcccaaaaaatatagatcgaggggactttattccgtgtgctttaaccctttggtggttggagcgttcctgctctccgaattctaagggctacgctaagcatttatagagaggcaagaaaaggccgatcgctggagccagagttaaggattagtttgtgtcctctgattttggatttactcaggttattaaatgctttaaaaagtcccccatgtatgctcagtaagggacttaggcagcctaattaagtatgtagtgtttctgagaatctacctaattgttccagtggggtattatttatctccttacaacttagcatgtggatgcaagccttgtataaactgggcatgctcttatttttggaagccattaccttgcctaatgtaactccttctttctctgatttaagatctgcaacactcgaatgacaccaaaatagaaacctattgtacaaatgcagtcactgcaatgcgtggcaaatctctgttcactgggatcccaagggtacttcaagggaccagaggaaattgggggtgttttgtgtgtgtctcttttttattttctgagaaaggctattttgagtctatttaagctcagaacatttatttcagggagggtatataaagcttgaaaacagacattatttattgagatgcttgttcagcttcaggagtgtggatacaagttggcttactgtcgtattttcttaatgcagctatttgcctgaaataacttgctttcttacttatttagcaatctgatcgtcatcagtgctctgtgtacccaagttatgaaagttagacatagcgcttaatattggtaggaatcaaattatacttattgtaagggatctttgtattgacttccttgcaagtaaaaatataactatctttaaactgagccacaatactatattttgctacttttattttcggaagtgaaaaacacaattttatttcccataattttcctttacagagaatatagtagaagaggaagtattaactttatgggtataaagcagcaagtgctaattaaaggtttatagcattttgtttcacagctaatttgtgtgtctgaagtggtgctgttcaatataggtttatactgaaaatgtaaaaactagcatataaagacatgcatttattttatttgaaaatactcacattattaattaatctctaaagacttaacttttgatgacatgtattatctttctggatgggaaatgatggatttcaaagaaagtatgtttcttccctctcttgttttaatgaccatctgggaaactttagaagaaacaccgaactcttggctctaggcttaacaagtgaaagttagcgcttatctttaaatttatttacaaaccgtgaataatagggtttcattcattactctctttaacaaatgaccagagtcctttgtatcaattatatgcatgtgtattatctttacattctgtgagtatatggatccttttcaaatgtcagtgctcatgaaagtgtactgtgtctgtggagaatggatgaaagagttttgtgggttcaaaagtcgttgcaagtaggagaataacttcaaataaaatatagccaggatcattaaaatcagttaataattcatgaaccagccactgatgtataaacttaaagtcatcactgtttcctaagggctaatttccattttaatttcaagtagaaagtcgactgtttgaacatttctttttctggtgtggttaacaaattaaaccctgtatattaagaaataaaaactcattatgttgctcaaatgatctggtgactctttgactatatatttgtaatttttctttcctgagttcaatttgtcttttcaccagtaagaaaacaatacacagaatatcaattagcaaatataatttagcactaatctgaaatccaacatactccaaaatccaaaactttttagagcactgatgtgacagtcaaaggaaatgctcattggaacatttcggatttcagatttttggattagggatgctgaactggtaagtataatgcaaatattccaaaatccaaagaacccctaaatctgaaacttctagatctaagcatttcagataagggatactcaacctgtagttgtcagaattctgccatcccaaaataagatactgtgtttaatgtgggtgtgaggtgaaatcatacagtgggttgttaacaaacttggactaaactccagttactagctatttctgcatatttttagggcttttccttttgaattatggctattgacctctcacccttacttagattagtgctatgttgtttttattctatcagtcccagactttgctttctaattattatgtgtattatttattgatcactttgattaattaagacattcttatattagtgctttgactccacctgattgggcttctgccttggctagcttgaagggcaaaagaaactgcagggtaatttgtcatttgtcaatcttcttggggatcatggttcaaattgagaacatattggggggaatttgattgaaactcttcttagattgagagattcctgtatcctatcacgacaggtcttcacgtaagatattgaagccacattgtgaaaaagaaataaggttttcctaagagccttaaactagggggcataaactcaattgtctcttgggacagcaagttagcctacatggagacagggtttgcggccaagtagagaacataccccatttaaagggatagccttcgtcagcattagtagagtgttgccatgccaacatttgggtccaatatctctatactttacaattcttttttcaagaggatgataatctgggtttttatgtgaattatcatgaattttaaatgttggaataaattaacaaaaaataattaaaatcattatgtgggaccctcaaaacttgcttgtgtgctgattcttgtacttcttgtcttaaattcatatgtagatgaggatccaaacataactttttaataagtcatttatggtttacatgcaactatgtggacagttctgctcccatgtccaactatgtagacagttcaatagaatggagtagagctgcgtaaagaaatttgtgacacctgtgaagaccagacttaccacagaatggttggcttcaggttggtacccagggcctttttagaaccttggcagctctaagcactattgatctgagctcccttccatgccccatcaaacattaaaatgcatccacatcctgcatttaatctaatgtgatatgataccatatctgagttgatatggatccgttgacttagtttacattttgtaaatatttagcttcacatctattagttgtaattttgtagttttctggtgatgtgtggccagtttatttttttctcacattttaaacattgttgtgggcccatgagaagcttgcagttctaagtgtgtggtgtatagtgactaatggataaaacagtcctgctgctcctaactagaggtccacaaactatttgaccactccagatgctgggctactgatgaagaccctgtgctcagtagagactagcatatagttagccaaagaaaattaattttagtcatttcaaatgaagtcaatgcatgtaggtggtcacagttttcaaagtatgtgtcgatatttcaaggaatctacttcatgtcacaaactcagctggatgtgaatccacttgaaaatttgtttaatctgcagagtattaaaaaaggcttggttgtctatatctaaaaaactttgcatataaatctggattccagcttttctttagacatctggcaacactgaaccaatatccttgtatggcaacatctgctcggtgtccttcagatgtgcctgtaccccatagttcatcacggcctgtttcacagcctgtctcatattcagacctttgtaatcctctcaggacctgaaggcttcaagtttgaagattttgattaagaggagaagaaactaaaggagcaacaaatgatgctcaaacccggaaaggttactgccaccagacaaattgcagatcaagtgcatctcatgctatgtacggtagtagctgagatggtaaaaaataatttgtgatcattttgtagggcagtgtttctcaaactttaccatgcacaagaaccacctgggagcttgttataacacaggcttttggactttacccttggagattctgattcatgggcccagggctgggctcccaggcaatgctaaggttgtgggtctgtagactacactttgagtagcacatcaagcagagggccttctaaggtcaagagtttgctctttctaagtttatcagttagagtgctttgggctgcagagaacagaaaactcaacaaatggtggcataaaccataaaagacacttgtttaccttcaaagaagtctttgggttggcagtgccaggttgttttggatggttcaatcatgtcttgaagagcccttctttgattttctttttattctgctatccttggagttttatcagtcttcccatggctacaagttggctgctgtagctctgggtgtcacatcgtcacatgaaaacacacaaaataagaagcaaggtgatggtggtgggagtggtcacaaatgagtactttctcttcctgtacatctcttggcaagaaggaaaagcttttccactagaccgtctcttttatcttattggtcagaaatgggttgcgtaccaaccctaggctactcactagcaaagaggaagattactttgatcagtttagaccaatccaatatcccttgaggctgggcattgctacgtgagcataattaattagtgttatgctctgttagcaaggaagaaggctgttggaaagtcaacggtgtctgcaactgagtgcattcgaggaatatatatatacacataaatattttttgagatggagtcttgctgtgtcacccaggcttgagtgcagtgaccatggcttattgtagtctcaatttcccaggctcaagagatgcacacatacctgtggtcccagctactcaggcctcctgagtagctgggaccacaggtgtgtgttcgctatgcttggctaactttttcattttattttttgcagagatagggtcttgctgtgtcaccagggttggtcttgaactcttggccgccagtgatcctcctgcctttgacctcccaaagtgctgagattacaggtgtgaaccactgcgcccagcctgaaaaattttaagtggaccggtggattggttagagttttacttttgtaaagattgatctgaccttttgagtagaatggtgtaggccccggcaagagtaggagagaccgggagtaggatgccatcacccagttgaggtaaggtatgggaaggatttgaatcaaggagatgtgaatttggatgcaaaagaaaagaaagcactaaacagaacctcccgactggaaggcagaaagaggaagcagaaacgattgagggtgtttgaatttggggcctggacgaatggtaagaccttgagtggaagcagagcggagagaggagaagctggttttgaggaaagataaccagatcaagctcattttggatatttcagtggtatattctcacagagtcatgcactggaactcaagagagagtttggggctgaacaaccaaagatggagtctttctgtttgtagtaaagcagatgaatgaaatgaatttgagtccttcaagaggaaggagacaggaaatgcaaggacaacatccttggacctgaggattggctggtgttgccaattcaacttcccagtcagtgaggcagtaatttaggaagtaacatgtgaaacagagaatttggaaatcctactgcactgttaaaaacaatgacataaacaaggaatgtgtgcttatgtgtgtgtttgcatgatgaaacatcctttctctcttaatagttatttggaaggaaacattcttgaatgtgtgaaacttgaagaatttggaaatcctactgcaccattaaaaacaatgacataaacaaggagtgtgtgtttatgtgtgtgtatgcatgatgaaacatcctttctctcttaatagctatttggaaggaaacattcttaaatggttattaagggggaatgatgcaaaatttgtgataacataatttaaaaccatattagccatttatgaatgaaaacatttatttttttggaagacacatttgttttggatttcatgaaatgttaatggtgtcataactattttagagaatctgttttgagtatggttaataagaaaggacaggatttttgttgagtatacttacaaactcaaatatattttgaaggtggaattagtgctctaaaaaaaaaagaaaaatcctgtttaaaaatataaggagtagaggcttttatttaaggtccgcatgagcttctcacaggttaatcttatccctttgaggtagatcgttttattttctttgtttcctaggtttgtatccttaatctcttcctcagggaggccatgttctcttaaatatgtttcatgcttgtgtaaaacatgccaggccctggaaaatggcccttcttgtatgattaacattctatctttaatcttaattcaattttgctttgtttgtaaaagaagaatttgaagatagacaaatgggctaatatgaagacacatttgagtttttactctaaattcatatttgaatgatatatactcattcttttgggggagtgaggttttaagctgggtccttctattccaaatgttgcaaatttaatgtagccttatctacattgactaaattgtttatgcagaagaattatgtcaaagatggtgataagagtgagttttaaaattcaatttattttaaatggatgtagtataactgtaccaaattgtgagattttttccagcaatttctacagctaatttgtaataagcaagggatttactgtagaataataaaaattctacagtttctttaaaaaatctcctaggtgtaggaagtagaagttcaaaatgctgacctgactagaaaacttttattaaatatgtatgattggttggaagttgatcttcttcaaaaggggatgagttaaatctagaaatatcaaacagttaataaaatatactcggtagatccatcgtgctgctccttgatgccaacttatctttaatgagagattcaacccttattatttgacttatttaaaaattctaataaaaatgtttaatggaaaagtggttaaaatgattgttttagtaaaaatgctttggttgcaagtgagaaaaagacttcagtcaaactgagttaaatagaaaagggattgtaagttttgtttcaggcatagctggatctagagtctcaagggatgctatcaagactttcttatattagctctgctttcatctgtttttttctttttctttcttttttttttttttttttttttatcatatcagccaggctgtactcaagtagtgggaagttgtccagcagcagctccaagttacattctcacagctcagcctcttcaagagggagagattctttcttgcatgtttcagcagcttttctggatcaagtctcattggatagacttgggtcccatgcccaggctcgtagccacgtaggcataccagtgggggagctggacactgtcatcttcttggaagccacaggagctaagagtatggagcagtggttctttggaggaaaaacaaagtgctgatgtcacaatgagagaatgtgggtgtaggataggaaagcaaagtccattgaaacggctaactggagtgaagcttgatgattttgaagatttctgaggatttccattgtctatgtttattattattctttgtggaaaccaaaatgagcctgtgcttatgtaatgtaaatatcataaatattgtttatattaggaacgcccttcttgttgaggctgagattggatgtggtctgccttcaagaaacctataggtcacctggatattctatggatatgagattttctctttccatggtgggagatgtggttggttgagaacaaactgtggagacactagaatgtctggtgaaagatcctaggttgtattgagtaggtactagtaaactgtgtatgtgtgtgtctcggtacatttgcatatgtatgtgtttacatacatatatgtgtgtataggtagagggtgacattttgaagtggggctaatgagaagatattttcaagacaatgtctgaacatgtttgaagaagagattagagagagagtgagagagctattgaatgatggattgggtggtcagttgctgttggaacgaacactgtagataaaggagagttagcccttaaatgaagccttggtaactatttctttgtgataataggaaagaaagggaagatggctgaagattcatatatatataaaatatgtaaatatgtgcacacatgtgtatatatacatatatatgtacacacacacacacacagacacacacaccactgcacttccagcctgggaaacacagcaagaccttgactcttaaaaatgtcaagagttaaggaaaagggccagtggattggactatgggaataagattctcagtggctgtatggatatagagtgagaaatatatcttgttctatatatacacatgtatatatatatatatatatatatatatatatatatatatatatatatatagtgtatatctatttcagtagaaaagatgttggggaagagaggagagagagagagaacaatatgtatgggcatgggaattgattgacaagcctgagatctatccctgtgtacttttcctacctcattttcttaccactcctcccctctaccctcgctttatgtgttttaacggtaccagccttcatcccatctttttgaacttgatattctctctgtctagagccctctccccaaatgtcttcacttggctggcctcttctcagcacctatgtctgagcccagatatcaccttcaagtatgtcctgaccattaaaaaaatctcaatttctaaaatatccttttccccatctctctaattaatatctctctaccttcataattttgttcatagcatgtaccctatttgaatttcttgattattcatttattcatctgctcttgttgatctctttccactgaaatgtaaacttcatgaggatagggggtgtatttactttgatgcacatggtacatctcacatttagagaagtgcctggcacataaaatgtggtaagaagtgaactagagatgaataaaaatactgttgagcagaagatctggttgtagtttagtatttgagtgaatatgtgttgacatagtatgggtcagacacttctaggcaataggaatgcagcagtgaagtcacttgtccattttcaaggagttggactacagttgtgatgatccctattagaagtgtttaagtttacattttatttttaattttttttatcagtatttgatgtgttggtggcaggaagagaacaatgattatgaagctgacttggtggtggattttgcctaggcagggatgagagaacaggagttgagggaaatgtggtattgaagtgactgcttttaatccaactattcaggccattgaagaaatggtcaaggaataggaggcccccataatagcaaagagggtacattagggttcaacttacatgtaatagaaaaaatcttgaacagcaacgtcttaaatgaagtagatactcatttcttgtttccctaaccaaatctagagggaagtagtccaaggctagtatggaggcttcttaaacactgaagagccaagctgcctctagctatcctgtgacccttatccttatggctcaaggttgacctctagtcaacctccatggtttgaccagcaagaaggacgaaggggattgaaggggatcaagggcaaacggaggtttccagaagctgccacatgccactttgcttatatctcactggctagccttcatcacatggccacacttgggtactcaggaaatgtactttatattgtggctggccatgtgcccagtgaaactctcaattactgtggaaggagtgagtggagaggaagggacaccaggtagttcagcaagtgtgctgtgtgtgagtgagcgatgggtgaggtctgagaaacccttcttgggtatctccaagtttgaaattttatgtatactctgtagtgttcttgtttttcctaaacttcaaagttttagtttttatgtgcttcttggatgatcctcttttggtgagagagacacactgtaataagatttatatcttttcaggcctttcttcagttttgggattttattttgggcacacttaaaatacccagtgatttatgttctttgcaagaaccacacatcattatgtcctaattttaattgattacctgcattttaggcccaaatttctcttcttttcaaaatttttcctgagtttttgtagtgccatttatcaagtcccaactcttggtaacaaaattttgaacactagttaatatttagttgacattttaaaaaccagttttttaaaaacatgatgtttttcctttttgatcaaacctagtttatttctcacttcttatatccctatatccactgagaatcttgttcccagagtccagtctactggccttttccattaactcttttttgttttttttaagagtcagggtcttgttgtgttgccccggctggagtgcagtggtgtgatcatagccactgcagcctcaaactcctgggttcaagcaaacctcctgatttagcttcctgagtagctaggactgcaagtgcacaccccatacccagctaatttttaatatttttgtagagatggggtctcactatgttgaccagactggtcttgaactcctggcctcaagtgatcctctcgccatggccctgcaaagagttggaattacagacatgagccactgcacctagccaacctttgactttgtatgtaaccttgactatgaggacttgtcagctatgcttgccactactacctaatctcctctgccccctttctttgctgttgtattttttgtgtcagccttagagtttcatttctcagctttgggataaactgtgtccattttccttactaaaaattaatgctgcctgactgtccctgggcctttgctgcggaatccttttcatctgtttgttctcttggtcattgtccacaatggatattccaagtctttcatactcttttgcagtcccagtcaaaccaacctaccctcattttagaggggacctccaatcttttacttatgaagaatttgatattatctgccttagatctctgatttgtcatcctcacccattcagggaccagatctttctttcttccaggcccagagagggcagcttctactctgggataaatccttccaacagtccttcctgcctgttgaatattctttgttctgcaaacagctcccatctttcctgtctcttgcctttctaccttcaaatgtgcccagatgtcttctgacttccactatagattttccagtcttcgctttgagtgccacctcacttgtaacaacttttgctgtcttctcatttgcatccacattattatatgctacatatttttatttacctctttttttctcttaaataaattaatgtgaaattaagactactgcaaatggaaaacctgattgctttccacacataaaagaaaatcctaaaaataaacacaaaaggggtgtaaacagtgtttttcaaatctcactggagaccttgcttgcctaaggctctgctctctgttgaactctgttgaaaagggagatttgcaagtgttagggaggtgtcgaagatggcttagtaccaaggcaagactttgtgttattttatctgggggattgaaagggaattcaaaacagaatgactttctcaagatgtcattaaatgctcttcagttccttgtctttgtacttcctagagcagagcttctcaaacttgaatggcacatggggatgtggataaaagacaggtagtgggtctggggtgggcctgagagtgggcattgctaacaaattcccaagtgatgctggcatggatggtcccagccacacttgtgattgtagggtcctagagaaaggaccattcacatttacacttttgtccaactctgttgacctcgtcttcaacatctctctgaatgattcttcaaacaagtaatctttacctagggttccatatctttcccacccaggccctccttaacactccatagaccacttctattccttgttacgttactgacactgtcttctcactcttctccagcgagctctgccttgacagatcaaacttcaatcattcatgcaaaaataccagtgccttctctaggcagattctctgctaagcccagtgctatacttccctgatgagtccttgacttctcctacccccacttttatcctctgtgtcccctgcccccatgttcctggttccctgatattatatacttgaatgtttctgattgccattgccctgttgtcttgtctacagctttcccccttcttcctaggaattgggaatatcctcctaaagcttgacctcttactgttttgccttcgtatgtttttcactttctaggcagacccgtgttgtctgtaccagttatctatcgcgagtgataaaccgcctctaaactttgtgacttcaaaaacacatattttgtttctgattctgcatgtcagcaatttaggttgggctcagaagggcagtgcttatcctattctgggtctcttatgtgtttgcagtcaactgcagattggcagggagggtttgcttcaggaggttggctggctgtccaccggggtccctcagttctctggcatgtatctttcacctccagcacgccagcctgggcttgttcatgatggcagtatttcggacagcaggaaagtacacaagaacccttgagtccaggcccagaaatggcacactgttccttctactacattctactggctaaagcaagtcactgggccagcccaggttctaggggagaggacgcagaatccatttcttgatgggaggagccacaaaattacattacagaagggcatggatagacagaggtgtggagaattgtggccatttttgcaatttaccccagggtctcaaatcctcatctctactgtgatctacatttctcatctcctgcatagtggctctctccaggctatgaccgcttccctgtctgccgtcagttcaaatccagcataagccagagggcaacctgtatccccactgccccccaaactcccctttgaatttctgtttttttcagtgccgtatttccaggtgcaaaacttcaaaattaatttagattacttggcttctttcattcccttagtccagggagtcttcatgtcttctttattatgcttctgataatctttttcttttctttcagccatcagtatcctagcccaggcctctctccctgcttgtcatcttttctcaccttcaatggaatctatgctttacttctggtttaatcttctaaaggatagcttagacagctaccattttccttctgaacacttccagtgtcttgcaatgtgttcgcagatttgccacattcatttctgctgtatctacctatcactgctattatttataattttttacattgacccactttttaatttgtatcaccattgcatatggcgaccctgtattgcttgcaatgtgtaaagattacccatacaataaatgcatagctattaaacttttaaaaagttttttatacaccacttaagttaatctaatatgaatagtagacactaggaacactggcctgcagggtaaattgctatgtcctcaacttgacattgaacaccctccgtatttagtatcaaacttaccaccttaagcaaaaataaaattccttggaaaacaggtggtgagttttcttaactgtttgagttctgctcagggtcactattgacagtcattgcagtggtaatagatcagcaccacaaactaggattgcctgcctttatatttttgcacctttcctggatatattcgttgtttttaaaatagctattgtccatgtgactcaaaacccattgtttataataaataactttcttggtggcataaaagccttgctctgtctgcattaataacttttcgaatatcctccccaatcctggctttggctaacgatttctaattgccagtggggtaaaataatatattacatgttcctctttttacatcttgtctcaatcctagattcctagaagacactgtagttttgactatacagcttaaatcatcggagcctttcttcatagtttaaacactgaaaacagtggagctttaaacaggtacaagatggcaggtgacagcattttccttcctccatgtttttcaaggctgcatgattattagggtgaagcttgtggaagtccaaggcagaaaccaagtaaaggaaaacgtagtcaagttaaaagctagtaagatgagtaagaagagtgataacagaagaccaagaagaatgcaatggatgggagtgatctagaagattcttatatcagggagaaagaccattcagttgtagagaggaaaaagagaagggtgtagttagaaaaaaaagaaaaaaaaaaaagaggggccaggcatggtggctcacgcctacattcccaacactttgggaggccgaggcagggcatatcacctgaggtcaggagttccagaccatcctggccaaccatgaccaacatggtgaaaccccgtctctactacaaatataaaaagtagccgggcgtggtggcaggcacctgtaatcccagctactcgggagattgaggccggagaattgcttgaacctgggaggcggaggttgcagtgggttgagatcatggcactgcactttagcctgggcaagagagtgagacactgtctcaaaaaaaaaaaaagtggggtggggggcagttcaaccctaagttaacagatacatttgatgacaggcaaaactcatggcctgattccagttgcacactaaaatttccattgtaacaccacacatacattagaattcaacttcctgggacgcttttcctgatgataaatgttgccaacatatgtaatggttttgacacaggatttttgtccttcttgaagtccctgctgcccagtttgtgttaataaaatctgttggaagaaataatatatctaaggagaatggcatgaagaagatgccttgcttccttccgttcatccagataacctaatttgataagagatttctgccagacttgtgagagagctgaatgctcacgatggcatattatgtggcaccccacttcacagttgccttcacaggccctctctgctttattgaattgcacactgattaaggcttcactttgtattgagaggattatgagtaatagtttcgtgaacatcattttttttaaaaagttctatttacaatgtatagctcattacacctcatggtgtctttttaaatgatgatttacagagaatcttcttaggttactatatcaagaagaactgaaaaaaatccacttcgctgtatcttactgggcattaatcttaccattcttgttctttctttgcattgatggccaagaagcttggagtcaaacaggaaacccatttagtagctgtctagggcagtaggatatgcattcctgtgtgctggccatctaggctttattattttctcaaatttactttttccttgctttgattcacctgttacttaccttttaaaaatcacatatgcttttaaaagtcacctcacttcctttgtagagaaaggcaggctatgaataaatacttaaagcacttataagtacaatgactatgtttgtatagtgtccaggctagtattcttatcgttctaaaagggaaatttccacatttaaaaaaaaataaagcctactatgtcaatattgtaaaactaaaaaacaagctcttatctcttcttcttttagtctttttataaaggtggatacaattctttatttacagtacttgctagaatttatttcttatgggatatttccccctagaattatagaatctactgaaatgatgaaaacaggaaaattagtatactctctgagactttaaattaatgtttgcactctcttatcattcaaaaagtattaattcctgaaagttgacctcctgacataatcagcattgatctagattttacccgaagactgtgctaaggttaacttggcactggggatccattggactggtggccaagttgttgtctggtccacatgtaaatcccatgatccctgagttagctccctagtggttgcaaagagtttctgcactcatgcagggcatttgtcctttgagaaagtggccattttagcttcaggaagcctgcccggtgcctagtgcctggtgccacatgagtcttgctcaaactgagaagcagttaacctcttataaaaccagccaccctcttagattgctttcaagtgtctcatggcaatacaaatgtacttcaccattgtcttggggtcactggtttgtttaatcagtctcttgaatattgggaaacttttggtaactttggaaagcagcctaattccttcccccttaggttggttctgcttatctaaggttagactcaagaggtctaataggtttcaatgactccacatatgaagcagttggccggctggcacggtgcgagagagagaggctagggaaccaggcagtctgcccggtttgaactggggttccaccatttattggccctgtgatctctggcatgttcctgagcctctcagcatcatcatttctgaaatggagatttcactctgctgggtgctggacagatggtggtgaaaaaaaaaacagatcaagtcttgcccacagcacacacttcctagggggttataaacccacctactccatagagttattgtatgtgattaatacagttaccttctagaggacactaataacatttgcaacatagggtcattgtaaatatgcactataactctctgtataccaagcatttcattaatgttaccattaccatcagtattattttaaaatattgttaacatcctaagatcgggtcagtttttaacatctggttaagttgctgaacatagactctgggagaagaatcctacttcagaatattttaacagaactatctggggtcaccagtagatgccctgctgttctttatttaatgtataacttaagcaggatttcttcatctcagcactgttgatgttttgggctaaatagttctttgttttggggaactttcctgtgtatcataggaggtttagcagcatccctggcctctacccactagatgccagcagcacccccagttgtgacaacaaaatatgtctttagatattgccgaacgtcccctggttcagagccactgagctagaagaatattttcgaaaactttctggttctgtcatttagaaagtgctaactgggatgaattattcctttgttacaaagggcatctatctaaatatagggcagttatttctctagggcctgatggagctaaaaggagcctccatcattgtgttccccagaatagctaagaaggccagcactcattctgaggagtaggtagtcaccagggaaggaggctcctggatcaggtaaaataatctacgcgtgtttcagcaccttgcagatgttttctttttccatctccctctttctgttagagaatacctctaggttagcaaaaagacttttcaaacttataaagctgtgtgatctggcggattgagaagagaagatctttgttcatttgagaaaatagttgtccttcaacaggggacttgcctgaattggggctcatctgtctctgggtgcttggactaagtcacaaagctatttaggaggaattgttaaagcaccaccaatgactggttctgtgcaacgatgatattaaaataataaataggagcaatatgtcgagggttttgatttcttgttccatttctcctaatattgtgggagcacactctggctcattattttgtgtgtttggttctagtatacctgctagctttttcttttcttttacttttttatttttttatttttaaatcttgagtcacatgaacctcaagctctgaagtctttttattcattcattcctcaaatatttatggaatggctactgtgtctggcatggagtgcacagagatttaagaagcagttttgtctttcctaactgtgatttccagacagtagtgaccgctgtgtttcgtttgttcgctgctatgtgtttagtgcccagcactgtgcctggtgtgtaggagaatctcaatacataactagttatgagattttatgctaacatttaatgttctttgcttaaagatttcataagctgattacacatttttggaacaattgacaggatgtcttaagaaagtctgtagcaatttgtttaaaagaacacattccaagaaaatgtattgttgtaggccagcttttcccaaacagaaaatcgcaaagactacctggttagagccttcccaagcagttgtcactgtgaccctcttctctctactacgcctggaattcccaaaggagaggggagtgctgaagacaacaatgtcccctctctggctctgatcaggggtttattgtcaggaaatcccccttttcagggacttcattgtctgtatcctctaaccagccctcccccaccacccccatcccctgccgaccaacgatttcaaggctttatggaaatgaaaagttgctcttcttcacaaaaaagattgggggagataaagtgattaacacttattttgttcaggaatccatccgagctaccatccttgaacactcatttggcttgttggaagggtaatctctttcagaaacattggacagaattgaccaattcattatgtatgtaagtctgcttaagaatgtttaattcagtgtgccctcatctcctggcttcgtaatctcctgccttggctattctgttctctttgagtttctgcaactcatttctccctgattattgaagctttcgctggacattccaggcaggcttggtcgaatcttgatgaatagatttatgagggaaaaaaataccatcctcttttatttggttattgatgaccagattgttctggggtaattaaacttgggaaactacaaatttaggcagaaaagtatgagaatacttaagccaatgggaatgtcagagaatatttcaaaggcagtgggaaattcttataaaaagtagctactttgggcaacatgggcagttcctgaacagccaattctggaagatctagattaaaacaaacaaacctttagttctttgtgggcatactaatatttgcactatttaaaaacggtaacaagtaatttaattatgggcacctttcaatgcgatgtattgcatatttttttcctaatcgttttccttttgggttcattaggcaggtttccattaaagtgcattatcactgctgctacccataacaaggaagagagggagtggacaaaatatgggaaaatgttggaatggtgtgcgtgtgtgtgtgtgtacgcaggcatgcacgcacttgcattttggcatgtgcactctctagaactcaaatggacttcccaatattggagaggagtagaggtgtgagatgagcccctctttttagttattgcctttgtagttcatgcccccactgtctttgatagcaaagatactttgggttgcagtgataaatccttgacattgctctggatttgaaattagcgtttgccctctgagtatagatggtaatgttactgactgcaggatgcatgctcttagcaagtgttcaagtacccaaagtaacatttgattatcttcttttgtatgtcctttattgtcttagtaatttaggtaggcactccggactccacataaggttttcttccattccctttccagtaggagagcttcaggaaaaaaggacagaggaaaagatagagaacccccctccccaaacttaattaaatggatctttagtatactcaaagaagatacatgaatagccctccacccacaaaatatcatcagcctttgcattcgtcagaaaggttctcaagtcattttatttactgtacctgattagattgcagtgtgatcagcacacacaaagcacgggattgtcaggacctgcaaatttattttttaaaaagcaacaaaacaatattctcttttttccctcaaatatcttgcctttcaggtttttgaaatcagaatagaacaaagtaggatttttttttttttaatttaataatgatcactctagctcaagagactttctggggaggttaccatcacagaagaagaacactggggtgggtgagccagggagggaaaacagcatcatgcataagtgtggagttgtgaaaaggcagaaaataggggttctcagaaaggagacccagagaggatggtcgaggccagattttgaaaggtcttgcctgtcgtgctgaagtttaggctttatcttctaggcacttttaagctcaatgtgcttcaagggccatgctgcgatttctttttggatggtggctgaaactggggtgagggatggactgggaagaggaagagagggaggagtggccgtgttcttgtaacaagagtgagtccctttcagccctctgtgggaaggggagggcactgaagagttcatttgctttatgtcttgttcagtgaatgctgaaatcttttcaatgctcattaagagactttgtaattgagtacacgtacccgtggtgattggaaatcatttgcatttactgctccatacatgtaaatcatagtaattttaggaagaaagaattgcaaacatctaaaaaattcatttgaattcatttctcaaattccatttttaatatatcattttctttcaggcagtctaaagtcttatcagaattattttttaaaactcaaatagaccacttttaggccctattggattcagtgagttattaaatttgacatcttccagggtttattttttctgatgccatagttcaagataatgtttttaatactacatgcagaattgtagagattcataatagcttatggcatcttaatgtccacagtgacattccactggtcatatccaactgtgataaacagctctatactccataaaagacgacagtcactaagtaaatgcagaaagatgcaaacagcccctcaatctcatgaataatgttacagatcctgaatgttaattttgaagaaaacacatgcttaaatttaaagtttatgtcttcaattcacagttcttttattcttccagggaaaaaaaatatcaagcagctatgctttaaatgaatctaatgaactgcaaagactgacattttcactataaaagtcacaattcatttaatgagtagttaaatattgatgctatattcaaatacaggcagaataaaaatggcacaatggatttcaaaataggaattcagggttcttttatggtgaaaatttcatgaactgaaaaaaaaagtctcgttcatcaggatgtcttcataaacacaaatattccagtgaaatagagtattagtttgcagtatataaatccccataaataaactgaggtaagtcttcccttttgctgtttggttccctgtcagtctttattcccacaggactcattgatgttaaacgtggttcctgtcttcaatgagaggggatgctgaaattatagaaggtggggaatctagtttccttggactgacctccttgaataacaagtcaaaacaactagatgtcgatggctatttgagaaaaataagtaagctaggtccctgtgactcctctgcttggagctctccaatggctccctgattcattcagaggaaagcctggtcttaactcagtggtggacattatttccttgacctcatcaaggcctgtctgacttccctcccaccacataccccgctcttcttgatcacttggaaacccctggcacacgcccacctcaaggcccaggtcctgttttcctctgccccaaataccgttgcatcagatatttgcatggctcaattgttcattctcttcaagtctttcctcagatgtcccttttctcagggaggactttgatgggcacctcattgctttccctgatactctccgtcctcctgccttgcttccgttttctccaggcacttactaccattcaacattccctctgccttatttattcattgtctctctcctccatgctagaacataacctggcgaaggcagagatttctgtctcttttgttcgttgcttcatctccagtgtccaggactgtgcctgctatagaggaggccttcatccatgaagtgcttgaatagcacatgataaacgtgaaggaaagtgtgttttgaggcaaaagtgggattcgcaaaaaacaaaaaacaaacaaacaaaaaaatgcttctcatggtacttggaaacagggaccagataggagagacacttggattgtagacttgggaaccatctgcacagatagggtgaccattttttcccaggtttcctgggactctccctgttgttgcatgaaagaccagtgtcttgggaactcccttgctttcccagtgggacagctgtcaccctgtcctgcacacagaggacacacttagaggccttagagtttgcagaaggacagggctcacaaacccctgtgtcataggtgtgaggaagatggtacatgactgcaactgaactgcccatttgtgtgagactgcaagagacgagacttcttcaaaggaggtggttgctcctccactctgcctgccagtagctctagggaatcctagagtagtgttgtctgaggtcctgatttttcaaggggaaccagaaattttgatttctgtgatattttaacatttttaaatgttagcactatttggaaactgtctaaagtctgcatctggcctgtggcctgacatttggctgtctctgctgaagttccacacttccactttattaggagacaaagcctatgaacctcattctgagcatcaaatgaagcttgtagttattaattgtctttattatttggagaaaatactattatttagctgtaagtaaaggttttatgtagcttacatggaatactattgatatttgtgcagtattttcaggaactattctaagtactctatctgtattaataaatttaatcctccacgactctataaggtaagtactattaatgtcccagttaacagaaacggaaatggaagcatggctgaaattaaataacttgttcaaagtctcaggtgaggaggtgattgatctgggattccttcaaatcaacaggcaggttccagagactgtgctcgttacccacaggcttttcaaacttcactgagcatgagagtcacctgaacgccttgttagaatccatgttgccgctccacacccagagtttctgattcagtaggtctggggtagggcccaagaatttgcatttctaacaagttgctaggtgatgctgatgctgccttcctgggatcacagtttgagttctactgctcagaaccatccaaaggcctctgaagggacccaggatcatcggagagatcatacttgcatccactgaagctgtgtacgcacagttgatcactgcactcatatttaggtactctagtggtaacagtgtcatcggcacagatggccatgcacaaaggcaaaacatatttaaggggcataaagtaaaatgggctttatgtaaaatgaagcacttcctggacccctgtggtcttataccactgaactttttttttttccagctgaatactacaacccttgtatgtttccaaatatctggcagagaaggtagaactggccagggacatgagcaaacatggtgtgctggttggcataggatagatggaagctaggcaggtggtactgggcttctaccattggtaggctgtagcttgatttttagctacaaggatatgtttttaaaccatattgaattacatagaaagcatttccattttcctttcaggctttcttattacatcagtgagaaaatctcagtttggtgcgaatatgtctttaacacctaatacttgctaatctcttttttagcagagagattgagacacattataggggaagagagagagagggagagacggaggagatcatacaggacccagttacaacccttctgtagctttggtttgctagaattaaatagattattttgtatttattgtatttattttgatagttatgtgctatttatagaaaggaataccagttttccatgtatgaaataaagtgtccttttgttaacaaaaaagcatattaatttttatgcaaatgcatgaattaaagaaaaataaaggctcacaatactataccttagccataattccaaattctaaatgctctgaaaaacaaattaaaaaaaatgtttagggttacacatttgcatcaaaacttgacctgaattcacatgaaacttttttttcctgtatttatctttatgtgaatattcagacattttgctacaaaaatgtccacatgtttgactatggggtgctgcctcagaccactagaggtattatgtaataagggaatatgcaccatattactttcctaatcttgaaaactttcaactgtaaaatacatctggccctaaggttttggataaggaagagtgtggacctgctttaaatggcaaaatgcatgaaagtgatatacaaataactgaaatttggcagacactgatctaggaagaagagctgacattgaacatgagtctattaacacgagcagaacaaacataacacctaatagggcttcccagcttttgcttgttgtaaacagctggcagtggttacatctatatttgttaagaggcagagcactgtattttgtgtaagataaggtgctagtcttggccaggctgccaagcctgggcttttaaaataaaagttttaaagaaaaattatagcataataaattacacaattttattggaaaactgaaggtgttcaaccaatgctagtttttaaatatatttagaaatactatttcaggaaattttaactacactcattagtcttatggatctgatttttatgtttggattttatatacccatatttcataaaattagatatatgggacatgtcatatctgcatccatacttcagtttccttcagccattggggcattgtatttgtagctcatctactactatttcttctccttcttcttcttcttttttttttttttttgtttttgagacagagtcttgctctgtcacgcaggctggagtgcagtggtgtgaccagtgctcactgtgctcaccgcagccttgacctcccaggctcaagcaatcctcccacctcaacctcttgagtagctgggactgtggatgcgtgccaccctgctcatctaattttttaattttttttttgtagagataagctctcaatacattgcccaagttggtcttgaactcccaggcccaagagctcctgctgtgttggcctcccaaagtgctgggattacaggtgtgagcgactgcgcccagcccattctactacttcttgcttggtaagaagtgatgtcttctcagtgtgacaaatagctgattgcccaaccatgttgttttttttttcgtctgctcagctaggatgcatttctctcactgaaccccatccagcagaggacagaagagtcagaagagggtagagaggatttagatactcatagaagatgtagtggaggatgaagtgccaacctcgctcgggagccaggcgcattgaggagagacttcattacctgataactacctatctgaaagtaagacctaatcttctggtgaggtttctaatggatctggacaggctaaccagatagtgtcttttatcagtttgtctgatgaatgcactaacccttacatttctagtttaagaataagatgaaagtggttgggaataatgaggtgtagattcaaatataacatgcatgagtgaatgtcagtttcagtggctttaaacaatttgtggcccccgcagtatttgtagataactgaagacggattagcccatccatctgtctggtgcatttagcgctagaacaggttggttctacatgcctcgcatgataccatttccctttgatcttcctggcaatagttgtcttgtgagtcgtccttactatgaggaaggatttcctgatacctgacattttgctacctgtatcttctaacagcctctaaatccaggctcattaatcattgccattggtgtttacactcaagtgtagattttggttggaaaaaattgaaatgatttgctcaaccacaggatattaatgattattgaaatacgattcaaatcagaaacatatccagctacagaagagaatgggaaagcagttcattgatcatcaggcttgtaatctgtgaaaactatatccagcaaagtggttgttctttttatttatattactcaaatgaacattaaactcaacaattccaaattactatgaggtattcttcatctctgttccatacagtgttgcattttatcaagataatgtagatatttaagaaatacattgctgacaattcttgtaaatattagaattctgtatgagaatattgatattaaagctgtactaggatggataccattagcaacaatatagagaagacgttttattaaatactaatttcatatgttatttaacaagtagccggctttgaacgcattaatctctctttttaattcaaggttgatggtctgggtcttacatattgtatccctgaataggccattcaataactatgcaaaatatctatttctcccatgggtatttgtgctttgatatattctgatccttattaaatttaaacaggatcaaatttatacagctctggcagagatttattaaaatacactgaatgggcagcttgtgggagtgcagtgtactgtaataacatatgccttttaccagagaatagtaattattgagaatcaaataaatctgtaggaggttaagtatatacggaaaagatatcaatttcagttcttcaaaactggcctgaaatattattaggagatgtgttactgtgcaaaataatgaatctcatctttttagactctaaatatttagcaatatttgaaaaatgcagatcttatgcgggatgtttcaaattccaaaaggggagggggtggttcaacattatcagaagtgttacatgtatttagtatactccatctgtagaggcacctgtttttcactttgccctactttttattagataaaattgaaagcacttatattatcctgttggtaaaatatactttgtttttagaagcaaaaatctgtgtctctttcggtcagaggtttgggagagagatcagagatggactaaatagaaacgtttttgatacttttaaactggtttatattttaaaagtattattttgttcttaatttggtgttttcctccatactttcagagtgaccttggtgtgtttaatctgatcagattgcaatagttccaatggattggtcttctgggtggggcatcactgcagagggcagctaggatttttaatactcaatgtgtaggtaagatgcatgtagtctacctattctttcagagctctcatgactctgatattttatccttcataaattatttaattatgttataatcatcattagtgcttttctcttctcctacttatagacacccttgagggtgggctggggcaccaccaagaagagagccatctgtatgacaagagaatactttgccccaacaaaccatcctggcttcccaataccttcttttccttccagtatttgaatctctttctctgcctaatcctttctagtatagaggcagaggcacaggtggaggtggcgcacccttctttcctggtcaaagttgtatgaatgtcaagtgaaggctctgggaaccacgggaatctttgagtggtggtatctagaggaagtgaattaggaagtgaattaggatactctctgaaattcccccaattcttaaattcgattgaatgttggtaaatgatagttatggcagggggcaggaaatctgtttctgccatgtattatggtagctcccctaatttttgtactcatttcttaacatattgtgtatgtgtgtagattttataggagaatcactgtttatgcatactttatagtgttttcttgggtcatggttaatatttgagtgtccatgatgttctaggtaagtctctgtaggaattatttttaggtgtcatggtataacagagttttggtttttttggtcggggagtcagatatgttacatacaataaaatctgccaattttaaatgtgctattggtaagttttgacaaacatgtacagttgtgaacaaccaccacataataaatatagaacatttccatcaccacaagtttccttgtacccctttgcagttaatcccctacccccagccactgatctgctcttctgttcacatgatgtgtatgatatgcatattcatttatatcaactaagttaaaccaataagtacataaatgtttagatatatcatattgataaacctttatgggtagcatatatctgatttttttcaatctttcattccattttgctcacatgaagtcattatcagtagaataaggaaatgtcagaaatctggagtttgagcaaaaaatgtatattttagtgaaaaagatttttaaatgcctccaattattggctacttagaaagtaagtatacttggctctgttgccaacttttctccttcattgctgctgatgaatgagacagatttttctaaatgcatgtaactgatgaatccagttccctttctcttgcaattaaaagttttcatttatgtgtctatctgtatattgggaaatctttgtaatttttcttttatagtgcttgttagatctataggacaatatagacctagtttctgaaatttgaaaatggataaaaaatattaaatgcaatgatttttaaaatctaatgtcttaatgttaatctttgattgattttcttaggtattaatattcattaccatttggataactgtgaaatttgaaagtgattttacaataccaacactttggaccagatgaactccaatattccttcagttctgtaatatgtgattgattctttgaggatttttttaaaacaagtatatgtgtgtgtatttgatttatatgtacagattcagatacacacacacacacacacacaagcacacatttcaaatgggaaagaaaagagaaaaaagtaattgtgctgtttatattttcaagttagcatttcagaagattgattataaagataaaataatttgtacactttttggatgttgattaatgctagtgcaaatagtggagaaaatagaaagctaatatagtttgctatagatatccttaaaaggaaaaaggaagtaaagaaacgaaaagaaggaatttagcttatgccattcttctgttttacctgcttctaatttagagtaacatgatcactggcttcataaattcaaagctcttaaatcgtttgcagtaacaagagcatgttccagtgttctcagaacttttgtttgcacctggtgttacacttgatcactgaataattgagtgataatgactgttatttttaaactaaagcgtaacatcaggagaggatggtaaacacaaaccgcccagcttcccaaagctggtagggaaaatatttctaagtgtcaaagcatgatagaattgttgaaagtacatgcagccagctatgtaacctcagaaaataagacatggaatgatttgttctgcagcttaaaaattatactttttagtttcatggagatggaaagttcaaacaaagaaaaactagtagaatttgaacaccatgagctagggttaggaaaccatactatctggccaaacagttattcaggaccaaggacaaggccataggcatgcctctccccacttaattttttcttttttctttctttttctttttctttttttttttttaacattcatagctatacttttaagttattcatttgcttaatttattcactcagaaattaaattacatattgagtatcaaataggtaatgtgacaaaacaagacagactcgagctctgttttcatgggacttatattctcttgggtcctttttttttttttttttttttttttttgagatggagtctcgctctgtggtccaggatggagtgcagtggctgtcatcttggctcactgcaacctccacctcccgggttcatgccattctcctgcctcaacctcccaagtagctgggactacaggtgcctgccaccatgcccggctgattttttatattggtggtagagacgaggtttcaccatgttaaccaggatggtcttgatctcctgatctcgtgatccacccgccttggcctcccaaagtgctgggattacaggcctaagccaccgcacctggccctgggtccttttatagttagctgttatattctgtttttcttcttctggggctctgctcttccttcaaggtaattcctgtctcccacataaatagctcttcttagattcttgacctactgatcttcttccaatatactcatcctcccatagccttcacaagcctttcggctctattgaacttgccaaaatgttcttatctcagcttttacagccatacagagaaaacaatacctatttttctcatttcttaaatggcttcttttcagtgtgttatatgaatggtttagtggttaggcatcagttgggctcaaaactcataatgtgaagttaaatttgtaagcattggcttatgattcatggttgacatgatattcagaatacaagggaagaagggcaatattgaaacaaaaaagtgtctatttaggccccaataatttggaatttgttaaacttgtatgtttgggtggccgtctgataagtggagcaacatggatgtggagcctagtaagccaggatttgactccattatttagctccatgtctttgtttacagtattctgattcccttagaaataaggagatagtaatacctacctcaagttcattgccaggcctaatgcatataaaacgtcaagaaaaatatatgtaaatctcttgctctcccttttctgcagtggtcaatgacttttaatgaatgaaacccagaatacttctttctgtacaaatatttagagtttaacttttccaagccaaggtttctgtcaaatagaaacatactttcaaattatgctagacatcttgatctttccattatggttgagaaacttttatataaatggtttaatacaggcctcccattattatttcttgaacttctaattgaagaataacatatataaaatgcacaaatcataagtctacagttttaaattcacaatcactaggtatttttatttttaatgagtcaaataagcagtgaacatccccttattttaaaagtttgacattttagacttttcagttttagattggcctatctcaattgtaagtcactctgcttttattcagtagaggtttagctttagatctcaagggggagcaacacagaaaaatcaggtcacttttactttggaaagcaaactaacatttactcagcccttataggattgtaggtacgctgttaggaactatgcatatattatcccatgttaactataggagactttaggttttagtgtattttcaatttccatctcatctagatttctataattttaattcatgcctttacccttgtaacagttccagttgcatgaatatttgggaagcagaggcctagtcttagagatttctgtccattgaatacacaaagaggaaatgattatcatctttgtgatgaatataccatacatctccagttataacccaaatgtttctataacacagaagtaacattgtattacctgttgtttggaagatgatgccattaattgtgatagctctcagagggcatgagaagcattgaaccagttgccttttctacagcctatgcccttaatattgttctttgagtaaggttgtgatttattcagccttttgtgttggtgcctggacttcttttttcttaagctccccaaagagtcagttgctgtttgtttgcattatagctcttctttccttgtgttccaccgcagtggtatgcaacgtgacattatgtacttacatgtattttggcattggaaaaagaaatctgatcagcttttggatgtgaagaaaggtattatttattgttttcgcttacgttactcacaccgtgttctctagctctttccttcccctgcaagctcacatcttaacacttcttggcattcactttgtttaagccttcttttcttcttcttctttttttttaataacatgccagccacattcctaactcagagcttttccattgattctttcttctgcaaggaattctttccccagctctttgtaatgccagctccttgtcatttgtgtctcagctcaaaaatgtcacctcttctgagaagcctttcaaaagtatgctacccaccaagtcattttaagtgacatagtcttattttacttccttcatctaatattcttatttattgccatccacctttgcctgtccccagtcaccaagggcatggactttggcctcttttgtcactaactgcatcttaagcacatagaacgtgcctggcatgggatcatgaatatggcacttgttgcatgaatggatgtattgagcagcaactatgctctgagtaaatagaaaacagaggttcatgttggttggattatctctggagtcaagttctgggtaatagagcattttgggttggaatcattttgaacattcaatctgtcagcttcctagtttttcctttgaaacctcctggtacttggtcaactatttctggggcaaattttcatccctttgattcaggtaaaacaaaatccctttgattcaggtaaaacaaaatccatttgagccaatatttatgtgtctttaccagaatatgtcctgattttgagatagggtcataaaaagtaccttgctatcttcatgggcaaactatcttaaagatggacctgcaaatacagttgaacaaacataaaccacagggagagttcctcagacttaccctgggaggcagatatggcaggattgatcattcttaaagttgaggaataggcaacgtggtgcttgaacgtggaatttctgattccaagttctcttgccctctgtgttctgctcgttccctcaggagttctgaatgtgtccatttaggcatttcccatactgctttaagtattctttgaaattataaaggcaaacatgactttacattaaatattttttctccatgcactaaactttcaagtcattagaatataggctaacggttctcaaactacttgttttctgactcactcttcaaactattgctgccatctttcatggtatattcctacttttctggaactatttgggttagaattctctgcattcattctgtcctacaaacacacaaaaagaaaaatgctgattctttcctcataaagaagcacatacttcacaggagaaagagagtatcctaatctttaaatacttcaccatctatttttaggacatcttatagtcactcttctttggtattatgatacaaatgtgttttcagtaggccttaccttttcttctcctgccccgagatggagtcttgctctgttgtccagagctggagtgcaatggcacaatcttggcccactgcaacctccgcctcccaggtttaagcaattttcctgcctcagcctcccgagtagctgggattacaggcgcttgccaccacagccagctaatttttgtatttttagtagagacagggtttcaccatgttggccaggctggtctctaactcctgacctcgtgatccacccttctcggcctcccaaagtgctgggattacaggcatgagtcaccgtgcccagccagccttactgtttctctttgagtatcctggactctcagcttttatgggatgcacttgttctaattaattaaaattcatattgtcatgtcgatgctcagatggtcacagcatgacctgcgggagtccctttaaatgtcctctttggtccccttagcattacccccaggcattcttgaaagcactgttgttttctgggaaccacaagttccagtggatcttgattttctcatgacccaatacatggagtcagctattctctgaggagctctgattcctttgatagagcatagtggcatccaaaatttaggtgctctgcatgatatcaagctgttccattcaaatgcttctggaaggtagaaatgattccccagttagttcattttagggagagagccagaagacaaattttctttttcttcttcttcttcttctttttttttttttttttttttgagacagggtccttctctgtctgtttcccaggctggagtgcagtggtcccatctcggctcactgcaacctccacctcccaggttcaagcggttctcctgcctcagcgccccaagcagctgggactgcaggcatgtaccaccatgcccagctaatttttgtatttttagtagagatgggatttcaccatgttggccaggctggtctcaaacttctgacctcaagtgatctgcctgccttggcctcccaaagtgctgggattacaggcgtgagccaccgcagttggccaagacaaattttctttaaggtcatgagtttaaacagctatttccaatttaaatccagcattactaaatccatttttattttgttctaatgtaaatttttagtatctatttctgctcaacatacttactctagatttgtaagaccctggtcccaaatattactttgattcatttctctaatcattatgtcttgtctatcactttattttaatcactttattgacaaacaaatattttgagattattcatgcctagtctaagagaaaggggaaaaaaacaaaacaccttgccttttatcttgtaagtagtggcatttttttttttttttttaacagcaaggcttatatcattgttctttcccttggaaatgcaacagatattttttgaggtatcagaggcgagggcagatttccagggaatgaaagaatagagctgatcttgtacttagaaaccccctcctcattattaccagcagcaaatatctctggtttctggtaggggcaggactgaggggccttttagactcatctcttgaataccatgacttgccattattgtaccggcctgagaaccactgctctcggtcttagactttgaacttgataattcaaatctaaaggttaattacattaatgaaactactaatatcaatcattatgtttaataagttggtatgctgtaagcctgtttgttttaaccaatacctagcaatgaatgtgtttatatgtatttaaacattatgcctgtttgtgtgtgcacatgtacatacataagcatacacattaggccacattgcatcatctggaggaattgtgagtgggcgtgtgtgattggcaagtgtgaaattgaatttaatatgagattctctgtcttaggtaaaatatttgaaagaacgtggatagagaaaagctgtctagctttggaaaaaatggcttatgtgttttgggagcaagaggtctgaatgttaaaatttcatttaaatggcaaaacacttttagaactatgctgaagaatttggttttagtgggaaaactttaatttgcctataacatgaagtacaagttattaattgcaccaaagataacatgctaattaaaaggttcatgcataattgtcagaggttaacagtgcacactgacagacttggaatagaaactaattatattatgttctctaaaaggagtatttttacccatgaatgtaagataccttattatagcactgttttttcttaggttggaaaaaaatcttttagatgttctttgtaatgaggctgcaatgataagcattcaaacaatgatgaagctatatataaatagctttatttgaaacatgagcttccagtatagttataattccaaataagcatttatttgtatttgcaacttagaagaaagacactcaaagtagaaacttcctaaaatttatcttcctggggtaataaataataaatgaataataaagcaaccaggatttctggaaatagtctaatgttcctttttgagatactttatgaataacaatcatcttttgattggcagtatgctagagatttgggcttgtacacttttttattgcattttatacctctgaattgttttatatctataatacataatatatagctatacatgtgaatttaaattatgagcatgtttaaataatagtaataaaatgatcacctatttgtctaacatccaactttgttgaaagttatcaataattttgaagttctctctgtgcgcttctcagttgcaactccctcccttcctgcccccagagatagtcactttcctgaattttacatttattattcccttgttttttctttatataaaattttaccatacatctctttatcccctaataatatattgcttagttgtacatattcctggtttctttataagtggaatgatgttatatattttattttctgacttgcttttccccgcttcaatattagttttgtaatattcttctaagtggatgcaggtgtctttcttttggtttgccactgtacagtattccatggtctgagtatactccctctggacatttgattttttaccagtgctttgctatcatgggcgggtcctgcaaacacccttgtgtatgcacgctgttgcacatgtgcaagaattgttctcatgtctttacttgggagaggaactcatgggttttagggaatgctcttgacttggcaacgttgaattattttccagaatggttgtatgaatttaatacttacacccagaatgtatctgcattatacatttcctccaaatcagccttcataataatgtcttcagatatttgtatgtttaattgactctccaattaaacaaaggaaacattttcttatacaatggaaacttacaggtgtcctgctatgatagcgtatttctttgcttacagtgcttagtcaaaactgctcgatattttggatcaaatattaaacatcttcagtaagaaacctcaagctcatttataatattgttatagttgtgcaaacatcacagcttaaattgtaatatagttcagtcatctgatttaccttcactccttcctgggaattctgttgcctaacatgatttgaagccattatttactttcaaataatgtaatctagaaattctaaaaaagaaagaaaaactagtattaggcttagtaaaatgtaattaagatcatagacacactgtaaaaattatctgatgtatttcacttctcagtatctgacttctggattacctggtatcttggattattcatggtattcctttgctctattaatatgaaaataattgattatgtatctttttttaaaaaaggtttttgaagcaatattgcttatttgtgacttattttgcttaccaagctgtgtgcatacaattgagtatgttgaagtaaagatttcagttacctcctttaaggtttgccttcctatacgtaatcacagaagcactcctgatgacaaagaaggcagagaacttatattctttaagtcacgtagcctgcagcagttctttaaagcctctagtttcattttttaatgcaaagatgtttttgtgtgtgtggagatggggtctcactctcactgtgtttctcagtcctgtcttggacttctgacctcaagcaattctgccttggcctaccaaaatggtgggattacaggcatgagccactaccctctggcattaacaattttgataatttcttttacacaggatctccttgtttgctgtgatacaaaacagccccctcctttattttgtcatggctccctttctatccccattctttgaatcaattgttaatctgagacacgatccagttcattctgtaactctggaaacttctaagatgtaggtcttaggtgtacatgtaccccagttgagaagtgaagtgccgaacattttaacattacatgtgaactctatgggtctcttcactttcagagtccatcactgttttgttgtcagctttgaactgtttgagcagaattcagatttctatgggcaactctaatcagggtttccagctacttaaatccattaaccttcaagataaccttttttgggaatttgacacaaacaatactacataataaatactagtgcttcttagatgcagtggatgttggacattctaaggagagtcagagctctaattaggagattgttaacatgtgattcaatcatgtttttaaatctttaatgtaattataggtgatatctcattgttggaggcctctccaataattccccaccccagcataagtgtcctcttatctgcacccttcctgtagcctctaaagagtctgaatcactttataaacctgaccaataagcttgtggttatgaacaatttatggtagggggctggcttccatgactctgtgggttctattcctgtctagaaaccccccttctttaaaagaagggccaagaatccaggaggttcttgggttgtgcatgccagttctttcatagagtctccaatctgtctccaatccaatctgatacattgcttggtgggttgggttgagatgaagacattggttgactctgtgttgatttctcacctttgagagatggtttaccttctcgttctatcctctttcttcaccttggacttgcttccatcagttgggggaaaatgctcctttttatctgtcttttgatagctagacctttggacatgtgtataaagagtatgagcattttgctgtgtttcaggcatcagcctagtgaggcttaaacctgagaggtgctttgtgcattggttttagtgtgagaagacttttaattgcagtgctcccaaaatattggatgtgtataaaatagccttagcatttaacacgacggctcttgtcctacaatgattgcagttttcaccaggaatgtcagttcagggctaagttcataaaattcatcattgaattttcagataggtttagataaaaattaagactttccgagaaattcttttctttttttgagacagggtcttgctctgtcacccaggctggagtgcagtggtgtgatcatggctcactacagccgccatctcttgggctcaatcaatcctcccacctcagcctcctgggtagctgggactacaggcatgtgccaccatgcccagctgatttttatattttttgtaggacggggtctccctatgttgcccaggctggtcttgaactgctgggcttaagtgatctgcctgcctcgatctcccaaagtgctgggatcacagacatgagctactgtacccagccttctagagattcctaattcttattgtgacataaaattattaattagttgaatgtgattttgacattttgtagtttttggaacttggggcttatccatgaggccattctctggaagccaaagcagttagtgatttttgtggcaaaatccagtcacgagcttcatgaaaacccaatctagtgatattgcctagcatcatctgtaattattcctatgcttccgaattgtcaatcagtttgtttaatgcttagtttggtgactctggcattcagagtttattatagctaaagaaacaagcaaacaagtaatcccgctgaagaaatggattaaccagatgattatttttattggaatgagaagttaacaaaattagagctattggtggcacaaattaatcactatgtgattcgatttgattgcgttgattcttaactgcattgatgactaacaagagagtagtgaaatgagaaggttcagggaatcctagccaggccttttccttcctatgcagttctctctttaacggatcttcctatcttgcttctttaaaagaccctcttcttggccgggtgcggtggttcacgcctgtaatcccagcactttgtggggccaagatgagcagagcatttgaggtcaggagttcaagaccagcctggccaacatggtgaaacccgtctctactaaaaatacaaaaattagccgggcgtggtggcgcgggcctgaaatcccagctacttgggtggctgaggcaggagaatcgcttgaacccgggaggcagaggttgcagtgagccaagatcatgccactgcactccagcctgggcaacagagcaagactctatctcaaacaaacaaacaaacaaacaaacaaaaagaccctcttctttaaatatatctccagtgactgccattccattggacttctttcatctccactcaccacttcctgagatcgagtcccttgccttgccttgccttgcctttctgtctcattgatcctttacttgtccatcccataagcccctaaaagcctccgttaccccatccatgaaacaaacgccatttcttccatcctttaagtctcatctctgctttgaaatgtcacgtgagctggagggtgggcatgactgtggtctctaactaatgtgtgtatgtgggaagttgtgtgcacatagacatttctcatttctcttcattttagagtgtgaacttcttttttttttttttttttgagacggagtctcgctctatcacctaggctggagtgcagtgacacgatctcggctcactgcaagctccgcctcctgggttcacgccattctcctgcctcagcctcctgagtagctggaacgacaggtgcccaccaccacgcctggctaatttttttgtatttttagtagagacggggtttcaccgtcttagccaggatggtctcgatctcctgacctagtgatccgcctgcctcagccacccaaagtgctgggattataggtgtgagccaccgcgcctggccttttagagtgtgaacttcttatgggaaaatacttggctttgttatcctctcccaacacagaaattgttgctcaactaggaacggctggcatatgctaccctcatattaaattttgctaaaagaaactacttaatccctggattatgatgtcctattatttattaaatatctcatctcatgctgtagtgaatatgaaagtgatgattcttttggagaacaaataccagagtatgacaattggattttacaaacaatgataaagcggacttcggaatgatgtatttatttaatgtatttatttaaattatcgacatgaggtacatagattatatgatacatttattcttggaagtattattttataacattgaaactgattaatttacaacatgtatgttgttaccataaacacattctttggttcaaataaagtcttaaaataacagctctttaaaaaaaatttattgcttatttttggaagttggagaataacaagttctatagaattttccctggaaaacctgtcagtacagcttaaatattaattatggttctgattgcctttcctttttgtaaagcattaaaaaactcaggttatactttagcttggaaaccaaggtaaaattttgccattgccctccctcctttcatttgctcattcattcacatccttatgctggcgttatgctgggtgtttttatagtatcattaatgataagctagaagaaagttgatagcaattgctataataaggtaggtacagggttatccataactatgctaagtgctgtatgcatgttcacttgtgtggtccttgcagtgagtgaccctatgaggtgagggctgtcagcatcttaattttacaagtgaggaaactaacacctagagatggcaggtcagtttcccaaagtcacacagcagtcctggaacccagtcctatttgacttcatagcccaaggcttgctctttattctgtattttaatacttcccaaatcactttcataaaaacataattttcatgatggaaagaccctaaaaaacatcatcttttaaaaaaaggtagatactaataataatttaaaccaagtttcagcaaattaccacccatgggccagttgcctgtttttattaataaaatgttattggaacacagtcatactcatttgtttatgtattgtctgtcttctgtggttgctttcctgcttttcgtgtagttgcaacaggggtgatatagtttgtatagttgcagtgtgtctgtggatgacccatagagcttaaaagcttgactatctggtactttaagaaaaaagttttttgaccccaatttaaagtacattgcattgtcattgttaggattattctagcaaaccaatgctatacttaatgcaagaagcaatattatttggtagtgttttaaaatttctagaaactgcattacctgggttcattgctctttaggatatcatggaattcttatgttggtgtcaaaaatttgtaatattaaaaaatacttcctctgctttctcagttttgttaaaaattgtatttcagagaactttctggcattcttcattttgatgacaaagtaatttatttggttgaacttcaatgctaatattttctttaagaccttactgctttttattaaaaatggcaacctggatcaatggtaattttccttttttgctattgaattagtttctcaatctgtgctttttttgttgaatatggatttttagattttgaccgaaaattatttccctttcttgaagacccattcttgtaggtttgacttgcataatatttatttctgcttgtcttgctggaaactggctttctggctaacatatgaggacagacattttagaaatggaaactaaacttgaagcatggaaaagtgtggcttttttccatccatgttagattttcctcctatttttcattttgaaatcttgttcctgaatggccatagcttttatttttgtgttcctggtgctgcatacagcctggcaaatagtaggcactcaggaagtgcttagctgtttgtcttacagtgcctacaggcttggaaggaacttttaggaaagaatggagttgcagtgtgtcagaaaactgtgtattactaagccacctgggaaatcgcggccactttttccctcattggcatggctcaagttttacttgcggaggcagggaggtatttaaagtacaggaaactgtgttaccctccttctctattctgttgctgccttcctgcaggtaattgggaatggtgagaagggtccatcttagcccaccccaggagggaaggcagaaggaactttacttgttgacatggttgtctcttacagaccattctcgatagggaggcttcttaaaaggaatctgtttacattagtgggttaaggcagtactttcactagtataatccacatagctcagggagtgagcattaaggttggagaagaaaatattagtaattctctctctgtttttttttttgtttgtttgtttgtttgtttttgagatagagtcttgctttgtcacccaggctggagtgcagtggcgcggtgtcgactcactgaaacctccgcctcctgggttcaagcgattctcctgcttcagcctccctagtagctgggatcaccaccatgcccggctaatttttgtatttttagtagacagggtttcaccatgttggccaggctggtctcgaactcctggcctcaggtgatccgcccgcctcagcctcccaaagtgctgggattacaggcatgagccaccacgctcagccatctctatatttttattcatcatttttaattataatttttggtatgttctgaaatacacataatacatcaggatggtggtaactgtgtatatagtttatgaataaataaacaaacctgcatatgttgcaattgggtgcccatgttattaaagagacagtatagtggctcagagtgtagacttggaggcctgtttgtctgcatcatcatcatgtaggcttggccaaagtcctgtttgttcctctgtagaatgggtacagtgattgtacctgtatcataggctgttgtgaggaattaatgagttaacatatggaaagtgctttaaactgtacttggcacatggcaagttatatgtaagtgttaattggtattatttatatgaaaatctttagtagaggtgtctagtaaaaaataattggagactacttatttagcacttaagacttcagactcacacagttgttagttcaagtccagactttcttgtgtgtaactgtggacaagttagctataaatgggcatggtaataatagtagcatattttactgacttaggcacacatatttttcacattttaacatgtctgtagttagattatatcttataatcaatggtgtcttagattttatgaaatatgatagtttctactttctaaggttgtgaggaagaaataagacgataaatgggaagtggttagcataatgcctagaatatagatggtgtttaataaatgttaactgttataattaagatatattggcatatgcattattctaagagggaaatgagaatgcaaaatgcagtgacaatagttggaaggtcttgatcagcctttgatatctagtaggattatagattttcacctttacaactcttggaatacttctgtggtacccagcttgggaaatatggccaccttttaatattctccaaaaaccctgtgaaacactgccatgtgatattattgcttcatatgatcgaatgccgattaactggtacccatagtcctcaattaacaaggtattttttgattagaagtctgtgccaggagttaaggcctaggctaagatgatgtgcatgggttgtacctgttttatttacatactctttggtttttgctccaatcatagtgctgcatcctctaataacctaaatgtttaaaacacatgagaaggaagcatacagatatagagtaacatttgatgcgatgtgacttcctttacagactaaacattaatacgtttttaagaatctcttaaatatagcagaatctcttctgtttggaggagaaaaccatgataagcattttcatttccagtatcagagctccctgtctctgcagagatggaaaacttctggccaacataaacatatctcttgttacattggatcagaagcagaaatttgtagttgtcactttgtagccagcgacccttgtgttcaggccaaagattggtgcttgtcatggttttctgctcttctcagattgtacactctcagaacctgatggagaagtgacttggaaagagcttttataaagagctttgcatcctttccttgtacctagggtggctggaaagttgttcagcagcttctgtgttcaccctctgcctgcctaggcaggtatgtgtttgaagccatagggaaaacatattttcagctcagtagaaccatggcgtccaggtgagagtatgctggggtgggtcttagatctttccggactcctgtggaggacactggtttagaaataatcacaactggttttagcatccttgttatttagggtgagagccatgtctaaaaaaagtcctttgacctcaggcaattttgtttcttgtggattcgtagaatcaatctggttctaagaatctgattcctgaagtgatagattcttcatactttccctagcatcatctcatttatgttttgtttgtttgtttgtcttgtatttattttatgaatcagtgaatcttgccttaatactatactcaaacacagctttagttaacgttttgagtatctggaacacttgccacgaagaaaaacaaaagaaaacctcttgaataatttgcaaggactgggttttgcatgtcgtttcgaagtaaatgctgcctggcttcatttgagcagctgtctgcattgctaaggctctggtgtggagcacctaattcccttctgttgcttactggctttctaatttttcccctgtgatcatagttataaaacctaatttccagggggtcttgtgaatcatattagtagctttgtgttataatagcaattttatattgcattggtattcattttcactattacggaataatcaaatcagcacctctcttattatgccgttgaaatagaaaataatgggactgtaatgtaaaactgctaatgtgatgaaactcgctcattgtgttagggtaagaatgttctcctttcttgttccagctcacttgaaactgtgattgaggaaggaaatggaaagcatttctacatctgtgataaggccccgcgtacatccttcatttgaatacgtaattgtctttcgatggcgcagggtgtgcttgttcgcacactcggaggccttccctgccaccgtggcgatgcacggggaagcaggatatgcacggaccagttttatcctgtggtttcccttttaatcatgagttacactgaatgtctctttgtttccagaggacttgtttgcaccctttcttgctcatggaggccttcttctggccttttttaaaacttgaagggcacattttgactacgttgttagaaaatacagcctcccccccccaaccccacaaaggttcagatttgacagggatgttgggaggcaggtcaagtgactgcctaatgaagatgaatgaagaaaattgctggtaccaggatcatgcgggggctcccagcccagtttgctgcaagtgtgatggaatctcatcgcttcatttatcagtgtcatatttgggctaaaagtgagcagtattgttctcatttttcccagatggataggtcaactttaatatttattgctcttatataacatttgtttgatgtatttccattagctaggcaataatagaaaagcggtggagagaaacataaaacagttcccttcctattcagttgaaatacagtgtacactaatgtataactacggcttgaagtgccattgattttctccccttttggttgatgacatgattgtatatattaaagattcccatgaaaataatggagaggcagcgtgaatgtcatatacattgagagcagctggcggggtagaaattgtgttgtctttttatttttgtgatttggtcacataattggtgaatgtctcttggccgtatattaaattcttagcccaaaatcatattttagaatggggagtaatgtgcagtagatcgcatcatcctctgggttctacggtgaatctcaataaagctagaattttcttcccattatagagcaaattgttttcagttgctgaataatgttgattttttctttatatctttgcgggtgaaaaataccttgttatgaaaagtattttcccctatgttttgaatatattaaagatatggccctaaacattaaaaaaaacacaactggctctgtaaggacatctagctcctgagatattagttgatgatcacattttgcagtaatctgaacattgggctattattttgtactgtggaataaacctagctctttgtgaggtaggtgttgtcttaagtgcaaagcaaacatcctagccatatgtttctataatttaaattaatttggtacagtcatactgttaatctttagtgacttgttgattggcattttgcagacatatttctggaaggctcccaataccattttctgcagcctttctggcagtagcagagagcaacatttccacaaattggaatcttgtacagcactgggaagcaagccaagatttaaattagacaataacctctgctctgtatatagcttctattcttcagctgtaggcagagtgatttgtttaatacagtcagccctgtagcatataatagactgatatatgagtcactccttggcaatgtgtttcttaaatttatatagattgaacaactggttggtaatgtacttagttacagttgtacaaacaataactattagcagggctgaaacaggcctagaaaggctgcactgggctggtgtttgtgaggatcccgaagtattgctgattttcagaataattcccctttgaggctaagggagactctatttcataaacatgagtgtgcttttttagcaaagtagcaataaaagttttatgttacagttttctgtttctcattttctatttgcttaaaattgaattggggaacctaatttccttcaaaaattaaacttaacatccgtctacattaggggcaagataatttgattgcaggggttttgtttttgtttttaaacacttgctttttttttttaacaaataaataacataggtataaatatgtattttctgtttttttttccccaggttagactgccgtgggcactaactgttcatgggttgaaagaaatctttctgagcaacaaagatcttttcttaagggaaaagcttgtgctccaagttcagttcatgtttatttaaaagattaaaatcattagaccagatctcacttttttgtccaaaagaaaattgattttgcttcccataaaagtgggatctgaaagaggatattcaggaatacgcaaatagaggcaatgtcgaaatctgtttgtgcagctgaacaaagcaattctgtttttaccgctgaacatttacttagccttggtgtgaaaatttctgaacagaattgtcacctgtctttagaaagtacttcttttgtaaggcaaagaggatcattttgatctgaaatgttttaatgctttttctttttaaacttctgccaactggagcatttataaaataacgtaccctgtaaatattgaacaatacaaagacatctttcataacagtttatagtatgttgcgtgtgctcagtggaagccaggcagcagttagtggcaaatgatatgccaatcaaaaattattactgcaagtataacctggtataatgcagtatcttatctggaagtgtcaacttgatataagccaactctttgtcttttaaagttaagctcttgtttgccctcagttaattctgtctcccaaaggctcatttgaattgcataaaggataatctgcttgacagttttatacatttaagcaatcttgattatatggtattttacatgttttttaagctcccagttactattttatttggcttttaagtctttagttaggaaagaatgagagaaactgataggtagaatttgatactctttctgtgaacagcatttagtaaaactgatatagcacctctttttattgccccatggttcatgatggtaatatttgataattgttgatgatggggtggaggtgagagtaaattcttgtgagaataaacggaagaaaatgtagtagccaaatttcattatactgaaatagagatttatagatgatcttttcctccctctcaaccatgacttaatttggagaatttctagatgaattttgggtgaaattttaggatcaagtgcctagtggaagaatttggaggttgtatatgtgttaactgtactctggaaaggcatgagttgtgtgttaacaccgtggtggtagttaagagcataccatctggtattatacagactggcttcaaattctgcgtacaccacatgtgcatgtgctgtgtgattttaaaacaagacactaaacctctctgagagtctgcacctataaccagaggagaaagtaatactcccccaatagggttatgatcaaggtgaaatgtgctgaaatgccaataaatgctactgttattaaggtctgccttcccccacactttaggcctggtgagatttgaaaaagttggtccagagtggtagctttagtacttaccttcctttcactagcaaattatttgataatcattagtggagagtcacatggctgttctctatatcctgggacgaaatgaatttaattttgaagagaatataaggcatcagggaattgcattttggggaattaggaagctcttctgtttccaaaagcacgttctgggctcccaactcctttcaaagttttattatgatgtcttaaaggtaaaaggggttttgttacattgctttgtcaattgatgggcaacaattctgcaagtttagcaccagtattatcttgttttaaagataaggaaatgagaatgtagagaaggaccttataaagaacgtacctaaccccagcaagtggatgggatttgaaccgatgccgctttcacccacagcaggtagtaagcctgtttcaggagagtcacttctccatggaagatctcccctacctgtatggtactgagaattgtggtgtaaacaagccaattactagccatttgacataaactcatacctactggcctatgccacaggtagatggtttgtcaccaaagagcaaacaaactgaaaaaaacctctctcctctagaatcatataatcagattggtgaaataattttgcatctgatgtaagagtgctgagtcaatatttattgatggagaggctgaatgggcgatgtaaccaaatgcaagcgaatgtagtagaaacatcctcaaaatgttgagaggatgatcttgagtggaagtttttgttagagagatggatttaatcagagacttgaaggacaagaggggcacagagtaatctaacaaatgtagaactactgagatagccttaaaggatatggaaagtagaaataaataaataggatatggtggctcagttagaatatcgtaacagctgttaacacataaacccaccatgtataatgaggtaaatgtaatagaggtgtatttcctgttcaagtattaagttcaaggttgttctggtaggcagtggaggagggacccaggccggtggaggccttgccatcttgttttaggttttaacacccagttggggtggaacgggacatagagaaggtggagaagccacacctgctcagctgctttggccccaaagtgagacacatccttctgctcacattgcactagtaagagctaaattgcctgccccccaacccgcatcaaaatgcaagggagttggaaacagcccataatgatttatgatggtaagaggagcatgactcttagaaaataattagcctagctgccacatatgacaagcagatttgtttgtcagtattagaagattctttggggagttggaagaagagataataaaattattattacagttgtgggtgaaagggttataggggagttttggattatcagtcagaaaatatctgttctcctaagatatgaaattcaagcctttcaatattggtgaagataaatgtttaaagagcatgtgcccacagggagaattatcaacagtggaaaagcatctgaagtattgacattgaatataaggagtgtggcagtgactgaagaactgtctgggtaattatgtgcttaaatgggtaggagtttgggaaataattaccacctttcctccaaatgaaaagggagactttgtaggaaaggtgggatttcaagaggtggaagcaaagactgtttagatgagaagccttgttctttaaactaggcggtgtttttaagatgattctgtgatggagtaggataaaaataagaagatatggaggacattttctggtgagaaaaaaggggctagggagaacaaacgagaatatttaggtttgtccaatatttataagcaatcttctccctttattcttgccagtaagtaattctcttcagatgatatttggcataaaatgtaccttattgctttgcatcaccttgtagtttatatatacatttattttttaacctctcctgggaattcaccattgccactttcattttatggtccaatttatggatacgctgaactcgattaaaaattgcactctcactttcccaaagagctggattctgagaggaagagggctgatatgtatgtggttatacgatgtgtgtgtaggtgtggctatgcatataggtatatgcgtgtccaaggtgaaagagttctcagtgttaccttacatgtctttctcacttgcaccttattctgtgaaagttccttgaaatactgctattgagatcctgttcccgttgccccagttataagtcaccgattccaggtgcctatttcttttgtaggactgtatagtcttttgcaggtatgaatattgactaagcacagggaagcttggttctgtccacttgctctgtgttcagtgaaagtacaaagtacatgtttgtttcacttgtaagtataaagggaaaaacccacctgttttgccttcagaaaaagtcttttgatctgactgttctcagaacgaaagctggagtgaactttttttttttttttgcagttgggttttctgatctaccttgtgcctctcatgaaaacacaattgggagttgaaagaatctactggtgaggaaaaaaaggaaggggcttttcatcatcctgcaaattagaagcaaagatagggtcttttttttcttttcttgtcatatctgataacacctggtaacatgtggagccctaactcagctgggaaaatgaagagtaacttaattttgattggccatctgtcttaggtctcagattcagtatatgaaaatttagtttctcatgaacattctacctgaaaggaaaaaattaaggaatatatatatatatatatatatatatatatttatatacaactaatatagtgttgtgttattggtcatttttcaaactaatatataatattatatatatatcatatattatatatataaattggtcatcatataatatataaatattggtcatttttcaaactaatatatatataatattcatgatgataatatttgataattgttgatgatgggatggaggtgagagtaaattctagtgagaataaatggaagaaaatgtaatatccaaatttcattatactgaaatagagatttatagatgatcttttcctccctctcaaccattatatatttatattgtataatatataatataaatatatataatatataatataaatatatatattagtttgaaaaatgaccaataacacagcactattaaaaagtttcccaaatattgacaaagtaattatgatgttagaattcattgtacagacccattttgagaaatagatttcacttacaaagacaggaacaactgaagaggaatgcttcagagtcagcctttgttgtgtcaaggggcctagtaaagctgttcagattggagtcctgcaaaagctcaatgcttcctactgctcctggcaatgtggtgtgtagccccgagcgcagcttcatctgtggccgtggtactttctttcatgagaggcaagaaaccatcagaaaaattagaacggaatattgaaacatactggcgtgtcatcttctcatctttgatgtgaaacccaaccaaaggaattctgcttcagttcccctctctaaggatggagataacactgtgaatgacctcagggggtcatttcttcatctatgcagaaaatacatatttagcatcaacagtgttccacatagtgtatccaatactgagaacaaaagagggagcaaaaagagatgtaattcctttgtgacatttccagtccatgggtaggacaagcagatcagtccaataattacccaaagacatgtaaaattgcaactctgatgatcaaacaaggttatacataccagcacatacttagcactcaatacatgtgagctcttgttagaaatattacacaataagtccttttctgctgacaaatctaaatgaaataaaacattactcccatttatttaacacagatttgaggagctgctgtgagtcttcagctgtgtggtaagattacatgtctactgggggcgctcacagcttaattaggaagaaagacaaagaaaccaatcatagtccagtgtgaaagggcttcagtgtaggggcaggaggaagaagagctcaccccattggatgttaacagaaaaggatccttctatgaaagggactggaagaaccaagaagaagagaaggattatgagagtagaggtgatgaggttggcaatggaggagaggagcagaaggaatagaagggaatgaggctatataaacaaagtgatgttgatttgtaaatggctttttccttcaatgaggaaaagagttttaattaggctgtgggtaactgtggaagtattttaaccctgacagtgacatgtatgatcagacttccatattggaagactaaccctattgaaaaccaattaggtaaattacgctttagccatgccttggcatactgtgttaaaaatcacatcttaggccaggtgtggtagcttacaactgtcatcctggcattttgggaggctgaggtgggtggatcgcttgagcccagaagtttgagaccagcctgggcaacatagagaaaccttgtctctacaaaaaataaaaaattagctgggtgtgatggtgtgcacctgtagtcccagctactcaggaggctgaggtgggaggattggttgagtccaggaagctaaggctgcagtaagccatgttcatgccactgcactccagcctgggtgacagagcaagaccctgtattaaaaaaaaaaaaaaaaaaaaattacatcctagaaggaaggtctcagtgaagaaaatgattacagaatacttttcaatttaaaaaatatactaaatatactttttggttcccccttgtgaagtgttcatcttgagagtggggtgagaaatgccttttgtgttagtcctcaggctttccagtattttccattattttaaacaatgcaatataaatgacaaatggaaataaagatgtattagtccattctcacactgctataaagaactacatgaggctgggtaatttatgaagaaaagaggtttaattgactcacagttccacaggcttaacaggaagcatgactgggaggcctcaggaaacttacaatcatggcagaaggcggaagggaagcaaggaccttcttcacatagtggcaggagagagggagagagtgaagggggaagtgccacacacttttacaccatcagatttcctgagaactcactcactatcatgagaacagcaagcgggaaatcttcccccatgatccagtcacctcctaccttggcatactgcgttaaaaaatcacatcatatgctgggcgcggtagcttacacctgtcatcaattcaacgtgagatttgggcagggacacaaatccaaaccatatcaaagggtaactccaggtgcagtgtggaggatgggtttgaagggaggaaattggcatctgaagattggttaggattgctggtaccattagaaagatatgcagtgatgtgaaagatgttggtgtggttggtgtagttgaatgaccacatgtggaggataagagagaatcaaaggtcgtggctttggaaaggaaatttaatagagtgattgatttctgggtgggagcatatctgagattggtaaagataagctctgtatttgatttgttgaatataagttggtagtaagtcatccaaggcaatattcagaaggagtaagaaatttgcaactcagtatagtgaaagatattcaaactggagagtgttcgtggttgatgcattgggacatgatgaattgttagaggatgtgttaagaagaagctgagaacctttccaggggataagaccactggcttagagtgactgtttccaaatgaaaataactctttccagagggtgatagctgaaaatgtcagaggagaaaaagtaatcatttgagacctagatactacgggggacatgtccatgggctttggagattagaagtccacagtagacttaatgatcacagcgcattaaatagaggaagacaaattgtaggaggcttaaaggtgaagggggacagatcacaatgtggagatggacacatagttagtgggtttaggggagggaggtacaagattaatttgagaggggctcagcagtgtttgctcccctaactctaagggtgaatgggactggaacattttgctaggaagaaacagtggagtgggaaaagatgaagaatcaaatgagaggtaaattgacagagccaaaccaaaccatggtggagtgggattcagaacacagatggaagaatatgttttgctgggcaaaggaaaaaaaagggatgatttgaagttctggtttggggtgatagttgcaaaagaactgcatacctcatggcctctgtttacccattgagggacaaagtccattagttgacaagtgggtgaggtttggtgctgaaagcttggcagagctgctgtggggaaatgggataggaaaagttacaggtgctgagtgcttggagaggctctgctgagtcagaaacctaacaataaaaaagctcatgcctattgggagagagacatttttgatgcttatgtctccaaggtatattaatcgtgtgtgtatctgtatgtctctctctgtgtgtatatctattccataatgagagctcagtacacatttgttgaataaatgagtcaatcatagatttgaggacaatttttttggtctacttcctagaacccaagtaaatataatgccaagatttgagtctttttcttgagtctgctttacttttttaacttttgttttccttctctatacttggtattgcctcttccactaaaaagaaagtttgtgcaagaagaaaaaattgcatccaaacacttcttgtgtcttttctatggataaagcattagaattgcagaaaagtcatggcaacaagatggtcattgcccttagaagcttccactgtagtgggcatgggggtggtgggatggagcagaggaagaattaaccattatcaacacaagctgtgtcataaaaagagatagaaaggaagagctctggacattccagagaaggaggtcagtaaatctggtagcttgagctgagcaaagttcctgcagtaggtgaggtggtttacacgggacactgatgaaagcatggaatttcagcagggggccactggctaggggcagggtgttttggaatggaggtggcaagaagagtttccaatggaagagaaagcctgaagttgggaaaatatggaatgtggtcaagaaataaaatatacataccaggatacataggcagagacatccatatgcagaaagcacagtgagttagttactcattgtcaagttttggcacttggaagtttccctttggcttacttaagataactgataggacctcagatgaaaggggaaaggattcaatatgggtcagtttcatttttttagacatatcagaattgtgggggaaaatttgcttttccctcttagtcattaaatatttgattccaaaaatcacagacttaaattcacattgctccacagacacaactgtcagtttcaaagggtcccaacatcaacatttatcaaaaccaaattatgttgaacaatggtttcaagttttgtcagaaatttctttaaattcccagttaatatttcatgtattaactttaactgcaaaccctcatctgattctcttgtttttaagaccttattgaaaagatacaggacaacagtagtttggggcttatacattttgttgtcctagagacaaaaacaatcctttaatcctgtttcttttagtagatgtcactttcttatgaacacattcagatactttcccctacttaaatgacgtgggtatataaaattggggatggaagtgtttctcgagcaatacatgtgtgtttagttttgaactgaccctcctttagagctgttagttcttgaagtgaaagcaatctacattactttctgatatatgacactccctagtagtgaaagggtattgaggaagcttatttttcttcattttgccaccattcatgatgaagggatgtctttttctttttctctttcttttttttttttccatctgactcagctgctctggtggttgttatggagaggattgtgggattagggggtgagcttggcgccatgcatggtcactaccagaagccaacagttttcgagttgtacaactgttgtcatcccatggtgaacaaggccttctcactaatcccaaaagatgcatcttctgctttattataagaaaatagtttttgtccatttgttccaaggatttccatttatgtaccattttggactctttatctacacagggataatttatatgctaggggcataatgcttattatttttccccttagaacaaagcaagatcatatggtggatggtcaccactttttttcttttaaaaattaattaattaattaaagatgtagaggctcgctttgttgctcaggctggagtgcagtggtacaatcatatcttaatacactctcaacttccagggctcaagtgatacccccgtctcagcctccagagtagctgggactacaggcgcgcactaccacactctgctaatttaaaatacattttttgtaaagacaggggtctcaatatgttgcccaggctggtctcgaactccagggctcagctgattctcctgcctaggtctcccaaagtgctgggattacaggcatgaggcactgcacccagcccacaatttctttatatctataattcttccttggccatagcaggccctcttactctcagccacttttccattctcccaccaaaactggagttgagtatttgaattttttttgatatggttctgtgtaggtacatgcatgttcgtcctgttttcacaactcctggagggcagctggtgccatccctcccttatacttcttctctgtgcttttgataaataccaaagtgtctttgatgtcattgaacccaacagatctatttcagcctcattgtacttcaagcttttgcagcattcaacattattaatcactttctctttagtgaagtcttctcttgatgtcagggatcccacccttgctaggcttcccttccacatcccttgctgccctttctcaggctcctttttgggatccgtgtcttggtcatcagacactggtgttcttcagggttctcctctaggcctcttctcatctcccttgggatgttctcccttcccagtctcactacggggggcctcattcattgaacaccagcacccatgtgtctcacaaagagtctcacatgaaaaggtcactgtattccagacttttctggtaaatgacagacatctcttggcacctcaaccccaacaatgtttaaaatgcacccgtgctttggcccactgctggaagactgattctgttcagcttcccctgtgttgatgaatggcattgccacatatccagttatgccagccccaaacctagaagcttccttgatggctcttctccctcacccctctcaattcatcatcaagtccagggaaaacactccaaaggaagttcctgggatccatccatgactcaactttccccatctttgctctcttctctccattaccatctggggtcatgctctcatcatctctcatctggtctgaggcacaattttcctaactgatctgccagtgctcactcttatttattctccatctatatgcttccttttttgttaattttattttattttagattcagggggtacatgtgcatgtttgttacatgggtatattcatgggtatattgcaacccaactggtcgggttggtcttctaatgtacctgttacccaaatagtgaacattgtacctgataggtaattctgcaaccttcatcaccccccaacgtccttttggagtccccagtgtctgccatttccattttttatgtccatgtgtacccattatttagctctcacttttaagtgacaatatgtggtatttggttttctgtttctgagttaagtttacttaggataatggcctccagctctatctatgttgctgcaaagaacatgatttcattctttttttatgactccatagtattccatgggagatatgtatatatatatatatatatatatatacacacacacatacacacacacacatgtatatacacacacacatatacacacacactacatatacacacgcatatatacatacatgtatatatacacacacatatacacacatatgtatacacacacatatatacatacatgtgtatatatatacacacacatacatgtatatatgtgtgtgtttgtgtgtgtgtatatatatatatatatttatctgacattttctttatccagttagctgcttatatgtacttaggttggttccatgactttgctattgtgaatagtgctgcaatgaacataacaagtatagatgtcatttttatgtcatgatttctttttctttgggtagatacccagttctgggattgctgggttgaatggtagctctatttttagttctttgagaaacctccatactgtttttcatagagattgaactaatttccattcccatcaatagctgtatccttcatggcataattcacaggagaagtctcacattcattcattttttcacttatatctgtagttatttgactgttatcttatttctctgcactgggctagatgctccatgaaggcatagattttttttttctaatgttttttcactaccttagcaaactttctggcacataggagttaatcagaatatatttgttgtaagaatgagtaaatgaatcaacagtaaaacttgattattgctgtttgttattttcagaatttatgtttatttacatgcttcatgccgatggagattaatgaaatccttcttgagcagtttcattataaataaatatatactttttttctgattgcagaactagtaggtcctaatgttaaaacacctggaaagcatagaaaagcaaaagaataaaagaattctgtcaaactggatatggttttgaatcatgtttttctgttataccatgactattttcctttgtcattcaaactgcttcagaattgtttaaaattaaattgacaaatttgagacacaaaacctttctagaatatttatctttgatgaatgaaaactcttggaaagactttgtttaaagaaatttccctaaagtattggagtccataaggtatgatgaactttaggctccttttaaaatatattacattttgtttagggtcaaaaatgttttctgcttcagtaactactgccagtttatgtaaccccatgttattatctagatattccatcattccaatttctcaaggctagtatgaggattccttggttagtattttttacaaagcaacattgtatatagttccagttaaccacattaagtgctaacttcaggttctaccactaggaattaaatatttctttgttaaggttacttttcttgtattaaaaatactgccctgtggctcctctcatgcctgtaatcccagcacttcgggaggctgaggtgggaggatcactgaggtcaggagtttgagaccagcctgaccaacatggtgaaaccctgtctctaataaaaatacaaaaattagccgggtgtggtggcaggcacctgtaatccaagctactcgggaggctgaggcaggagaatgacttgaacccaggaggcagaggttgaagtgagccgtgatcgcgccactgcactccagcctgggcgacagagcaagactctgtctcaaaaaaaaaaaaaaaaaaaaaaccaaactgccctgtctaatagaggaagcaactttaccattttacccaacggtgaatgggtaggcaacatgtaggtttcatctcagctcatttcacaaaggcacacgaagggagattataactgtacagtgctggaatgagttacgcccgtggtgttttcccagctctccccttctaggcaatgcaagagtcaagaactttgacttaatataatgtattttctgttttctctggagggtttatttttccttggggaattctgatcccttgtgtctagagctttcctttgatatgcacccttttattttcagttgtgcattaagatattcagtgtcaccactttacaatcttattaaagtcattaaaacatggaagtgaaacagtgtgggtgatgtgcgtcgttgttgaaggcgtggttttcctgggaggttttcttgggagggcatatttttggtctggagtatttagcacagtggaaaagggagtggcttatggctagtgccagatggacatccctcatggaatctgttacttatcccaggggccctattatacggggtttattttcaatattaatcttgatatgaaggcagctgcagttcttaaaaaaaaatcatacctctaacttatttttattatggccaaagaaatttatagattggctttatagatggattctactattcccctcagttattaaccagcactgtggaatgtgtagtaatttttcctgtgtgccatatatatttttccactagtagcgatgagaaaaataattcttttttgttaggaataaatggagtcagtgtgtatggtaatatgtacacttcgtataagagttgctgtgaataaggtgctaacattttactttaaaggtaagtagtgtgtcccccctccctttttttagcttctcaacaagaattttctctccaaatatgctgcatgtttaactgtggcatattcagagggttaataaatatttagatagtatatgtagtgtctttagcttaaaatgcaccctaactgatattcttttgtggttgttttaagaacttttacatctgtttttcctcccttttggtcacttttgcatttacaacttgatataatttgcctaaatacagttgagtcactcttttagaatttgatttttgctgaagtgagtaaaatttaatatatgatttaagaagagctacttacaaattgctgtataatcacatctttttaaatgtttgtaaggaaatgttaaggtaatcttaaatgtattagtatgcagtgactgtttgggatcccaagaataaaatgcctccattatttaggaatacttaaattcatggttattttatataaaatgctaaaataagttgtagctgaacgcccgattgaaatttacatcttgactgaattccattatttgtcttcaagatgaaagccagcaacccctactttgaagggattttattttatggttatgtttaagaaaccattagccacatactcaaactaatgaaaatataggtttagcaaaaacccttcttttaaaataaatataagatataaaatcttaagttacagattttggaatagttggttgggaggaatgtgatttctgtccttcctgccctaagacctcgtcggaagtgggatttagagtctcatgtgagctctttcctagtaaaagattttagataaacacaactggtaaaatacagagaactaatgatagctatatgatcacccatctggtaaaaagttgtccctacagaattccggcaatcataaaatcacagaaaaatgtatgtaatcaagatattcttgcagtgtgagcaaaagctctctgccactatgcagtaaaacattagccctgacatgtttctaaagccagactggtaccagtggtttcatagattcccataatttcttatcagctatcttagacttgctcttaaacaatgataaatgtgaattaagagacattaatagacctcagatgtaatcttgtttggcttaagtgattatatgttatatatgcttatgaacttcttatcattgatgatttgtgagttaagtaggctttaggtatttggtttatcaaatatgattaagactggaaaataaacacattcagtcccttataatacttaaggaagaatttataggtttattgatcttttaaaaatgttagccttaaaagaacacgttaaactatttctgtttcttggcttattctcagcaggaacaaaaaaagcaactgggtgtttatataaatggaaaacttcattgctgagaacctactagttgatatatatttgaaacacatttaagagaatctttaattgcagtcagtaatcttatagatatatccaaaggcaacacaatgccctcttgaagaaacaacacattgtatttggatagtgtagaagcaatgattctgtaatatttattgtaaaatacctcatctcgaatttatgtttaatgtatggattgatctatatcagagtttctcagtctctgttgatgctttggatagggcaggtctttgttgtgggaggccgccccgtgaattgtaggatgtttagtgacaccctggcctttatcccctggatgccagaagtcatgacaataaaaaaaaaaaactctcttcagacattatcaaaggtcccctgaggaataaaattgccccggcagagaatcactgatgtttatacctgtctgtttataactgtttatggctttatctgcatctgtgcattagcacattagtttttggcacctgaacatgattatggtttaagagcattatattttatactttagaaatcaaagaatggaagatagtataggaagtcattgatgttttggtggaattcacactaactcataattaaagggatttattgaaattagagagcacatgtttttactattggttagtgaaagtttggttactgaactaagggagttttgtaattcgttaaaaggttttcatttaaaaatactgaggaacattttatttaatttgttgttccttttttacatttgaagtttcatatggttgtgcaagaagtgatgcccaggagacttactcggggtgtccagtgtaaatatgtcatgtcattagaggcctgaaagtttgttttcagcagaaagtctctaaggtccttcattggattgcagcaagaactacgaagtctggcagtacaaggaaaataactcagattttatcttacatgactttttatttctattttgttttaaggcttgacagtactttggcaaccataataacagtggttcacctgaatttgatgtgggctgcatcatgtgcacagaaaaataaatggcttagtaacaagtgtctttaaccacattgaagctgccaagtgcaagcctccctggggttgatcctgaggccattgcattatcaattgagaacctatcgtgtgcctggccctggtgttgcaatggccaatgaggcattgcctctgcccccaaggactgtagcagggagacagacactgaaatgggatcattttaacacagtttagagcaatgcacaggttgccttggagcttaaaggaggagaatccagtccagctaggggaggggaaggtggtgccaaggaagccttttccaaagagttgttttctgagcatccttgaagatgatacccactgtgtgcatcagtagaactgcttattatgaacgaattcacactaaagtgcccatggcagatgagagctaagttgttattcctcccagcgatattgggatttataacaggtcacaaccctttctaaacccaagagaggatactgctagtaatagaagcttgcatgtcatatctttccatggagaaggggtcttttcaattctagcaacatcagagaaagtaaccaccttttccatctggactaatggattctctcagctgtcacttcagtgattctcacaaaaaccataacagactaagcacatctcttttgtaagttgctgtcattttataagagatgcccagtagtttgccaaatacaagagaagacacgcagaatagacattattcttaccttctgaaaattatgcctcaaattttatcttcagctgtcatggtctgatcttccttctcctttgtgcttagtttcttctctacctgcaaacattcgcaagtctccttttattcataagcatattcaagctaagcctcccctaagcacagtgtatacttgcaggctcctatatcagccttgtctctgtccttcctgcctagaatgcatacatcttcatttcttggtatgcaaggctcactttgatgacattaggtaggcctttgcccaagtagttttatctaccaaagtgcttttgtcttacaggtgagatcctacacatccttcaagaccccactccagtggctcctcttgtttgaaaacttatgctgactttcaagggggagtacttcaaatacctcctccacgtagtacctgtcatgaggagtcatatatgtcttttctattagagctgttcttgggtagaaactgggtcttattcacatttttagcctaatatttaccattgtatcttttatattgtaggcacttaataaatgttatacagaatgtttcaatgacccattcattttccccagatcattgaacttctgtcttcccaggcttctcacttccaactctgacatttatcaagtgcctctctgtatgacatcctttcttgggagtttgtgttgtctcccttcttcttgcaaagcccagtcccatatagttctatgctttcctccttagaagtgaggaaacagaagttcagagaggtaacatgaagcaacttacctgatgatacccagcttgtaagtggtagagctgggctatgaatttggatgtttctggctcactcattcacttatgcattcaacagaaacatactgagcagctcctgtgggccagatactcttccaaggaaacagcattgaactagacaaatggactgtctattctagaacggagagaaatagtgaatggacaaataaatccagtacattagtcagtgatgagtgactttgtatctctgatgagatataaaggaagagaatgggcaagagacaaggagggcacatggaggtccttttagctaagctgacctgggaggactccctgaggagtgaacattgagcagaaacctgcgtaaagtagggatagaagggagagtggcccaggcaagaacagcaagtgcaatgagtggcccagagaaagaactgaggaccaggcagtgcagtgtttctggagcttagtgggtggcagctgctctcttaggagggagtttggagaaggagccagcacccagatgatatagggacttgtagcccatggcaaggagtttgaattttactctaagtgtctttgggaagccattggatttctctaaatagtaaaattctcttgcactgtcatataagctatagcagtttgtaaaacagatatgcttggtctcttttggtttcttcaaaactcattgaaatgtcacctggccattagtatagatacaaaaggtggctttaagcctggcatggtggcacattcctgtaatccaagtgacttgggagacttaagtgggaggatcatttgagcctaggagtttgaggccacagtgagctatggtagcaccattgcactccatcctgggcaacagagcaagactctgtctcttaaaaaaattaaacatttctgaaaaagaaaaggtgacgttataatacttacccatttaatcctcaaaacccctgtgatgtggcaaatactgttcttatccctgttttattgatgggaaaattgaaacacatggagagtaaacagcttgtacacaatgacccctagcaagcttgtacacaatgacccctagcaagtagttcagctggaagctgaacttgttcttaaggcaagtaagacagcttgcctgccatcccacaactagtttggtgctaggattggaattcaaagttagtctgactcctgtaaagcgctttctgaattttgttctccctactgttgcctctgcccggtctagacactttcaacctcctgccagccttgaagtgttcttcactggtctccttggcaccagcctttcttaatactactcttgtgcatctcacactattgataagttcgggtgtgggctttacatctctctctctctgcctccttcctctaacaaaatcctttgtggacactcttatttaatatatttcaaaatatttaggttagccttcaaggcccaccagagcctggctttctaccatctcctccagctttcttccttttcttctgtagccaaattgctctctgctttgttctttgaacacagcctgtgtacaagtaggtctgaagcttcactcactccctcctttttgcctgggactctccctctgtctgccttctttcttggttaaagacttgttcctaactattgggtactatactcagtacctagatgatgggatcattcatatcccaaacctcagcatcatgcaatatacccatgtaacaaacatgtacatctactccctgaatctaaaataaaaggtgaaattatatattgaaaaaagacttgttcctctgaaaggccattcctttttgactcctcctcctagatttgcaagccacttgtcactgagttggcccttagcttgatatatttttttgtctcatcacccaaactgagttttcaccccttaaaatcaacagtcatatcttctacttctctgcatctgcagagaagtagataatatattccactaaatatatcctattaagtagcatttaatagggactcagttaagtgttggtaaggctttcaggcagaagggagggagacaaactggaattaacacaaaagatgtagtcacttcacaacatatgtgttaccattggatttttttgtgggtgtgtattcgaagagaaccagagatcagaggccttctcttcctgttctccgaatattggtgatgattggttgcttggccaatctcaaagatggccccatttttgctaaaaaaaaaagcaagaaaaaacttcccaaaacaaaacaaaaaagcccccttaattctggaaccttagtatccacttctacttatatttgttttcctgatattaaacaagtgcagttgggtttgagagggtgtttttcttttttgccacttttaactagtccagatggttatgcgattcacagactcaaatgtgtccagatcatgaaaatcccaaggcctccgtgtttgagcagagtccatatgtttaggcattgttgttacttgtgtgggtccacagaacttgttgaagaatccaacaatggaacttgtgttcctgcttgatccaagtttggatgttcccatcctttctcctggtgatatgggtagaaggggctggatggtcacttcacaaatggttgcatgtccctatcatccaggaaagtgagaggagattgtaaatatgcgtgccaagccttcattgctatcaacaaaacagcctgtgctctatcagcatttctgtgagatgtgtagaaatgtttattttaaaaaaaggaatttccatattagtctaaaatgaactaggctagtcgttctcaaatattagagtgctttggagttccttcaaagctggttaaaaatacatgtattagggtcccaccgcctagagattctgctacagtaaatccagagtggggagcgggtaatgcgcatttttaacagccatctggttgttctgcagtccttagcacaacacttggagaaaccctgacctataatataaagcagtttttttagaagaggaaattttaaattagaaaaaaaaattagctgtcaaatctaacacttgaatccttgcccccattgactttatgctgttggttctctcttctctcagcattttgcctgcaggctagaatctgtgttgttcattgcagtttgtgctcagccacggaaggcacctatccctagcacccaacccccatccacctagggctctataaaaaggttagtgcattttctagaataaagcctttttctaggtagatagttctggggttcaaaatgggactttattataacacagaagccttaatgttaccatatttttcccatagatgtagtttggggagtgactagtggtgttggctgctggacatcttattttcacttggatttcaagttctgtgtctggatgggcttggacagcagttctgagtatcattattttgcacccagaaattcatttgtgcctattgaacacctactatttaccaaacactcttcttcttactgggacatcagtgtaaaaggcagacaaaacattcttatctttattgaatttatattctagtgggaggagaaaggcagtaatgatattgttggatgttgaaaactattcatggaaaaagtagacttggggaagagggatagagagtgttggaggtggaggagggtagtcagagagaaggtgacatctgagaaaagactccaaaggcagggagtgaacgaaccctgggaacatttacagggacaatagtccagacagaagaaacagccagtgcaaaggccctggggtgggaacatgtctggggtggtgaaggaacaataggaagccagtaggctagaggagtgtgagaaaggggaaggacgatggccaaaaggtaagaagaaatggggcaattgtaaggattgggcatctcccttgaatgaatcggaagccattggagagttttgagcagaagagtgacatggtctgagttagatttactgcctccctcccttccttccctccttccttagttcttttcttccttccctccgtctcttactttctctttcttttcctctgtccctctctccctcccttctttcttcctttccttcattttctttctttcctctttcttctttttttttttgagacagggtctcactttgtcaccctggctagagtgcagtggcagagtcatagcttattgcagcctcaaactcctgggctcaagcaatcctcccatctcagcctcctgtgtagctgaaactacaggcatgtgccaacatgcctataattttttttttagtagagatggggtctcactatgttgcccaggctaaacttagattttcgaaaggcctctttgtctctgtgttgaggatagtctgttgggaagtatggtagaaccagagggacttgctgggaaggtagttgcagaggtccaggaggaaatggatggcttcggcctgggtggatcccaaaaggcaggcacacatggtccattttgggtacagttggaaagataagccaacagaatctcctgatgattggatgaaggaagggagacagagagagaggatttaagaatgatatttggccggagtcaccaaaagtgagtcatttccccatcaaagactgtgggtggagcaggctttgaggagaagatgaggaattcagttttggacataggtctaagatgtttactgacatccaattggaagggctgtagaccgttggatgtacgagtgtggtgctcaggggatcctcatctaggagttttagcatgtggacgtgtgtgtgtgtgattatatgtatgtgcgtgtaaatctatataattgtatgtacataattagcagaattgtgtgcatatatgcttgtgtgtatacataactatatatgattatatatagattcctatattatacctcatagcctgttgtttgcaatgttttgtttctaaagtattgttgaacctccaacctttggtgtagatggtctttagtcacaaagtcatgctttgccttctaatgtggtgctccagacccatccacgataatcatcagtattcatcatcatccgccatattggcttgttttcactcctttgggctttgtgtcttgaaacagattactaatgctgaaaatggttgaaccttgatgatctctcctaagttctcttccagggggtagttaaccgagccttcacgtgcgtgtggactttgcagtccggcctctgccagcatgtgaccgtgcgtggcacacttgatccatcatggcacagttcatttgtgtaagtgacttgacagatgtccatagtgaggcatcaagttggatggtgtctgctaataaatctaatgggggaaaaagaaaagagaattcgaaggattatcttttttttttttaggattaagtttgtgccatttagctgtttgagaccctgtagttaatgctgctttattagaagcctatacaattcttcacatgggtgtcaaaataatttcagtgaaaatgatgttgtgtggacgcatcaagctgaagtattcgtcttgtgattacagatgggtttttgtctgggctgttccactttcttccggccgctttgctggactagctagacttaacaatccacattaatttactttggcacttcacatggtcaaataggccacagacacgatggtccttaataaatttctaaaaaatcctgcggtgctcctttttaattgacatccttcacaaattgtatttgcccaagctataattactcatcaagcagcaaaagcaaatctacctccaagtacaatgaggatgttctttttgaaattattaagatacagaagttcaatgcagagtaatttagttctgctttataatgatatctttggggactctatctttggggatcacatctattagagcctatcagcatggaaaaggacctattaccaccagtgtgcctcataaatgccaaatacccctgattcccagtgaccatttatgtgtctttaaaacagttggaattgcctgatttctttaataatgtttgtatatgacctttagaacaattaactactttacctgatattcatttagtttatttggaatattttgtcttgactcttgaaattgcatagaaggccccatatatggttgagtaggggatctttgaggggacatcagtggagggttataatctagaaagtttagaaatagaccaagttaaggtgacttagaatgaataattaaaaattcttatttagttgattcatattaataaaacaaatacattttaccatggtgtaaaattaggatattagctttcctaagaaagattcagggaaaataaaataatattgtcaataaagggcttagaacaagccttcccaaactgtgatttcacagggtattgcaggggaaacagaagcaagtgatccacagcatgttgtttgtttgtttcctgtctccccctttaagaaaaatgtaagcttcatccaagtagaaaattcgtcatcttttccataatattgcctccagtgcctagcacagccccttgtacataataggcacataaatatttgttggatgaaggaactgtgggccttctcagagcctttaactttatagcgagcatcgtgactcatcaaagggaagtcagcctttcccaaccttactggaccatggaaccatttcttgaggagcattttactagacttgagtacctctgggaaattctaactttgagtaaaatagataaaaaagtaaaactgaattgatcactgagtgaaatactcaagcttttgcagataccggaatgtaaatgatagagatcatgaggtagggaggaggctagacttccgtggttgaatctataaccttcggcaagttacttgagccctagaagcctcagtctactgatccataaaatagggatgataattatcttactgggtgttgggaaaatagattatgattagtcccagtttggaaaactaaatgaaataaagtatgtagagggtgtcactgggctaaatacttattcctatcatcttttaaaaagtaagtgaaaatgactccagttaggatgggcgattaggaggcattgaagtttatgtgtgatcaacctttctccctctctcccttcaacaaatactagagtgcttataatattccagacattgttagttctgggagagatgtcagtgaacacagttaaggccccttccccatggacctatggggttttgtactataatgtgtttactgatgtcactgcctcttagaacataaagtaaatttaattgtacacaattcacttaaagttaattgttctgaggtcattatattagagacctgccccaaaggagcactttttctctcagaatcagatctgttcttacaccaaatgactaaagcaggattcataggtcacattttaaaataaaacaaataagatcaagctagcattactaggtaaggtaatcaaatgaaaataccaccctttcattctgattagtttaaccaccatggtagggtagccagatttaccaaataaaaatacacagcacccagttaaatttgaatctcagataaataaagaatagttcttttattataagtataccccaaatagtgcatgggatatacttatactaaagcaaatttgctgtttattcaataaatttaactgggtgtcctgtatattatctaactaccttgccacactgaactagggtcccaggtacctatgcaggagaaagacaattgcctgcaacaagtcaatatttaaagccccctttgtagaggggctgttttacccaatacagaatagaaacctttagttctatttgaagtgatttataactgttcccgcctgatcagcaagtgtttccaaattaaaagccattaattaaggccttctatagatacaaaagatatgcaaggagtgctttgtaatgctagctcagtacttcaggtaagagcgtttcaaattacctggaccactggagccacctgcttgactaaacgctgcgtggcctgctctgctcatcagtgtgcactgcggtgccagtgttgttactgatttttctcatttctccagggcaaatactaattaatggatacaattcacagctgattagctgtagtttcttcagtaattacattcgcatactaactgttcagaagaggatttctaacccagttcttatttcactctaagcttaatttgttttttgaattgtttaggcctttagtttaatagccattttatttttctttgttgttttaggtgctattagataataagtaagtttaatcttaaaaaaaatactctgtgataatgagctgtttgctttaaatggatttctaattccccaacaaaacctacatttaaataacgttgaggttgtgatatatgttgttaggcggtttggggggccaggactggtgcacggaatactcatctcgagcccaggttctcataaatatccaaaaggaacatttgcatggagacctgagattttaactctagcatcattcattcatcaaaaatttcatgatagaaaataaaatacttaaaatactttttcttgcatgtatttaacattgtagaaaaacaagggaaaatatgtgtgtgagtgtgtgtgtgcccatgtgcagccatgcacatgtttctgatatcacatgccttcagagaaaccagataaaggtctttcttaagcgccaattcatctttcagaaatccttataaagatatttacctaaatgaagctgagtgctcagtgagagcttgtcggatgactcattgtatgtgcatttcggtgtgttggctgttgtgggatactctggaaccattagagtcttttgtataaatcctgcttagttcttggatccctgacatgataaagtgtagcatgtcaatcctgcttctgggtgtaagtccttcagagtcagagattgagagccccccagaaataagtgttagtttattgaggaagaggattatatgagtcttccatatctatgtatctctctccatattctatttattctcaatatttatctgtgtatttatctatgtacctacccatttatctccatccatccatctctcactctccttgggaaaattctatctttaaataattactagctttatttatattagagaatagatatacacatttcaccctttggagatcaaacctatgttttatttgatgcattcaaggaaggaaataatacactttataaaaaggacattcttttaccagttaaaaatcatgaaaataatatagctctagattattatactcacagagcctttccatattaccagactgataatggaatgtttaaagcaacaaaatgtgccgatttagaccatttgaacctgaaaatacatttctgccaaaatccaagttttacgttttgataacaggtccctagaggtaaagagcttaagtctgaaatgctgatacggtcttatttgtgatgatatgaatggcccattgtgttagcgaatgaaataaaaattgatgtgttcatgagatcccgcttatttttaaacctctttgcacttaatgttacattgagagattaaatatcactgttttcagcaactctgatggatatagatatcgctttaagctctgtttggagattttaaaaatattctttagtcttacaatttatattcatgccacaccccattcactagaaaatagaatttgagtcctgggaattgaattttattccctttaattcatattttaacctacccacacttgtgacatctgttcttgaaaactaagctataaaatccttacatgcttttaaaatgtgtcaaggtgattttcttggaaactcttttccctctcacctctcacaaatgccaggtcaataagcaacacacactggtgaccagttggcttaatgtttgtaatcctttcccttcacagttagtcttgatgagaaacaaaactattttatagaattattgagttagcttaactctgtgctttattttctgagggaaccagctgacagtatagccttgaaacctttgtcatgttttgcatttgggctgataaaactctcttttatttagcaacaccagcattctttccaaatcacagccagaatgctttattatgccgcatattaacgtaaaacaatctgttttctttcagtttggaaataataataactatatgaatatggctgaggcgaacaatgcgttcttcgctgccagtgaggtaggtgactgtcttaatgtgtttgttcctgttttttgtgttattgagataatttaataggcttgaagggaaaaacaaagtatcaaatttatctctctcttatgtggcacaaggtaactactttggaggagaaaagagaaaagcttattggaaaagaaaacctgataagtcttttatcacttgtctgtagactgttactaatgttagtaacttcatacgaatcttttgattaaaaaataatgcaaacaaaaagtaaatatataagaatgtatgttaaaacacacacacacacatatacagtgttggtatctaagcagataagtggttatttttttagataccaggctagaagtgacttttaatggaaaatagtttaacttcacatatatctagggataattaagtgtcattaagttgtcatggtttgggaaactatgtgacagaagagtattatagtttcctggggcttggggtgatgtgaaatgagtgttgtaatttgttgctagatccccacagcccagtacagtgcctggcagtagtaggtgctcaataaatatttatagaatgaatgaatgagtggctggcatgctccaagacttggtcacagctggggaaactgggtgatggaatcaaaatgcagcacctcattgtctctgggtctgtcttcagtttacgggtgcagatgaaacaagcatcatcttcttgctgctctttttactgcatttcctattattgattttgggctgctgtttggtctcattggcctgccctccagaaaaacctcaatcttgattagataaaacatggtttcctaaaaatggtagactgtgtgagatttaagattttagaacaagaacaaacagaagtgaaattggcccaaatggaacatttcctcttgtggttcatgtaatataaagtcctcattttccagatacattcaaatacaggaaactgaactagcttgaccccagagaatgaaaataataatggcttcataaatgatcttggtaaagggaggcaagtgttatgaaagaaattaactttgagaaattattagaataaacgggggatcaagaattaaagctattcctagattaatcatttttatagtgaccatcatctctctaaccaagaagacagtttagataagggaatattgtttggcactggctgctgtgttgtttgtggtaatgaacacaaaccccatctgtaaggacgacatgatgtttcattctgtaggatttttttttccctacatttgaatcaaacattgatgaaagctctactgccagcagctgttcagagacaatttaattccagctgtgataattcaccgtgtcagacattggctgttatatgttgatacaacagttctccagatttgcatttttatcaaaaggaacaaatgttttgaacatttcagtacagatggtatttaaccatgtacatactactttaacatgttcaaggtaaacattgaaaagtcaatatctgtaaaaaaataatcacgtaaactctaaatgattaatctgatattggtcagatggcacagttaccaaagtcagtgtgtctttttgttgtttttgttgttgttgatgccatatgtggttatttttttataatctcagatatccagcattttggattcctttttttctctaaggaaagcttaattttaatatattacctgcctttaaaggtagtttaacattttaacattttcttggttatttcagtggattattatattaggttaggatattgtaatatgcttaattgaaattaatttgtcgttaaaaaaattataccatagggacatattgcatatgacatctctctctgttcctgaacaaaaataaaaaccttcctaattatgactgcttagcatagacatgttttatgttagttttggaagtaatcttatgtaatgatttctctgtacatcttttcttgaacaaaaaataaagcccaagtaaatgttaatgctacattatagcacgtgcctaatttcccagtcactgcattaaaagtaaatttacttggttttttaacattttaatgagtgtaaactaattcaggaagtctttaggtttgcatgctgtaaagtctaaattgtgcctgaaaccaattcccttcacatggatattgtcctgtagataacactacaggaactaggatactctgagtttgaaattcacacatttgctttatgttttctatctgtgtcatgattaccctgaccatttttaaagtactttaaatatttattgaaataatatttcaagtgttaattacagtggtaatgaaaacagccaaatgccacatatcaagaatgagtgtttatccgtattgttaatgtgatatgttagatttcattaagcagtaatggggtagcaaatgagtcacaaattacagttgcatctgttactagaccatattagtgccaaaataacggcaaatgcaaccatagggttatgctcattagccaaccacgtttgtggccaattcatccctttgtgtttgggaactaggggttccacagttagaaactgacagcttttggggtcattattagaatgcatgtgtcagaaaatccaatattttagtctagcattcaaatgtattattctgctacgatgttttgaatatattgagcctgctaagaacctcaagatgttcagttgtcccaccatagactgccatagctcgtgacctctttttttctggtgagatacaaataacatttgacaggttctatatgtaagaaatgttttttgttgcttttttttcttgagtttttcttttccctcaagtggtcattacattatatcatgattgatagcttgaagaatgatgattttcagcacttaattagtcctcttaactgataatagcagactcaaattatcttgcaccagttcattctttcaaatactattaatagtaaatgaactataagtttgactctctgagctaggaataaaaaatatgagtagccccccaaaccctccacctgaccaaaaaaaaaaaaaaaaaaaccaaaaagaaacaaaaaaaaacctagaccttgccactcccccagaacctctcgccaaaaaaatccccccaaaaatggttagtgtggttgggtggagcaacactgatttatatcacgaggccctattttaaaacactgcctttaagaatctcagtattggctgggcacggtggctcactcctgtaatcccagcactttgggaggccgaggtgggtggatcacaaggtcaggagatcgagaccatcctgcctaacacggtgaaaccccgtctctactaaaaaattcaagaattagccgtgtatggtggcgggcgcctgtagtcccagctactcgagaggctgaggcaggagaatggcgtgaatccgggaggcggagcttgcagtgagccgagatggcaccactgccctccagcctgggagacagagcgagactctgtctcaaaaaaaaaaaaaaaaaaaaaaaaaaagaatgcattaagacttacttaggtcttgagatataatacttctctaagtaagcgaacagcatcaaatctagttagtatttctatatcaatatagctctatgctctctagatcatctttaaaaagtcgaagactggtagaaaatgttcagataaatacatattaaaatgttcatgtaaaagaaaataaccctctttgtagtttaaataaaagcgctggcatcttttaatatgaactatgataatccttatataaaacattgtattacacacagtaacaatttccatagaagtagtcattgcacttgggaatataccaatgaggaaattaaaaaagcaaaccacaaatttaatattacttgttttatatgttgtggcagaaagtaaatatatgtaatgttcacttctggattaatatgtgtgtgtgtgtgtgcatgccacaaaatcatcagcattttataaagcatgtggatagtgtcagcggtttgagctgtttcactaacatatcaataaagtagcaatttgttatatgctccaactaacaacaaagacagatgttgctaattaagtaggcattaaaaaactgttaatactgatactccattaaaaccatatgataatgagacttaaatctttaatcagaatgatcagcaaaactttatatatggaaatctgtgtttaagatattttcatttgagaaataaatatttggcctagatatgtatgtagtgttttcatgcaatgtctttctctttccctccccggaggaataagatataggaacagaatatgaagatacctgtattttgtttccttttagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggtaggcaccacatttattacttaaattattttttatcatttgcacaaatcatagtaaagatctgagagtccatgttctgaaacgtgctcttgcctgttcctagtggattgattctagtgctatttacatgcaggtactggatcgctgcctggtattgaacaaaggggtattgggttggttgacagtaaccaaaaagaggatgatccaaaaagagtctgctgatttaaaatgatttttttttaaagtctaattcattaatttggaagtagccaatcttcccttgctgttggcttaacacaaaggtgtgcttgagttgaaagtttgcccaggcaagattttagaaatggaagtccttatcaggtgcctaagtcttttgagtttttagtattataatgcttacgatacacgatttattcttattgcaaatgaaataccaaactgagataccaaaaaagggaaaaagtataattgcttataaccagcagagaaaaatatagaacaagtgattatgtgaaatacacctaattgcgttatttattgtcataaacatcgattaaggcactccagagagccaagataactaatgcaataattttggttctatttttcttagtgtgcaattatagtcagcaatcactagagtaaatctgcttaagtattttaaactcttctgctgggatttttcttttttttccatcatagcatataatgcatttgtgtctagctaggtgaggtactaagtagacatttttaaaacaagattaatagtttatagagcttttttttaaaaaaccctgataaaatgaaacagatgtgttggtataacaaaaaacaaatcctcttgcttgtttacatatttctctgcacattaggaccatgccagtgatgtttattggcttcattgttaattccccagataacaacatatgattgcaaaatatgtagtggattagtggtgcaaagattcaaagtgctctctgaaatataagattgctttcccaaataggattgcagcaacataattttctttgcttgtgatcttttgtgtttgagctgaacatcagggtttttattttttacttttttttttttggtcagaaaagaattcagtgaacagtcgggaaatagtcattaagtattcataaacgttactagacatcacaaataattgtttcctggggactttcttatatttttgtacctttgacactggaatggagggttctattctctgtttctctacagccaggcttgcaatgttttgcttagaaaagaataaaaataaaatgggtgtgtttagtcaccaagggagtttgccagggttcaccatcattcatagatgctcagagaggctcatttaagttgcagaaatagttaaatgtgtgttaaaatgtgtactttcttaaattggtaaatatttattaataatataagaatctgcctttaaattaaacatctgatgaattaccttgccttaaagctataaaactgttattgctgccataaaaaagtgtaaaggaggcattttgactatgaaatttcatttcatggtcaattgaatttactatattggaaagaactaaagatggaatcataaaataattatgatattcacatacacttaaagaacaatgctttcacggactggcgttgggaaagaggactcaatttttaatgcttcttttgtaatgtatggctaatcactaaagcagttgaattatttcattgatttttaaaagtataggtactttagctaagtgcaggctgttgtcatggtatttacatggacctcatcacatttattggtgcctttttgaagttttgctgaacctgagtgatatttattttggcttgaaacaaactaatcttgttgaaaattctagtagaatttcaccttgaagaaatgtcatgggattttaaatcacaaatgttggaaaaaaataaaatgtactaggacagaattatgatgaatacaatgtgttgttggctttgttctatgtactacctgacatgttcacctataaacttgaattcagaatcgccagaggcatggttaaaaattggttatgtcagggttcttctatatctctctgcgggtactgagttggctggctacatcataacactccacagaagcctcctcagagatttcccttaggaaagtcaccagaaaaataataaataatactttatacgtcatgcattcagcttcccagtgtgtgttggatatttcataccttatgcaagtaagaagttttattatccaaatgaatatggctgtctgttaaggattgctatggtgaattaagactatcatataagaagaaaagccagcttgttgatgttgtattgaaccagcttttcttcagagcttcatcggttttcctttagaaagagtgacagtttgtcacattactgattagctgcattattgttggcaacaagcacaacatgtttatcttcgttaaatttatgccattatatttaaaaacagaaggcaggaacaaaaaagggggattaaaaagagtccagtgattagcattcacatttcaaaatatgcaaataatgccccagtattcaaaagcgaattgctgaaaaattgaatgtcgatgcatttgtgacttcaaagaacaaccttgatttgcttgtcgtgaatacgtgtattttaaaacaggatgtggttggcaagtcaaaatcaacagtatattttggttaaaaatttgttacctctaagtgttattgtcagttcagatgatcagaggaaattgttttaatccacaaaagattgcaattctaaaaatctacaatgtgagttccaaagggttgtgtgtgtttttttttaacacctctctataatctgcccagcctgctgagtagcactgacatcagtagtacatcaatttcagaaagtggattatttttactagacagctattgtgacatattgggtcagtcataaatgaaagatattcatgcaagcatgcaatacttgtaatgaagtctcactctgaccttctgtatgattgattctgtaatttagttttctcaggcagtgcctgaaatgaaatgaaatcatgttgaacaagttttgaatacccacagtgcaccaggagaagaaaaatctgcagccctagaggcttgagagagagcagatgaacgatttatctctatgctattatagcctttgccagcattcaacatttcttttttttttcttatttggcttaagtacttaattctgcaggtagctgtaaatgggaaaataaaatgctgttcagatttaaaatgacaggacaggagtatgtgcaggggactgataaaatatcttgaatagaactgacctttcatgtagctgaaagttactgggggattcatcctcataattaccatatagattatttttatttctttcctgcaatgaaacatttcagagagcagtagtgctgattgaatgaaaattgaacttgttaacattcttttcagcttagcctgttgtacataacagaaggttagctttgatgaatttcaaaattctctttgatatctaagaaacagacagtaaaataattgtctctggtctgatattttgtatgccccccaaaagagaatttataaaacacactgataattcacatacttttcttcatatattatatttccatgtttagaggactgacattttctgtttgatattaccttggatttaattgtgatcacacatatttatagaaaatgctatagtggtgctctagcaatatcaaacggagtattagaaaattgaaaaagatggaagtaaggaaagtatttgagtatggtagtattcgtacctgttaaagggaagagaaaaagagaagaaaaggtcctataggagacatttatgcagagaagaaaattatgagcttttaaaatattcataagactcttaagtcataatccagacagatatcatttttgatagaaaaatggcaatttatcaaaatattacatctaaaattaccaggcttattttagaagttttttttattattatacttggcatggctctaattttgaagttgaattattatatttatttttaagaaaatgactttcatgccatttttatacttaaaaaaatcttacgttaagagaaatagcagactttcaattaatatgttgtttttagcaacgttgcttaatgtgttacagataaagccgttatttcatgggtcattaatgtgtttaatgcatggaacattctattaaaacaagcctttattattgttatgaacgcattcattgccattgtcaatagaggctggggagctaaagttcacaggatgatgactatttagccatggggggacaagcaatttctcatacaaattgaatgcttacaaatttatcatacatattgaataattttggtcaagttacggtcaaaaactattttattataaattaacaatgtaaaggtcacaacttacctaggcaaaaatacacattgaatggaataagacctatctgcatgaactctaaattataaaactgaagccatatattaaccttcaatgaatatttactgagcacctactaagtgctgtatattgtttgttgttattttttttaattttacatattttttagagagaggatcttactctgtcactcaggctgaggtacagtggtatgatcatagctcattgcagtctcgaactcccgtgttcaagcgatcctcagcttctcgagtatcttggactacaggtgtgtgccaccatgtccagctagtttttaaaattattatagagacagggccttgctctcagttgcccaggctggtcttgaattcctggcttccagctgttctcctgtcttggcctcccaaagtgctgtgattagaggcatgagccactgcacctggcctgtttttaatcattagagattgattatactgtttgtgaaattgttttgtgtttctttctttttttttgactaccagtgtcccctcaatgaattacagagattcaatctgactgctgcctgaaagaagcttattgtcaaaaaccaactttaatttagctgttactataccttgataattgtctgccaaaaatacccaggccacagacacttttacaagctgccttctttgtagagccttgtaccacactgagcttaaaataaatattctttattcttggcctgtgcatactactgactctgaacagataggaattgtctttagggctgagttaacctgagggtcatctgtcaaagtaggactgtgttccaaacttctactaaacctaattagaccttgtgcagtgtgatacatgattattgtttagtttataacatttaaaggaaaatgttatgagaaggctggctgtggtttatttccctgtatcttctttttaacatagatcatctacagttaagtattgtagtacttagtgatggttcagagacagcaaagacacccttttacagcacttagattcccacataagactgacatgatggctcaaatattttttggagaggtgagagttactctgtatgccattacccctgttccttttattcacagcccttgtcgtcctttgcaatggtttcctttgcttgcttcccatctgtctcctccctaccagaatagaagctccaggaaggcaagtgctccttgggtctgtttggtgtcgtccctgggcctggaatatacttggctttcaataaatatttcatttgttcaatatataaattaataaaaggacaatgaaagaacatttacttgttattaagagcatacttagactgctaagttaaaatggaggggagggggcttgaagtatcaacagctataaaaagtggaattgctctttaaaattttaatttaggactgaataaaataagtgtggagttgtccctttggtaaaacaaaggcagttgcagggtacatgagtaaactaccattaagtgttcataataaactcttgaaaattttattttgccaagaaactattaattaactttagggaacactgttttttacaaaactttcatgggtaggtatgtctgattacaaccctgagagtagttattaagtaaaaatgatctatttcagtgcagatattttgatgagtataaaggtggtggtatgcaggtctgtaattatcattggtatgcatttggcattactgtgtcagggtccattggagttacaaaagtagtagctatgcataactatttgatcgttgttaatttggaaataaaattttaacattgctataagacataactaaataattgaagataaaattactggcctgcatttcctatttgcagttaactctgatatttatgaatacaaagtaatttttattgctgataattgtttaattacttcatttctcaagaaatattgattaaaaactggcacagtgaaaatatatttagtcacactctaatatatttgggttagttgcttcttaattggatgttatgctctattttgaaaacctaatattggatcgttatggagaatatttctgtgtaagtatagatagaagatgcattaaacacatttgcatattagaatttaaaaaaattttaatgatgaaatcaacccaagtgtaagtgccattgtaataagtataaacacataatatagaataataatgtgtaatatttacaataaaatgtcagggtgaaagcttatatcttagatttgcaaaaagaaacaaaacaaagcaagaccgtagtatgtatagctatggactactaattgtgcagcacaaagataaatgtagcactgctccaggtttgaaaaaatgagtgaaaaggatttaaatatgtagagttttctcatttaaggaaattagagcaagttttatccattctcttctcatatcctgctaccctaagacatatcttcatatgaagtacaaacatgatattataacatagtgacttacacagtaaggaagtttttcacctttcaattctcttttaatcttgattaagtccaggagaaagactcagtttggggctaattaagtctttcacacctttcttttgccttcttaagttaaagaaagcagaactcaggcccagagccttaggcaggccccagtatccacactgactataacagtattgttttcttttcctggtgtttatttggcattctattggccatgagtgattttaatttttcatttatgttagtgatctaaagtttccttattaatataacattattcagattttaaccgttcactcaaatgattaatgttcaataatagactgggtttcaggcaatttaagaaaatgagggattgctacccaaaatatccattcattggatttttcctgtttaaaaaagacaaagaggctctttcatcaggtggagagagaggcgagcctccgccaggcactcccctacccccaccaaggcatacagaaaccagaaggctttgttgaacaccacaggcatgaatcatataggccaatagatagaaggcaatgcccctcctattagtgagagcattttatgagatccatggcccacccactctgagtgaccttctgtgactgcaaatgttaatctttgggtattcttcgaaacacagattgaggtggcaggctatacatttatatttaaactaaatagaaatgtccgcaattgatttagatgggttggttgtccatgaggtatggtcagttaatatttattgcaatgaatagtcccaccagatatataccatgctttaaactttcaatggcagccttctacactgtgaatataatccagacttcctaacccagacaataaaccttgtcactttatggccatgacttgccgttccagcctcatagccagctatgctcttcctggcccagtcacactggactgtcatttccttatcggcagtatgtttgcccatgccccaggtttgggtacatgttcatctctgtctgggatgccctggcttggttagcttctacttccctttatacctcagcatagtaggtcacctcttcggggaagcatcccatgatttccccaccttacacaatgaggccagtctctccaagcctattgcatttcaccctttaccttgcctaccctgcacccagctttcctgtccaccttttcatttctcaagcatgtcaagatctctcccacttcagaccttgcacatgctgttccctctgcatgagacatgcttttcccttcacttcacagttggcttctccccatccttcagcatcagctcaaatactatcttttttgagaggcctttcctattgacccaatcaaatgtagccatccttccccaataactctcttttgtataacctatttattttcttcccaatatttatcacagttggaatcttgtttatgtggatgctttctatttttaggaaaagaatataagctttgaacattcactacctgcctcccccaaggagatgatttttatgatatttgtctaatacagtaatttgcaaatgaaggggattttgacatttgctaatgtctgtatacattttggttgtcacagcccggtagggaaagggcggctactggtatctagtgggtagaggccagagatgctgctaaatattctataatgtacagaatgcccctcccccaacaaaggatcatccagacccaaatgtcagtaccactcaggctgagaaactcttatctaatatcgccaattagaagacaaaacgagacaaggcagagagaatgagtttttcccaaatactgaaaaatttaggaaactatataaaggaacattacatataaaatgtaattgtgaaaggagttgaaaaagctaccagcattcagctcttattgttggttatgatagtgggcaatctcttagaacccaatagctgctttgcctttaaatgatcactggtaaatctttcaggacttaatttttgtaagtaagaagtaatattaacaaaatcacattaaatttctctgggctatattcatagttatacatttccttattgtgtcattactactgggaaaaattgtgagcaattttggtgggagtatataaaaattattctggcctacattatgttgtagtaaatttgttcatccattcaggattttgtttaatgtgtaaaataatcgcatggtaatttcctggttctcaaagatataaggtttgatatattgccttctctggcctgatacatagtaggggctcagtaaatacttttatactgagctgacatcttcctctttttatgtggtagtcctaagatcaagggtaacatcttttaaaggttacttttatggaaaatgattggagctgttgaggatcctcaagttccccaaggcagttgttaataatttgtggccctaaaagagcttgaatttccaaagagacactttagccattaatcgtcttatactataatcttcactcataggaggtgattatgggataactgtgaaccgtggtgagtggtggcacattttgatgcatcaattatgtgggtcagaggttactttaaaaatagtctagaggcccttggtatcttgtccagtgggagatggcatctttttggatctgaagactatgtggatgactctaagttttggcaaggccttggccccaccaccagtactcttcaggagtggtttccatactgtcacactgcaaaataatcttttttttttttgtaatgaaatattatgaggaacctcaatttataaaacaaatggaaatggagttgattttgttaaagggggatgatggcagtggagatcccagagtcttattcatctatctctgccgggacatgcctctaccgtgaagataccatggctctctagggcccaggttttctgtcaagcattcactagctagcttgggggcctggggaatcattcttatctgtctaagaataagtatagtactagtatctaatgcagaaagcaatctaggggattaaattagaaagtgcatattaagcttagcacaaatgctggctcatagtaataaacacacagtaaaactccctttttagtacagtgaaccttggctgtctatcagcaggagctccccagcaacaagatccataataaaggcataaattgcagatggaattcaggaagggctgacaaagccaaggagacatgcttgtgtttggccatgatagccatctgaaaaatgctctaggtgtggggtgagtcaatcgagcacctatatgtgcaaattttcacaggcattggagcaaagagagcaaagtaactctctgctaatgagaaaactgcataaatcagatgatcacatttcatgaccataccagttaactaatttagtattatacagtcagaattaaaatacttcatttaaatgtgccctagaatttgcctgtagatactttaaaacatctagatttaaataagatggaaagatttttaaaaagcattctgggccgggcacggtgcctcatgcctgtaatcccagcactttgggaggccgaggctggcagatcacttgaggtcaggagttcgagacaagcctgaccaacatggtgaaaccccgtctctactaaaaatacaaaaattagctgggtatggtggtgcgtgcctgtaatttcagctactcaggaggctaaggaaggagaatcacttgaacctgggaggtggaggttgcagtgagccgagatggcaccactgcactccagcctgggcaacagagcgagactccatctaaaaaaaaaaaaaagcattctgaaagacatatatgaagacgaaaatttagaataagctagatggcgtaattaccagtagtgtgggggtggaagttatgtcagtgagcagtggttacacttcaagagaacatggaagactgaatagatagctcagattttctaggagaaatgagcaaatgtggtagaattccaataaaaaaagataattaggatgaacagataacataaaatccacacaatctgtagaaagacacctgcaagtagaacgtaatattgtaggaacaacgaaggagaacactgccggtgatataagggagtgtggtgttctgatacttgtgacactttcctccaggatttcacagtaattattcggaaattattaagaaatgggaaatgtatgtatttaatattctaacacttgttggcagactcttttaaccacttgcattatcttccttttttttctgattaaagtgttttagtttttgtttactttttttttccatttcttttttttattattattatactttaagttttagggtacatgtgcacaatgtgcaggtttgttatatatgtatacacatgccatgttggtgtgctgcacccattaactcgtcatttagcattaggtatatctcctaatgctatccctccccattccccccaccccacaacaatagcaaagacttggaaccaacccaaatgtccaacaacaatagactggattaagaaaatgtggcacatatacactatggaatactatgcagccataaaaaatgaagagttcatgtcctttataggtacatggatgaaactggaaaccattgttctcagcaatctatcacaaggacaaaaaaccaaacaccgcatgttctcactcataggtgggaattgaacaatgtttacttttgtattgtggtcacagcttatcaaaacagcatacacatgtacgtagaaaaagttgaaactctcccctccttgcccctcccattctaccccttataatgtaaccattgttaatgttaggatacacttttttttttcccaaagaaaacaaggctgtcctgtatagttattttttaacttgccttttatgtactgtatcttgggtaggttagtggttctcaactgggagtggttttgccccgcctggggcaaagtctggagacatttttcattgtcatgactggtacggggagggacgttgttagcatctagtgggaagaggctggggatgcatctgagtacctacaatatgcaggacaagccccctcaatatgcaggacaagcccttacaataaaaattatctggtccaaaatgtcaagagagctgaaattgagaaactctgccctaggtcaatgcacataaatctaattcattatttttaaaagcttcataacactttgacgtatgggtagaccataatttattcaactagttttctttgatagatcttctcattgagtggcatttatatatttaatatgaagaaaccaaatgctccaatttagttatttacaattcattccgcttctttaaagagcaaaaataagccttatcggaaggactcaaaaaaggaacagttaagaattcataggcttgtgtataaaattagattctgggtcactgtgagtcaagagaatttggtttcagcaaaatcacagactcactccaaatgacatgtcttaaagtaagtcatttgaaaaacatgtcttcattttttgattctttggaattaaaaaaaaatagagaataagcagtaacaactataaggcctttctgtatgactaccaagaacagagaaagctgcatttgaagtaactgcaataagtttcagaaaaagctatttctgatggtttctaccatctttttttacgtatttatgaagaaattcattagtacattaaatcatgatggattgaacaaaagaaaacaaagtaagtttaagtgaaaaaagtgatatccaatccaaaagacattgaatgacttccagatgccgctgacaatgtaattcagaatcggaatgaccgtctggttaaccacagaggatttcacagaaagggtgccctaaagcaaacagatgtttgctctgtgaaactaaagctctatgctttgctggcccatcctctgcgtgccctgtgcatttctgggagaataaaataaagaatggcttcgccttctctcataacagctacatgtttgagaaggatggtaaactaatggatgagcctaaatgggtgcggtctctgcttcagccctttccctgccaccagtttactcaataagaaacaagagatgaaagattatatttagtttttctaatttcctttcttctttttttccttccttccttccttccttccttccttccttccttccttccttccttccttccttccttccttccacatccactgacagttctataatgaaatattctgttctggatatttggattttgtgcttctcaactttcaacttcttggcatgggtccttatatttaataaatgaacggagaccatcatcctgcaataggtcagacctatcaacattgcaacagttcaaacctatctaaggagatgctaacctgataagttcactgatatctggaaaagctgaaatattttccccctttgttgctgcctttctaggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagtaagttagaactgccttagtgtgtaacctgccagagaatatgggattaccccatgctgtttgaatttcattcatggtgttatcttgtttgtcttcatggatttggagtagcatttaaatgtatgatggtttgttgtttttcttcactctttcatttattttctgtagaaagtatattggactggaaattgagagatctggcttctcctactatagctgtaaggcattggacatgttatttaattcttgtaggcccaatttttctaatctgcaaaaggaaggcttggactccctgctacaaatttccagaaattctagacattccagaaattctaaactgctctggttctaagttaatgtccatgtgagcaagtttcatccagtgtgttggtcaagctgctgccacatttgacagccttgcggcttcggtgatgtttatcgctgagttcattctcttcatcttacatttttgcctttgtcatgggaaatgtataatttgaaatgatacaaagtttgaaataaaaactgtgttccagtatgacttttccaaatgcttagaatgatgaaaaagagtactgtaatagtacataattactcattagtcacttattaattatgtgctgtatacctactctgtgcttggcattttgtttggttcttgtgatacaaagatttataagagaattactgctaatgagattcccctttggggatgaatagcaatgtttaaaactagctccatatgtgattagtgatataattgatgtatctggtgtgctgagattctaatcgattctgcttgggagagtgatttgaggaagactttactgagaaagtgatatttgaattaggtctaagaggatgaataaaagtttgtgaggcagaagacagaggccagcattttggttgggggctagtgaggaacagtggaagtacatgctatttatgggtatagtgaagttcgatatgggggaagagagaaatagaagttgaagaacgaaatggcttaaatgtggtggtctttcttctgttggtagctgagagctgattaattatttgcatcgaggaatggcataagtaatttatgctttagagagacaactttggctatatagagaatgccttataaagggagggaccaaagaaaaggaaattaattagaagactcttttgttatgtttcctttcatcaagggagggaatgaacagaaggtaccagattagcaggcattttaggagtgaaaatcataaagattttaaggatttggtgatccactggaatttgaagaagagacaaattgggttttagtttgagagccagaatggctatcagcaaatgagaggagcaacccacaaagagaggagtgttctcccccatggggaacatgagagtttgggatgttagagttgaatttgacgtgcttacattggagtctagaactcagtcatggggaactggaactatagattttgggaccatcagcacgtggatgagaagatgtgaaagtaatcaggacttctcagagagtattaaggagtaagtcaaggacagaaccctgagcatcatctatttctaagtagcaaaaggaagaagaggagctagagaagattaagagtgatgaggaacagagaagggaggttcaagtgatgctgcagaaattgaaggggtttcaagatgaagggtttattctataacatcatgttagcacccccattgggcccaggaatggtaaatacactgacagtcttctcacagtcacagaacttcagtccagaggattgagaagtaatggttaaagactcttgagggatatgatcagatggggttaggtaacagcttagccattacagttgagagggattcctttccctccaatcacacgtccgctgatcttcatacttgccactgtaccatactgaaattgtcatgtcttaaagaggacctcttatgggactcctagcttgctccattttaagcgagggtctaggttttgtgtaaaggcaatacagccaatgtatcttcattgaatcttagctgagaaaggaagattaaaactatcattgattatgtctctttggggtaaatctttttctccagctttctgtctcaacccttttaagtcaatgacacaaaaatttccttaggagaattaattctgaatttttgtttaaaatgtgagactccacatttcttgtttattcttaaaaaataataatgattagggcacatcatggttatccaagaaaggcgtcaaaggtggtcgacatttgaatattgttttacagagaatgaaattgaactcctcttatttggaaaaaaagctactctggaaagtaatagcaacttgccattggtcagggtattgtggcactaacagtgccagattttcttccaggagaagaatatagttgtttgactcaactagaaaaatatgtgtgtctgtatatagtttttcttgtttaaataatgtttttcattgaaggaaaacttggctccaggtgaagctctaactgaaaggcatctgactctcttggaaattcacattcattaagtagaattaaacaagtgtcacttattttgaaaatttagaaaaaagactatgggctctagagaattattgaatcaattgtgtgagttatgaaagatggcattttggaggagaagtgagatatgacttaaaaccatctgaagcttgtaaactactcagataaagtgtggatgctgttatcacttaaatagtgcaaacagtaggctcacctagaggtaggccagtggtttcttaacactttgagtgttcagagctctctaagaaaagttccttatccgtttcctccctaagaattttagtaaatggtaaaaatttagtgaaagttccaaatgaccctcatttagaaagtaaataatactctaggaaaatttgaattagaattcaagtcattaaaagcctatctgttagtaacttgaatctatcttggttgatcttgcccaaggctggctttgaaaacagattttgtcaaacattgcaggattcttgatgaagttaactgcaaaattatcttcgatattgtaatctaggggaataaaacaaggtttacaaatcatttccctgcttctctgataagtatgttaaatgatcagtgaacttagatggtggtagctggtgagtatggagcttagtcatctttaaattgggaaactatacccatatcagtttgtggttctgatctctcagagttcatatggtcaatgtgtgtgagtctctatggagtattcttgtgagcagggttacttgccataaataacaaacatcttctttttagtcttcttagtgatttttaagtatcaactattgctcttttttttacacgtttttaattttacggagagtatcaatttcccttttatctccacttaaagtagttttgacatttttacatttgctgttaatcttcagaaaattatttttagaaaataaagatgaccttttcctaatgctgcaagtatagaaattggagctaacttccatttgaatttctggagagccattagcaaagtaacattctggtaaaattaaaaaatcagcctcaaaaaaaaaaatcaattcagacagatcacacatatggcatgtgactatggctagggacctcatttaaaatatttgaatatgatcaacatcctgaatattatttaggttttacttctaaaacctctgaagatataaaatattttgctgatgtatgtatgtgtagtatagcatatatatagcattgcctggtacagagtgttctgtttttcattactcataattgctatttcgagcatatgttgtgaacgtattgaagatacttctgggtctcattaatcgatgttctaaatgctaatctctgctgtctagttaactccaagcaagtttacccctcccccgcttttggtggtgattcatctgttgatgatgcctaacaaaaccttcaaagaacaattatggatctgagttaagtcttgttgcattctctgcaagtacattctaggcagtgaattttcttcctgctttgcaggccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtgagacaaagacccatcaaggctccatcaataaacctcatgatcatttaaaatattcctcacaccttttccaagtgcatgtgttcacttaatatgattgcttcttttgaaatccttttctaagcaatggaatttaaaaacccagacatataaatctaaacaactctccagttatattgatttctctgtcagcttatgggtgcatgttcagaacccattcagaggaaggttggaagaaatccaggcagtatcctgcaagcataaacttttgatgataatcttttcattttaaataatgtggaattttttcccctttgttcaaaaagggcactacaaagggattaggtccatcctgcttgcctttccattgatcatctttctgaacccttgtgctgtcctggtgggtttccaaactttgaagctgcctctgcgtgtctcattattgtcaccgggcatttgaaattttattccaagttcattttaaagcaaggcagtatgagaggtattcagaaattagccatgcttgtgggagatacttccttaggggcttcgtctcctctccttccccttgcaactcctccacacaaatgaagggaagaatgggttccttgggggtcgatcccccccttactccttgcatgaaactccaattaccattaaaagaagttaacttttacatatccacagaagaatagatcaactcctatgagtgataaaatagaataattgttttcaagaatgaagagtggaaagtccttgattttgtttacaaatcatgaacttatttcaggaactcattcctagaagcttgttttgttgggaaggtgcaacattagaaatttctttttagtttgcactgagtttattactgtagatagcagactgattttctgtcccagaaatataattctgagggactggaaaagtgctgcacctaacttttaaactctggagagaaagatgcatgttgactgaacacccagccatcagaccacttaggaaaaggagaagcccaaatcatgtttaatatgctggaattttatttatgtaactcagtggggtcactaatggaaatctcctagcttggatgatttctgacttttaattttgctccaaaagaaaaccaacattgaaatgctttgctcttttctcttctgtcttcatcattttacctgttgtttttatcctcttgtttggtatagtttagaaaggtatctgagggaaagaagacattgatggagaaactcattattttctctaaagtaagccatttgcagcaaagcttattcttcttgctaccttatttattgccttagcatgaggttttcagctgttctcaagaaaaagtgattctcaagtaatctgtattgcatccagaaatctttttcttatttgcaatagtaaatataaaaattgtgctccagtgagggtggcagggttctgttttgttttaatatccgtgtgtgtgtgtgtgtgtgtgtgtgtgtgtgtgtgcatgcgctaacatttaaaaatcaaagccaaggagaccaacctttttatgtgagttgtgtttatgtgacctaatttgtgcagcagctattttatagctgagaatttatacgctaaaggtggtgctaattgtggtcttttaataggtatataaaaggaaaacagaagctgccaaaaaagaatacctgaaggccctggcggcatacagggccagcctcgtttctaaggtaaacctgggcaggggcggccaggctccaaaatagtcacagcgtggaaaacagccctcaagcattgaaaacatacttgtagctcccctaaaagttgatggaaaggcatcttgaacaacttgtaaacttaggcgtttccattagagattacccaagtgatgatctgaaaatatgagttaatttaagcagctgagtctaagttgtttctgaaagatttccctgatctttatatatgtgtatgtagctatatacataaattttaaataggctcttatgctttcttctggtcagggattgggacctgtgctagtgtcctctgtttaaactgggaggtatgtttgtcaggcatttttggacatcatattataaattctcctgtggttatattactacaattggggggcattgcatttttgaccaaactgttccatatcatataaataaataaacctcatgatcatttaaaatgaaattatactccaagtactaaacaaaacctacatgtattatatagagagtatacagtggaccctggtgtgttataaaatatcccaatatcccaagcaaatgtcactctagcaaatgaatccaaaggaatatgagctaatacatgatattaacatttaattagctttttctcttgcctttctagattttagaggttttggaaaggataatttgatctaatatatttttgctctagacaaattttttctgacaagtagggatacaatttcattgtcactgttgctgtctcaagtacaacctagggtctcaaagccatttaaaaagggttcattcctttttttctcttttcacctgagttgcttcttctttatattatctgtattaagtatttgtatcaagatctaccatttgcagctgctcagaatcagatcaacagaggtcctcctctctttgctgacagctattaggacacttcccacttcattagatagataaaacatttatcaggtcaatagcaaaacctctttctcagactctggaagacacatactggaagatatactgatgttgtactcagacttgcacattggcagaaaacagctgactgtgtgggctgcagatgttaagaattaaagtatagttggttaactagatggagtgaagtgaatagagtaacagtgtgcatgtacttcttaagtgaatcatttattcattcatttatccagagcaggtataggtgattttgtgcattaaagcatgaataattgaccgtatatggatttaaaccaagatccggtatctcaaaaggcattcagggaatattaaccatgattgggctcatgaagcctgtgactgacttagaggggataacttaaaacttacacattgcatactagaatcaggattcagaaatacttccaggtagaattcaatgacaccaaaaaagagaaaaaaaatcaataggatagaatttagaaggaataaatttaaaatactagggtttggtttgtttgttttttaattcagtaaatgcactttgagaggatcctaaatctctattcaaagaactgtgaggcaactaatatagtcctttaggtataagtttagaataatttcagcctgaacccaaactgtgaagtagctgctaatatagtgatcgcacaggaagcagcattgaattgtacagtgattattagaccgcttctaaagaattggttctgttttggatcccacagtttaaagagagatgacaatcaattgatgtctctctagagcattgcctccacgatagtgaggactgaaaatcacatcatgttagaataactgaaagaatcagggaggcaaggacttggaggcatatgatcttagtcctcaaatataagggccgttatataagggaaatgaagtcgatctttgtgcccaagagaggagaactcatccaaggggtgagcttacagggagtgagagttcagccccagcatcagaaatatcaatagggttgcatcatatgcacatttaacttatgcctctgcacgcagagcctcagacctccccccttaagatacgactctgctatcacttttaatctttacaataaccaaagaaattcatggaagcttactattaagccataaaggaacaagaaggcaggcaaggaagaactctgtgcaatcatccacccatctccatttaccgttaaggcagcatcttaaaggcacaatagtgcaactgagctgcccaggtgttgaaatacagactttctttgtgtttttttctttaagacagcttgttaatttttaactactagagtatataagaattatgtacatgtttattgtgtgtattcaactttatgggtgatttaatggttttttgaagacaaatttgaatatttataggctgcttcttaccctaagaccttagaacatgacggttcaggaacatgcagccccactgagttttgtaatgtggagagctgcccactgaaggggagtgccttataatgatgacatgtgttcaaacagaaaacatcagagatggcttttcctacactggatgactctctatatgaggttacatctcagtttgtttccaacagcaggattttataaatcggagtcataaaaatttagaaatataaaattattgaagataatggatggctgtttgatgtctcctaggtgcccctacaacacacccccaaaaacatcctaatcaaatgaaaaatacaaggaaaaaatcgtctctggaatgaatcattccaatcactgttgcattagtggaagaatttctttttgtagaggcagtgaagtgtttttagtacaaaatgtaatagatagtttctctctatgttcagccctagatctgctgtttatcttttaacaggtgatttggtcccatgaagttgaacattttccccttatctatgactcctttgataaattctacaaatcttcaaaaatagttgatgaactaaaacatttctaaaattgtgaaaacttcaatttggtatctctgaggaaaccaataatggttttcttatacttgagtgaaccttgttataaataatcacacaacacagggctttcaagtattccagtggccattttctggtaatagtaactgttaactaataaaaatagctaatatttattgcttcctatggaccaggcgctttcctaaatgcttaacatgtgagttcatttaattctcacaacctctgcacaagaaaaataccatataacctggccaggggtagtggctcacgcctgtaatcacagcactttgggaggccgaggtgggcagatcacgaggtcaggagatcaagaccatcctggctaacatggtaaaaccctgtctctactaaaaaatacaaaaaaattagctgggtgtggtggtgggcacctgtagtgccagctacttgggaggctgaggcaggagaatggcacaaacccaggaggcagaggttgcagtgagctgagatcgcgccgctgcactccagcctgggtgacagagagagactccacctcaaaaaaaaaaaaaaaaaaaaaaaaaagaaagaaagaaaaataccatataacccaatgttacagataaggaaacaggaacagatgagtaaattaacttgcccaatgtcacaaagttgttaagtcagagaactgcatttgaactcaggcagcctgtactctgttgtctttaaacatatggtactcaatggtaaagtcgttagtacagacttaaatgcagaagaattgttgctcttaaatatgtgtatcggttatcttttgccacaatagtgctgtgtaacaaccatccccaaagctcaatgatgtgatgtaagatgagcatttatcctcagagagtgccagttagctgactggttcttcagatctaggccaggattggtagaaccagctagtcttgcttttctgtctggggtcagcttgcatgttggagggggctggactcattcacattgatcacagttggctggctggcagtgaactgactcttgaggggggtaattgggccacatgtctgtcatcatgcacatggcaggggcaggcttgaagcctcgtcttggaactggagcagtatcactgtcatcacattctgttagccaaagcaaaggcacaagagcagcccagactcaaggaggtaggggatttgactccacctcagggaggagtgaaaaagtcacaagacaaagagtacacatacaggagggcatgaataatggtggccgttaaaaaaaatcaatttataatatctaaaaatgcttaaatattttaaatacttatgtgttgtaacagtctggaattttctcccccaaaatgcaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgatgcaacaacaaagaaactgttcacttttcaaataaaatgatatgtcagatttc

SEQ ID NO: 61 - DNA, 206582 bp, Homo sapiens
ccgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggacagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccaggtgggtccctccgcctcctgtccctgcgggtctgtggggcagtgtgtgcgggggcggaggttgcgagtggggcgacagggctgcccccagggacccggaggcctcggccagttctgagagagaggactctgcagccggggatggcggcgacgcccttgtccccgggggacaccagcctccttcgcagctcagctcctcgcccagtgctgggtgcgctctccccatcttccttccctgagacagtctgacactctctcccctcccccggccatttctggggttctgcagccgcccagacccaaagtttgtcctgttctggaagtggtgtttgttttggctgctgcctggtttaacctctgctcgctgctcctgcccctccctctcctgagtgggttctcagggtgccttgctgggatttcaacttgaagggtgtgtgtgtccgtagggttcgaggcccagggctgaatgttgtcctctctatgtagttgtaatatataagtatctactatatgtaattgcccataacatatttctaaatattaatattaaatcgaaaaccttaatgacaagttgcagaacagggacacgggactgcaagaggacgtttgtcaagtcaaaaccaaatttcccatttgagattagaggtggacttcagaagtccaccatgggaaacagctgtagtttcccatctatcattacttggacttgaaatagaattgaaaggtaagggatgtcatagctaccaccttttggctgttctatacttggaaaagtactaggggatgatacataccagacgctgtttttgttttgtgctttccttggagcttggagaaagactacttgataagcctttgtctgtcatttcatgtcaccagcacttcatggtgataagactgttaatatcaggttcaaaacgtgaaatgaagcttttcctaaaagcaatagtatgaatgttattaacaccaatggaatatttagagtggcgagtggtattttaaaatctagtttcaaaggagaactgagggttttatggttcacttgcaatgtcattgtgttcatacgtatttttaaaaaaattgcttaagactgcgttttatactgctggagtgtttttactgctatatgtttgtgagcataactttagacactttgtaatctttcacccttttgaatttgggatttctgaaactgtaactagtattcacagaacttagcatggctgtttatccctaaagaagtccttgatatgtagacagttctgccattgctgatgagtagttgagctggatcaggtaaagagaaagtcagtgtcttaaaacacaaaccgtggctattacatgaggccctcagaatagtcccgagcataatacatttattcagtgctgtagctgcttcccagctgaaagaggaataattgactgaggctatgcagcaagtaagtgacagctgggtacctattaaggcttattttgttgtcagtaatgcatcggataagaggaggtgggcatagtaaatctgaatatgttggttgatgcctctttaggaattgggaagaaggatttcctgatgttagaacccatgctttcttgaggtacatatagttttaaaaggacccaaggcacagtggctgtgcgtgaatgagattatatttttgatgtccagttgaaatctgcttgcaaaagactgcttcagatactggcaaaaggggacatccctgcgagattgcttggagtaaatctctcagagctcgaagctcccttattcagcctagcaaagcaaaacacatcatccacctttaatccaacaaaattaccataactcaatattcttggtacaggtgaaaatgaacattgaaggcatcctggacatgtgatcctaagagagtcaaacaaagtcagcaaccagcagacacctaattttcacccatcactttggtggtggtggtggtggtggtggtggtggtggtgtgtgtatgctccatccactttaatttgcattaccccatcagtgtattagccattctttaaaacaaacgtagatgtttttaccctttctctgttaaacaggaacctgtaagttgagatttaagtgccccaacaggtataactgctcaaatcttggaggcactaaccagtcctgatattttctatggtaacaaccaggttttcctcttaataagcatacaattaagattaccataataatgttccaggaagagtgagaatcttgcattcttaccacaagtaaatggtctataaaaatacttattttttatttatttattttttgagatggagtctcgttctgttgcccaggctggagtgcggtggcgtgatcttggctcactgcaacctctgcctcccgggttcaagcgattcttccgcctcagcctcctgagtagctgggactacaggcgcacgccacctctcccggctaatttttgcatttttagtagagacggcgttttgccatgttggccaggctggtctcgaactcctgacttcaggtgatccacccgcctcagcctcccaaagtgctgggattacaggcgtgagccaccatgcctggccttaacatattttttaatagactatttttttttttcagagcagttttaggttcacagcaaaatttagcagagtacccatatatcccctgccccgacacacccgtagctttccttactctcaacgtcccacatcagaataatagagtttttacaattgatgaacctacattgacacctcattattccccaaagtctatatattagggctcactcttggtgttgtacattctgtgggtttggacaaatgtataatgacggttccaccattgtagtatcatacagaatagtttcactgctctaaaaatctgtgctctattgattcatccctccctctccactaacatgtggcaatcactgattttttttttttttttactgtccccatagttttgccttttttagaatgtcatatagttggagtcatacagtatataggcttttcactttggcttctttcatgtagtactatgcacttaaaattccttcatgtctttttatggtttggtggctcatttctttatagtgctgaataatattccattgtctgcatgtactacaatttatttattcacctactgaaggatatcttggttgcttccaagtttgggcaattatggataaagctgttataaacatctgtatgcagccttttttgttacatgcaggagataagcttttgactcatttgggtaaatagcaaggggcatgattgctagattgtatggtgagagtatatttagttttataagaaactgccaaactgctttccaaagtgattgtaccattttgcgttcccatcagcaatgcattggtttctttacagagtatttattttcctttgctgacttattttaacagcaggattctagcactaggtggaaaacgtatatgagtttctgatgtgtgtcaggtactgtcctaggtgctgaggttataatagtgaatccaacacaatctctgtcttcatggagcttatgttctcatgtgaatgtttttacacttcagagtttttatttggttgagaaaagacttgaaatataacatccaaaaataaaatgtcagcctggtgctgtggcgcacgcctgtagtcccagtgctttgggagaccaaggatgggaggattgcttgaggccaggactttgagatcagcctgggtaacatagtgagaccctgtctctacacaaaataaaatagccgggcatggtggcatgcgcttgtagtcctagctactctggaggctgaggcaggagaattgcttgagcccaggagttcaaggttatagtgaactatgatcgcaccattgctctccagcgtaggcaacagagcaaaaccctgtatcaaaataaagtaaaataagcctgtcaaacccaaaccaaatacatgtcaaacccagacctgattcttaccacacactatgccttctagtaaaattctggcctttgaataccaacaaaatacttcataacctgggaaaccaactactctaacgtttgttgctctgtcttgaaatactaaacaaaaccatttacctgttcgtagacatattttctttttctagtttaaaagtatcccattctgccattttccacctagtgctagaatcctgctcttaaaataagtcagcacagggaaataaatactctataaagagaccaaaagacctttcaaaataggctatggccaggcccagtggctcacgcctataaatcccagcactttgggagtctgaggtcggaggattacttgagcccaggagttctagactagcctgggcaagatggcaaaaccccatctacacacacacacacacacacacacacacacacacacacacacacacacacacacacacacccccgctacctacctctctctggggcatgcctgtagtcccagctattctggaggctgaggtgggaggatcccttgagcccaggagtttgaggctgcaatgagccattatgacaccactgcactccagcctgggtgaaagagccagaccctgtctcataaaataaataagtaaataaataaaatatctaccttaaagcagcaagttttgtatttgatgtaatgaattaacagaccgctttataatatctatcttttaggatagtgtcagtctcttggaatgctgtgcatgagtcatcattaaaattggttttcattaaaaaaatttttttaacatatacacatcttattggagttttcttttaaaattcaaaaatgggaacattattttttcaaagccaagtaacagaagagtatataaaaaagtcaattttgtgcatatctttttacattttctatgctcatgtaaaacatacatgacttatgtaattatacacatatgctccagatctcatctgtattaattttttaaattatactttagttctgggatacacttggagaacgtgcagttttgttacataggtatatatatgtgccatggtgatttgctgcacccatcaacccatcatctacattaggtatttctcctaatgctatctctcccctagccctgcacccctgaataggccccggtgtgtgatgtttccctccctgtgtccatgttttctcattgttcagctcccacttatgagtgagaacatgcggtgtttggttttctgttcctgtgttagtttgctgagaatgatggtttccggcttcatccatgttggttttcatttttgtgatagttaattcttggacattaaggggaataattataaaacactgttgcttccatatcaagggaaatcactgaatgattaaaaaaaacccaataagtgttgtctgattgtttaaacagctttcattgaggtaaataagtaaaacaaagctgtgagaagtagggaatatttaaacaatttgtgcgcatgccctcacctttggggagaagtcttttctgaaggctctcttctgattttttgaagcaactgtttaatcattaaagaaaattataggtaaaagacaaattcttgtgaactttcgctcattgctagattattaggcagaactattttttaaaaatttaaatgaaacaactttatatttttacatctttagatcatatcattttgtaactatactttagggaaatagaggccagcatattaaaacagtaactaggggctgggcagggtggctcattgcctgtaatcctagcactttgggaggccgaggcgggcagatcagctgaggtcaggagtttgaaaccagcctggccaacatagcgaaaccccatctctactaaaaatacaaaaattagcaggagaattgcttgaaccggagaggcgaaggttgcagtgagctgagatcaggccattgcactccagcctgggagacaagagtgaaactctgtctcaaaaacaaacaaaccaaaaaacaaacacacacacacacacacacacacacacacacacacacacacacaaacacacaaaccagtaactaggactaactatatgctgttttagattgacagtattctttttttctaaaagagaatgaatgccagcagatgtaggaagtaccagagctaaaccattgcctggttaaaaggagtacctctgcataatagttacttgttgactcttttgtaataaaatatttcaggcatgtaaaactagacagttacccaagaaataactgtgtatccaccactccgtataagtaaaacagcccagctagagtgaaagcctgctatgtccccttctctggtcccattcccctccctccctaccctggagttaccagagtcctgaatttggtgtgcatgatttgaagatttctttctacttttattgtatgtatatgtggatatatatatttgtgtatatataaatcactaaaaaagatattattttggatgtcttttcaacttaaggaatatcgtattctgtgtaaccttctgcaacttgcttttcctctcattgttttgtttttggaattcatcttgttgacacatgtaatttcagttcatttatgtttccttttaaaaaatctttactacttacgtttacaatgactcattgttacagtgcggtagagacccttatgccaaaaggaagtaggtggcatttttccttatttatatagaatgtcacatgactgggggactgttcgaaacgtgtatgaaaattaagaacaccttcatagatagcagaatgcacacttatattcttgagcgtgctaggggatgtttgagctaattaattgactttcatgggctttctttttttctcatcttttatttttttgagacagggtcttgctgtgtcacccagactggaatgcagcaatctgatcatgactcactgtaccctcaacctcctgggctcaagcaatcttcctgcctcaggctcccgagtagctgggaatacaggtgtgcagcaccaagcctggctaattttctttttaaaaatttgttgtggagatggtgtctcattatgttgcccagcctggtctcaaactcttgggctcaagtgatctcccgcctcagcctcccaaagtgttgggattacaggtgtgagccaccacaccctgccatttttcatctttttaaaaatggaacatctcaaataagcaagtagatagaataatgcattaaaccctgctgcacttgccactcaggcccaacaactgtcaatgcaaggttaattcaattccatctacatttctatctttgttccctctcacctttgttatcctgaagcaagtcgcaaacatcatatggttcatagggcttatctttaaggaaggaaccagggtgggcagaaggaaatggaaacatgcaggggtttaggttggccagaaaaggtacctgtggcctatggtcaaatggcaagactgatgatggttcaatactgtcaagcctttggctgtcatggagatagacgtgcttgagaactgatttagaatagttgggaaacctgtagggagattgaaaaagtaaccaactgaagaccaggaatacaagatggatttgaatattgttctagcttcacactcctaagtaggggctgtcctattttaagggtgtagacaattggttttgaggaaatcttgggttgtttttgctaattatttataactttttttttttttttttttttttgagacagagtcttgctctgtcgcccgggctgaagtgcagtggcgcaaggtcggctcactgcaacctccgcctcccaggttcaagcagttctccctgcctcagccttctgagtagctgggactacaggcgcccaccaccatgcctggctaatttttatattttttagtagagatggggtttcgccatgttgactaggctggtcttgaactcctgacctcaggtgatctgcccaccctggcctcccaaagtgctgggattacaggtgtgagccaccgcgcctggcctatttataactttaaaaagagggtttggttcctttccagggtttttcaaactttctgtttgtttcgtataggcaagtttctcatgttttgtattgatggcattctattattcatacctatctgttggtgggcaactaatcaacctgggttgcgcaggactgaaggatttcctgggggcatggaacttcagtcttcagacagtcctaggcaaactgggatggtcaccccctctcttggttgctgcattagttatctattgctctataatgaattaccacaaacttagcagcttaaagcagcacacagttattatctcccagtttctgtgggttcgggagtctggacatggctcagttgggtcctcagctcagagtttcataaagccacaatcaaggtgtctggagcttggagtcctctgtggaggtccaacacttggttgcagaattcagttccttgtgattttagaactgaggctctcaacttcgaggcttcctgcagttccctccacatggccttctccataggcaattcacaacatggctcttggcttcttcaaggccagcaggagagtgtctctctccagttagctcagacacctttgccatagtccattagttagaagcaagtcacaggttttgtctgctctcaaggggaggggattatacaaaacaacagagaccaggaggtgagaattttgcgggggacaccttaggatctttccaccacacttgctttccaggatttgtctgaagtagaaaattattctgttgagcctttttgtggccagaatatacatatgttttgctcagccactaatttagaattcctttatctttttaagaaacattttcatgcgtaattcatcctaagtagaactggcaaatatgtaacttcttaggtattttcaattttagtctttaggcaattgtttttcctcttaactagtaggaggcaggaaaaaaaagtggaaaagcagatgcaaatgccctgcctggctactcctgcacgcagtgctctaaagcaggccttctcagcctgggttagttcaggggtctgtgaatttagatgtggaaaagaactacatctttttttttttttttactaactgcccttcccccaactgaaattgagcacttccttctattatgcatgtaagcaaaaaaccacagcagtttttttttttttttttttttttttttttttttttgagacagggtcttgctctgtcacccaggctggagtgcaatctcacaattttggttcactgcaacctgtgcctcctgggcccaaatgatccttccatctcagcctcccaagtagctgggactacacgtgcatgccaccacacccagctaatttttgtattttttgtagaaacgggattttgccatgttgcctaggcaacagggttcactgctttcggtcaaatgacagcaatgctgctggcaagtccatggtcaggagtgagattccctcaggctgctgtggtccctcctcctccagtctgtcctgcaggaagctcagagtgaatggatgctcagctgtttcctctgagacctcaccagggacagttcctgcagtcccggctctgagctctgctcctgaccgttttatctggccctctcagctgtgcttcactgcaaaggaggaaggacaaggccctctggagccagtgccagctgcttgtggggcctgttttatttactactgctatctctacttcagagacttgggctaggacatagacttgaagaaaaaagccattttaacagacttgagaaactcagccatcctcataataccattcagaaccaggagaggccattattaacactaggctagtaggaaatgttcactttgactgaattcatttgtaacactttgccactggtttacaagaaaaatactttggttcagtctcctggaggtaggtaattaaatgtttcacctgtgctaattttccaaataattaaagtgaatcccataaatgccagcaattaagaattgttgtttttggccaagtgtggtggctcatgcctgtaattacagcactttgggaggttgaggcgggcggatcacttgaggccatgagtttgaggccaacctgggtaaaatagggagacgctgtctctacaaaaaatacaaaaatcagctgggcttggtggaatgtgcctgtagtcctggctacttggtaggctgaggcaggagaattgcttgaatccgggaggtagaggtttcagtgagccaagattgtgccactgtactccagcctaggcgacagaggcgagattctgtctcaaaaaaaaaaaaaagttgtttcttaagtgcagaccttctgagatgtgtagtgcttgccccatgccttcaaaagaacatatttaatacaataatctctttgtctctcctttacttcaaagtcagccttgtgaaaaacagatgatgatataccaacagttttttgctcttggaggtgtttggtgtgctctgctttttgagttttgttttttggacttctttaaaattattttaaaatgttttaactcctctcctttgcatactctctggtacccttatagtcccaatactgagtaaagcatgtaaaatttagcatgcagatgttttagcctcttttattttttgttcgagatccagattttttagtctcagcatgactgacactttggggctgtatcattctttgttgtggaggactgtcctgtgcattgtaggttgtcaagtaacatccctggtctctacccacaagataccagtagctattcttctcctgattgtgacaacaaaaaatgtttccagacattgtcagatgtctcctcggggcaaaatttagttctacatatatgatgataaaaaccatggtagcagccaacatttgttcactatcatccccattttgaagaaagcaaaaacggaggcactgagggtgaggttcacttacttgcccaaggtcacatagataaaagtcacttcttgaaatacttttcataatatatatgggttgaatctcagtcttaattgaggaggcagactaaaaaagaatgtaaaaacggggagtttcctgatgatgtctcaattgagaggctattgctttcatagtgattctgtgtaaatgctggaattcttgcttaaacggggtgattccatgggcatgtgtctgagtaaaggacttggatcatttctaagaagcttctgtggcatggtgaagcagaacataagacagtctaggatcaaggataactgatcaaactttgaaaccaaggaagccataggaaattggggtaaggctatgtatcacttagggtcccacaggaaatggcatgctcaaagggttttagtgaaaacaggaatgttgaggcacgaagggactagcagcaggaagctattgccattcctagacctggtggggcaaagggaggggagggaatgtcgttgctggagctgtgaaaggtactccctctacaggaacaatagtcatgaaagaatacagcctttgctagaactatggccagagaggggccagtgggatgaggggatgggagagaagtaaccaatttctgtttcctgccctctcatttgctgcagtgccttttgttgttctaacccaactagaagccacaggtaacagagcctgggtgttgaagcttattgaggttagcctcttgcgctgagtggatggaaagggctgagagtggttcaagggggcaaatagagcaacagccagcacaggctatgagcaggagtgggaaacactaccctggatcctaggaaggatggggcatggccagtgataggagcaatgaaagtctttttgtgtgaaaaagagcctggggatacagacctccatgaaggagaagagagggttggataggagtgactggttcatctgaggttcttcctatttctccaaggaagccttgaggaatgtggggttgtctgtttgcatttggatatggaagtatgtgtgtgtgtatacttttatttattttgagacagggtcttgttctgtcacccaggctggagcacagtggcaccatcacagctcactgcagcctctacttcctgggcttaagtggtcctcccacccaggcccccccaggtagctgggaccacaggcatgtaccactatgctcggctgatttttaatattttgtagagacagggtctcactatattcccctggttggcctcactcctgggctcaagtgatcctcccaccttggcctccagaagtgctaggaatacaggtgtaagccactacacccagtctgtttgtatactttttggtcagagtgaggctttccgtgagttggagtgtttgtccttattcatgacactgggaaacatacaacagtggagtgaccctcttgcagattctgctaggagtagctacatatggtgggaaaggttgctatgggaatggagataaattcaaggcagtagagagtgctttataatgtttgggggtatggccaagcattagttttgctttttccttcccagtaggatacgatttctgtagcaattcttccttacccaaaaatagctatatgtgctcccaaaaagaaaaagcccaggaccagatgacttcatggctgaattctaccaaacattcaaagaagagttaatactaatccttcttaaactcttccaaaaaacagaagtagagagagtacttccaaactcattttttgaggccagcatcaccctgatttcaaagccagacaaaagataccaagataccataagaggagaaaaccacaggttagtatctctgttgaacatatatgcaaaaatcctaaataaaatactagcagaccaaatttaacaacacctcaaaaagatgatacaccatgaccaaagtggcacttatccctgagatgcaagattggtttaacgtatataaaacaatcagtgtaatatgccacattaccaaaataagaggtaaaaaacaagccaggtgtggtggctcacacctataatcccaacactttgggaagctgaggtgggaggattgcttgaggccaggagttcaagaccagcctgggcaacatagtgagacactgtctctacaaaaaattaaaaaaaaatgagctgggcatagtggcatgtacctctagtccctgctacttgggaggctgaggcagcaggatcgctggagccgaggattttgaggctgcagtgagcactgattgtgccaccgcactccagttgggcagtacagcaagaccctgtcttcaaagaaaaaaaaagagagaaaaacccatgatcatttcaatacatgtagaaatagcatttgacaaagttcaacagcctttcgtgataaacattttcaacaaaataagtttaaaagggaatttcctcaacacattaaagaccatttatgtagagtccacagctaatatcataatcagtgggagaaaactgaaagctttttttctaagatctggtacaaagcaaggatgcccactcttgccacttttattgaacacagcactggaagtactaacatgagctatcagacaataaaaagagataaaaggcatctaaattgggaaagaagaagtaaaattatccctgtttgtaaatgtcatgatcctatatgtagaaaaccctggactccacaaaagccctcttaagactaataaatgagttcagtaaagttgcatgatacaaaatcagcgtacaaaaatcagttggaaatcaagaaaactgtcccatttatgataacataaaaataataaaatattcaggaatacatttaatgaaggaagtgaaagatctgtacattcaacattataaaatattgatgaaagaaattgaagacacaaataaatggaaagatatgccatgtttatgcattggaaaaattaatagtgttaaattgtccacactacccaaaacaatatacaggttcaatgcaatccctatcaaaataccaatggcatttttcacagaaatagaaaaaacaattctaaaattcatatggtgtgacaaaagacctagaatagccgaaacagtcttgagaaacaaaaacaaggttggaggcatcacacttccttagattataatacagtataaagcagtagaaattatgatagtatatcctggcataaaaacagacatatagatcaatagaatagaacagagatccgagaaatatacagtatatatacagaaatccaagtatatacagtcaactaatttttgacaaggccaccaaggagacacagtggggaaaggatagtctcttcaataaatgatattgggaaaactggatattcacaggcaaaagaatgaagctggatgcttatatacaaaaatcaactcaaaatgtgtctttaaaatatacaacaaaacctgaaaatggaaaagaagacctaaatgttaataactcaaaccattgaactcctagaagaaaacataggggaaaagctccttgatatcggccttggcaatgattttttagacatcacaccaaaagcacaggcaacaaaagcaaaaagaaacaggtggtactacatcagactaaaaagcttctgcatgacaaagggaacaatccgcaaataaaagggcagcctatgaattggaagaaaatatttgcgacccatatatatgataaggagttaatatcaaaaatatataaggaactcccagaactcaatggtaagaaaatgaataacccgattaaaaaataggcaaaggacttgattattcattttcccaaagaagccatacaaatggccagcaggttgtgaaaaggtactcagtatcactaatcataagggaaatggaaatcaaaaccactatgagatatcagctcacaccttttagaatggctattagaaagacaacagataacaaacgttagggtgtggagaaaagagaacccttttatacttttgatgggaatgtagattggtacagccattatggaaaatggtatagaagtgcctcaaaaaattaaaagtagaactaccatatgatccagcaattcctctgctggatatgtacctaaaggaaatgaagtcagtgtgtcaaagaggtatctacactcctgtgttcattgcagcattattcgcaatagccaagatatggaaacaatttaagtgactgttgatggatgagtggctaaaaatatcgtgggatacacacacacacacacacacacacacacacacacacacacacacacacagatgacagaatattattcagccttaaaaaaggagatcatgctatttgtgacaacatggatgaacttatgctaagtaaaataagtgagacacagaaggaaaaatacttcatgatcttatttatctggaacctgaaaaaaagagtcaaatatatagaaacagaatagaaccacggttaccaagggtgggaatggggaggaaataaggcaatgtaggtcaaagtgtacaaacttgcagtgatgtaggctcaataagtctagagatgtacagcaggaggactatagttaacaatattgtattgtatatggaaaatgtgctaagagtagattttaggtgctcttacctcttctccccacaaaggtaactatggaaggtgatgagtatgtcagattgcttactggtagtaatcatttcactatggatatgtatatcaaaacatcatgtcatacatgttaaagttatgccataaaaatagctatatgtgggccaggccaggcatggtggcttatgcctgtaataccagcattttgggaggctgaggcaggaggattgcttgaggccaggagtttaagaccagcctgggcaacgtagtgagaaacctgtctctccaaaaatgtttttaaaagttatctgcgtgtggtagtgcatgcctgtgatcccagctacttgggaggctgaggcaagaggattgcttgagcccgaaaggtagaggctgcagtgacctgcgattgcaccactgcactccagcctgcgtgacagagtgagaccctgtctcttaaaaaaaaaaaagattaaaaaatagttgtatgtgtatatgtatacgttcaggatttgttctatttgttttctttttcttttttttcataggcagtggtcaatggcctaaggatttctttatacattgctcatatccactaaggctctattgagcaaaccacgccttaaaaatcttacaatcctcttcatatattttaaaggcaaatgcaaagaaatagctttgttctgttttgcattcttcatgggttaacatatcttctggaaaacttgttgctatggcaatgggatattatctatcttggtaatgtactacataaaaatagccctttgtgtttgagaatgatgttagtgacaggtggttgggtgaatgtatagcaggctgctttgtcaagaatagtttcccaacattccattgtttaaagttgtgaaatcaaaatgagtataatttttttctctctcaaaatgtaattttatctggaaaaggcaggcagtggtgctctgtttaattatgaattacaagccttcctttgcaggtcaggtcaacatgatgattgaagccacctctcactgtaataagtaaacgacttctctattctttctgtcagggtgtgcagcacaaggttgcgctgggggggccagtagggataattttcccattcttgaacacatcgttcttcctaagcacctcgtacttataaaccaagaagtaggaagtggtcaggtggaagagatgagctctgagctgttaatcaaatccgaatttcttgtaggttcttaggtgaaacagttccttgggaaaggtcagatttccatgttgcttttagtattgaactcacacatatagccaaggatagaatctgacccaaatcttaatttttcctttgaaaaatcctttgggcaatttttttttaatttaatttaattttattattattattattattttttattgatcattcttgggtgtttctcgcagagggggatttggcagggtcacaggacagtagtggagggaaggtcagcagataaacaagtgaacaaaggtctctggttttcctaggcagaggaccctgccgccttccgcagtgtttgtgtccctgggtacttgagattagggagtggtgctgactcttaaggagcatgctgccttcaagcatctgtttaacaaagcacatcttgcaccgcccttaatccattcaaccctgagtggatacagcacatgtttcagagagcaccgggttgggggtaaggtcaccgatcaacaggatcccaaggcagaagaatttttcttagtacagaacaaaatgaaaagtctcccatgtctacctctttccacacagtcacggcaaccatccgatttctcaatcttttccccacctttcccccctttctattctacaaaaccgccattgtcatcatggcccgttctcaatgagctgttgggtacacctcccagacggggtggtggccgggcagaggggctcctcacttcccagtaggtgccgccgggcagaggcgcccctcacctcccggacggggcggctggccggacggggggctgaccccccccacctccctcctggacggggcggctggccgggcagaggggctcctcacttcccagtaggggcggccgggcagaggcgcccctcacctcccggacggggcggctggccgggcggggggctgacccccccacctccctcccggacggggcggctggccgggcagagtggctcctcacttcccagtaggggcagccgggcagaggcgcccctcacttcccggacggggcggctggccaggtggggggctgaccccgccacctccctcccggacggggcggctggccgggcagagtggctcctcacttcccagtaggggcgcccgggcagaggcgcccctcacctcccggacggggcggctggccgggcggggggctgacccccccacctccctcccagatggggcagctggccgggcggggggctgacccccccacctccctcccggacggggcggctggccgggtggggggctgacccccccacctccctcccggacagggcggctggcagggcagagtggctcctcacttcccagtaggggcggctgggcagaggcgcccctcacttcccggacggggcggctggccgggcggggggctgatccccccacctccctcccagacggggcggctggccgggcggggggctgacccccccacctccctcccggacggggcggctggccgggcggggggctgacccccccacctccctcccggacgaggtggctgccgggcggagacgctcctcacttcccagacggggtggctgctgggcggaggggctcctcacttctcagacggggcagctgccgggcggaggggctcctcacttctcagacggggcggttgccaggcagagggtctcctcacttctcagacggggcgtccgggcagagacgctcctcacatcccagacggggtggcagggcagaggtgctccccacatctcagacgatgggcggccgggcagagacgctcctcacttcccagatgtgatggcggccgggaagaggcgctcctcacttcctagatgggatggcggctgggcagaggctgcaatctctgcactttgggaggccaaggcaggctgctgggaggtggaggttgtagtgagctgagatcacgccactgcactccagcctgggcaccattgagcactgagtgaacgagactccgtctgcaatcccggcacctcgggaggccgaggctggcgggtcactcgcggttaggagctggagaccaacccggccaacacagcgaatccccatctccaccaaaaaaatacgaaaaccagtcaggcgtggcggcgcgcgcctgcaattgcaggcactcggcaagctgaggcaggagaatcaggcagggaggttgcagtgagccgagatggcagcagtactgtccagcttcggctcggcatcagagggagactgtggaaagagagggagagggagaccgtggggagagggagagggctgggcaatttcttagagcagtaactctcaaacattttgtcgtcatcatctcacttttcttctacttatcaaaatgagtattgatttaattgtaatgagtaaataacagctccctgctactgaaatgaaatttactctagctttgagaatttgagagaccctcttaagaaaataccacagctggaaatttgagacctaaaagtaatacaatttgagtatctcatatctgaaatgcttgggaccagaagtgttttggattttggattttttcagactttggaatatttgcgtttacataatgagatctcttggggatgggacccaagtctaaacacgaaattcattaatgttttatatacgccttatacacatagcctaaaggtaattttatacaatattttaaataagcttgtgcatgaaacaaaattttgactgtgttttgactgtgacctgtcacataaggtcaggtgtggattttttcatttgtgacttcatgtcaacactcagaaactttcacattttggagcattttggatttcagattagggatgcttaatctgcagctctaattctgatatgcacggtactactgcagagatggaaccattgcctttgtcttttctgttggagtcagtatagatatcttgctactaataatatcagaagagagtgttgagtggtttgctgggtgcccaatactacttttagaacattttatgtattaactaatttattcctgtaaacattcttgacagtttttgtgactatttcccaaatgaggcgtacttgttagcatgtctttctgtttgtggtgagtaagcattcttgtgtattggaagacttgcttactagcatgtcacagtgttcttcatattgaaagcattcttctatcaggagttgacgtaattcagcctgtgggccaaatccatcctgccacccattttttgtgtattttataagctaagaatggtttctgcatttttaaatggttgggaaaacataaaaagaataatttgtgacatgtgaaaattacatgaaatttaaatttcagtttccataaacagttttattggaacacagctttactcatttgtttacatattgctaaggctgcttttgaactagagtggcagagttgagtagttgtaatagagaccatatagctcccagaccctaagaaaaagtttgccaatcccttctctatattcttctgtatctagaatggcagatggtcctcaataataacagcagattggtcaggtgtcatagtttatgcctgtaatcccagcattttgagaggccaaggtgggaggatcacttgagctggagttcaagaccagcctgggcaacacagtgagacctagctctgcaaaaattagccaggtgtcatggtgcacgctggtggtcccagctacttgggaggctgaagtgggaggattgcttgagcctgggaggtcaaggctggagggagacgtgatcacaccattgtgctccagcctgggtgacagagcgagaccctgtctcaaaaatatataaacagattggatttatgtacaggttcatatatatattaattttcttttggtatgcaatatatttttctttcttccactaaacgtttctcttgtcataagcttgatgtcatgtactatggcatatctcaaatatacgtgatttcagctctttgcatacccatattggttttcttttttttttttttaattgatcattcttaggtgtttctcgcagagggggatttggcagggtcacaggacaatagtggagggaaggtcagcagataaacaagtgaacaaaggtctctggttttcctaggcagaggactctgcggccttccgcagtgtttgtgtccctgggtacttgagattagggagcggtgatgactcttaaggagcatgctgccttcaagcatctgtttaacaaagcacatcttgcaccgcccttaatccattcaaccctgagtggacacagcacatgtttcagagagcaccgggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccattgtcatcatggcccgttctcagtgagctgttgggtacacctcccagacggggtggtggccgggcagaggggctcctcacttcccagtaggggcggccgggcagaggcgcccctcacctcccggacggggcggctggccgggcggggggctgacacccccacctccctcccggacggggcggctggccgggcggggggctgacccccccacctccctccgggacggggtggctggctgggcagaggggctcctcacttcccagtaggggcggccaggcagaggcgcccctcacctcctggatggggcggctggccgggcggggggctgacccccccacctccctcccagacggggcggctggccgggcggggggctgaccccccccacctccctcccggacggggcggccggccgggcagaggggctcctcacttcccagtaggggcggccgggcagaggcgcccctcacctcccggatggggtggctggccgggcggggggctgacccccccacctccctcccggacggggtggctgctgggcggagacgttcctcacttcccagacgggatggctgccgggtggaggggctcctcacttctcagacggggcggctgccgggcggaggggcccctcacttctcagacggggcggctgctgggctgaggggctcctcacttttcagacggggcggttgccaggcagagggtctcctcacttctcagacggggcggctgggcagagacgctcctcacatcccggatggggcggcagggcagaggcactccccacatctcagacgatgggcggccgggcagagacgctcctcacttcctagatgggatggcggccgggaagaggcgctcctcacttcctagatgggatggcggccaggcagagacgctcctcactttccagactgggcagccaggcagaggggctcctcacatcccagacgatgggtggccaggcagagacactcctcactttccagacggggtggcggccgggcagaggctgcaatctcggcactttgggaggccaaggcaggctgctgggaggtggaggttgtagcgagccgagatcacgccactgcactccagcctgggcaccattgagcactgagtgaacgagactccgtctgcaatcccggcacctcgggaggccgaggctggcggatcactcccggttaggagctggagaccagcccggccaacacagcgaaaccccgtctccaccaaaaaaatacgaaaaccagtcaggcgtggcggcgcgcgcctgcaattgcaggcactcggcaggctgaggcaggagaatcaggcagggaggttgcagtgagccaagatggcagcagtacagtccagactcccacggcatcagagggagaccgtggaaagagagggagagggagaccgtggggagagggagaccgagagggagagggagagagggagagggagagagggagagggagagagggagagggagagatttggttttcataataatcataaccctttccaaatgagggagagtaatgaattttatcattttattagttagtgtgcttcctttgctagatcaggaattatatctcctagtaattataaccctctatttattatttttaactatattgctttctacttttgggctttcagccaacgtgtaaatattgacagtttaataatctgaaccaagccacctggactgattgtaatattttaatttaataaatcttgcatatggttaagattacatcttctacattcatcagattggatttaatgcactcaccataatcaactctggaacattcttgcaattattattgttatttttaaaggttttctcctttgtctgttgttttcccactttttttttttttttttaagacggaatctccctctgtcacccaggctggagtgcagtggcgtgatctcggctcactgcaacctccgccccctgggttcaagcgattctcctgtctcagcctcctgagtagctgggactacaggcgtgtgccaccacgcccagctaattttttgtatttttagtagagatggggtttcaccatgttggccaggctggtctcaaactcctgacctcaagcagtctgcctgcctcggcctcctgaagtgctgggattataggcgtgagccactgtgcctggcctgttttcccactttttaaagtaacagccttgttgagatgtaattcacataccatatagtcacctatttaaagtgtacaattcagtggttttagtatattcacagaattgtgcaaccatcacaactatttccggaatatttttgtcacccaaaaaagaaaccccatactcactagcaatcacccccagttccaccattcctaggcagccatggatctactttttgtctatggattcgtctattccagacatttcatagaaatgaaaccacatagtgtgtggtcatttgtgattgtcttctttctcttagcgtgttttaaatgtagcacgtatcagcacttcttattgccagttctgctgtatggctataccacattttatttatcaattcatgagttgacagacatttgggtcattttcactttttgcctcttatgtataatgctactctgaacacttgtgtataggtttttgtgtggacatatgtttttatttctgtcgaatatatacctagaggtggaattgttgtgtcgtatggtaactctatgtttaaccttttgaggaactgccaggctcttttgcaaagctgctgtactatttgacattcttgtgagcaatatatgagggttccagtttccccacatccttaccaacgtttgttattgtctatctttttgattatggctatcctagtgggtgtataatggtatctcattgtggttttagttggaatttccctgatgactaataatgttgcatgtcttttcacgtgcttattggccacttgtatatcttctttagagaaatgtgtatttagatcgtttgtccattttaaattgggttgtctttataaaatgttgaattgtaagagttctttatatattctggattcaatacatatgatacaatacatataatacatattttagtcatctatcagataaatgatttgcaaaaattttcttccattttgtgggttgtctttttactttcttgatggtgtcctttgaagcatgaaagcttttaattttgatggagtttatttattgttttctattgtcacttgtgtttttggtgtcatatttaagaaaccattgcctaatccaagatcacaaagatttcacttatgttttcttctaagagttttgtagttttagctcctatatgtcagtctttgattcattttgagttaatttttgtacgtggtgtgaagtaggggtacaacttcatacttttgtatatggatatccacttgtcttagcatcatgttttgaacaaactgttcttttcctaatgaattgttttggaacccttgtgcaaaaccaattgaccttatgtaaatgtaagggcttatgtctagactgtgtcagtatcacactgtcttgatttgtttaatctatttttgaggcagactttcgctccctgatctaaaattaaaatgtttcacaattgatgatgtcttatatgcatcaaaacttgcagactgggtgtaagtggcttgagaaaatatattggagactaaagtggggctgttggagactcataggaatcaaatagttagaaggtgggggagtgagagaggcagtaagttggatgcttcccaggtgtttagcagccatcccaaagtggcagtcaaaaataggctagctttacataatttcaaagttaggtactgatggttccagtttctttttatggattcttttaaaaagtgctgtatcaccaaatgctgttgatggcatagaagacaacactgtggaaaaatgtggacattgaccagtctgagtcaaaaagatggacagatattcagttctaaatgtgaggaatttttaggaaaaccttgagcagttaattttgcttatttccctttctatgtgtatatgaatgataaatgaaaagtctaaaagagctcctttaataagcctgagataaatgctaagtcgtagactactgcatcatatcttatttggcttttttttagtgccacctaaaatactggtgttttagctttgagatgctcttatcctcctgcttccagctctatctacacctcagaaggagctgggtcctttcccagagtctattgtataaattaaccttcttcctgtagtcactctatgtccatctgtttcccagccactttaattttgttctttttcctttctcttgtgcttgtagatttaagtcttaaaaacaagccaggtattattgtttatagtggaattttgagtaggagtggaggttaacctgtacatcaatctagtaggaatattcattcaatcactcaagggatgagcttatggaaaagttacaaaaatagtagcattcctttatattcctcaccctgctcccttaatgttaacattttatataaaggatcaagaataggaaattagtcttggtacagtattattaactaaactacagagcttatttgaattccatcagtttttccactggtggtctatttctgttctaggatcctgtccaggatcccatattgcatttagttattatttctccttagtctcatccagtttgtaataatttcttaatctttaatgacacctttgaagagtacagatcaatattttgtagaatgttcctcaatttgtatttgtttgatgctttcttatgaataaggttgttcatttttggcaagaatataatgatgcatatttttcagtgtatcatatcaaggagttcatgatgttgatgtgtcttgttactggtgacatttaccttgattccttgtttaaattgctgtctgcagggtttctctacagtaaaattattactttttctctttatggttaaaatatcttgggggagatgctttgagactaggcagatatcctatttatcctcaaatttttgtccattgatttttttcattctttggtggatcactctgtatcatagagtatttgtgacaaatatttgattagcagaaataaagctatgccctacaagaagcaaagatcaattacattgaaatcctattgtattggttaatataacgctagcagctgtgttcctcaactttcaggagcttaacacaacagatgcttttcttctcaatatgggcatttctggttgtgtaggcagttttctgccatgttaattcaagtatccagactaaactttttatactgaagtaacttcaaactgacagaaaatagggatgcaagaatagtaccaggaaatcctgtataccctttactagatttacttaacatttgctacatgtgccttatgattttctttgtctattcatatatgtatatgtattttatatatattttatatatctgtatttatatattgattgccatatactaaatcacttgagattaaatcacatacatcatgttcttctatgccttaatagtttaaacttaatatatttatttgtttaaatctagtatacagtttcagaattgctaacccatatctgtttgagaaacactttcactaactggattacagcatttatacaattcttttattctttagttttgcaatatctagtcaagatacgattttccagtttcccactgaagtattaagtttgaaaactgtacataagcacactgttattcaaatttaggaaatttaatatcagtactttagtatgcagtctgtattccagtttcattaattatccccaaaatgttcttcagtggaatattttttttctcctgatacagtatcaagtccaggatcatgtattgaatttatttgtcatgactttttagtttcctttgatctggaacagatcttataagcctttctttgtctttcatgacatcgacattttgaacaatgacaaatttatgacattgttttgtagaatgtaccaaatttgggctgggtgctgtggctcatgcctacaatcctagcactttgggaggctgaggcaggtggattgtctgagttcaggaactcgagaccagcttggccaacatggtgaaaccccatctctactaaaaatacaaaaaacaaaaaaaattagccatggcacctataatcccagctactcaggaggctgaggcaagagaatcgcttgaacccgggaggcagaggttgcagtgagccgagattgcaccactgcactccagcctgggcgacagagctagatgctccatttcaaaaaaaaaaggaacgtaccaaatttgggtttggttgatggctcctcttgtttagattgagattatgcatttttaaaaaaacttttaggttcaggggtacatgtgctgatttgttgtataggtaaattcttgtcacgggggtttgttgtacagattatttcattacccaggtactaaacctagtatgcagtagttttttttttctcttctccctcctgccaccctccatcctccaataggcctcagtgtctgttgttcttctctgtgtgtccatgtgttctcatcacttagctcccacttacaagtgagaacatgcagtatttggttttccgttcctgcattagtttgcttaggataatggcccccagctccatccatgttcctgcaaaggacatgagctcattcttttttatggttgtgtagtattccatggtgtatatgtaccacattttctttatccagtctatcattgatgggcatttaggttgattttatgtttttgctattgtgaatagtgctgcaatgaacatacgcttgcatgtgtctttatggtagaatgatttatattcctttgggtctatacccagtaatggggttgctgggtcgaatggtatttccgtttttaggtctttgaggaatcgccactctgttttccacaatagttgaattaatttacactcctaccagcagtatgtaagcattcctttttctctgcaacctcactggcacctgtttctttttgactttttagtaatagccattcttactgatgtgagatgttatctcattgtggttttgatttgcatttctctaatgatcagtgatgttgtggtttttttttcatctgctcgttagccacgtgtatgtcttcttttgaaaagtgtctgagattatgcatttttgtctggaatactgcataagtgacatgtccttctcaggcaatgcatcaggaggcacatgatgtctcaacccctcattggtgattgtaattttgatcatttggttaaattactgtttgcttaagtgttaactatttttagatatgacgtatcagagtgatcaatactgtgaagcctcttacaacagtgtttagattgaaaaattatgagtgaaaagcctttcacagtcattcggattgaatatgcctaacatgaaatccaaactgtttcaacatttctttcaagtcattttctactatggaaataataatgcatgatttagccatgcctgagttttatttcctcacgcaggcatttatttctttaaaaaatttaatttaaagttcactataaaacttaccattttaaccatttgaagtgtacacttcagtggcattaagtacattcacaatgttgtgcaaccatcactaccatccatctccaggacttctttatcatcccaaacataaaccatatctactaaacagtaactccccaattccttctccagcccctggtaacctcattttatatgccatcacaatattttagaataaacgccaacttcctggggtaagatcatttgacttttgctcccagatcagaactatgataaaaatattatttgctatatactaacagggaaatttctggattttggcatgagttactgtattataactctaaatcctggtaagggaagcatttttattctgaaagtaaacaaaaataaccattagtatgataatctttacctctgggggtggggtattttggagggggtgagtacaaagagaggtgaaattattcctctagggtggcagaccagagtttaaattgtttcttatgtttttcatcttggttgtctaccaattggatatagtcactcagatcatccatgtttttgtacctggtttgataggtataaatacctataaattggaataaattctagcaattagaggtccatgttccttggtctgtaaagtgaatataacaaaactgacttctctccaaagggtgctttgagacaaaactataaaacactttggagagtagaaggggggtccttatttttagtaacattcctcagtgttcttcaagaactcacctactgccaatcattcctctgagttaagaatatatattagaactagttttaatagcactataaactatagatagcatggccatatgtccctgtttgcctggagctgaataaattacaggttcaaaaatactcaaataataaaattgcctaggtggtgacccacctagtttgttgctgtatggtgttgggtatctcttttttttccttgacaaatttgaaaaggccttgaaaccatgagcagattccttggttcagatggtctgtaataggagacaccaggacaagcctgagtctcctgctcttgaaagattagcatattgatagattgcgtacccattatcagttaggtatctgccaaaccatttgcagcgtttctctggagttcatacagttgggaagacttcctagaggcaagaggtcttttacctgaagattcagcagttactataggggccttcttttggcttcttgctcttgggacacctttacttgaatgaggtagtcttttgccattagtgcctgtggggccttaatgattcctattgggatgagttggccagaagtgaggctctccacttcatgttgaaactaacttctgcctgagtattaaggatgggtgattctgaggtcctgagccagctggaaggactttcattcactttctactcttgtctgaagaatgcttaggctaccttactgttacttctctggtggtaccaaaggccatgtaatgacatggctggatgcgatcactcacgtctgtaatcccagcactttgggaggccaaggcaggaggatcacttgagcccaggagttcaaccagcctgggcgacataggaagacccccatctctaaaaaatttttaaaaaatctagctgggcatgttggtatactcctgtagtcccagctactcggcaggctgagatgggaggattgcttgagcttaggcgattgaggctgcggtgaaccatgatcacaccactgcactccagcttgggcaacagagcaagaccctgtctctaaaaaaaaaaaaaaaaaacaaacaaaagatgtgatgattgcctctttcggttatatcctgctgcctaagagcccaccccagaatttagtggcttaggataaccattttcatagttttgtcagtgagggattagggaagatgtcagctgagctcttcatttctgctccagatggcattggttgggcaatgggactggaggttctaattctaagatagcttcttcactcttatgaatagctcctcagtgtctgtggccagtctctctccatgtggtatctcatccaccctggcctttccacatgccttaggcttcccacatcatggtggttcctgggtagttactcttcttacagagtagggatgaaatgaaagcctctattctaaattcagttaaatactggtacaaatatttagtactgggattgtgggatcattttcttatatcataattataacccaatcagggtagaaaagtgaaagaaagaaggacacttcattttctttgctctttgtgtggatgatgggttgtacaaatagcaggaggttcaacttttggcttgttttggattactgagtactatccttcagaaatgatttcctaatactttcccggccatctggcatgagcacagaagaccttttactcaataaaagtaagctaataataataagttgaaacatcttgataataaatatatttgtacagcttttcaaatcccaggttattgaaattctgtcagccttggctggtttccatgctccttctgtgcccttgtgtttcctttttttctttttttttttgttgagccactcctgctgacttccaaaggatgctctgagctctaaaaggaggagcagttttgctggcatgcagaagtggtgaaggtaaggcttggattcaattacagtaatctcagaagttcttggtagaagaggggcacagaatcccagcctccattttgcaggtaaggaagaagaattataaaaagataaaatggcttttcttaatgtcagcatctgattctttaccttctttcaccctagcaaagattgttaacataaaacagatgttccttggacaagagaaaagtaatagagctggatcttttcatgatcctgcatttattatttgtagcactggatctctaaactaggaaaagcaatgtcgattctaactagaaattatggggcatttaataacacgtgaggcaaaattatgaggaaaggcaagaaaccaagtggctcctagcttctaacaccttattttctatggtgtaagttaatgaatgatccatttttaatgccataaaaaaggaaatttccgataggctttaccttaacttcacgttgctgtttatattacagacaaaatgctaaagttaacaagtgtaaaatgccctaggtcagggtttcgagtgcccataagcaattctctagaattattttgagtgctcagattatagatttgcccccataccatatactgtattacctatcactgcaagattctttatagggtgtcaagtatgtgggaggatttaaactaattgtcttaaatgcttcatgggataggagatgatccaatgggaactgaatgttttcaattaggatgtttccatggatactattaagcatgccaagattcatagccacaggagatttttacttacttcaatattgattaagaaatctgagaacaatctcaagaagtgtaggatgtaggcggaggataaattttgaggatagtctaaaatttgctttctcttccatagttaaggcctagtccagaaaaagtctaggcagtcagccaagtctaacagcaggatttatgtcaagagaatgtccagaataaaagtgaacatgggttgtttcatttaccccaggtgtatttattaacatttatttaatgttacttattatttgtttattaccattagctttcttatgtactcggtacaaagcattagaattacaaccctttgtatctttgttgtttatgaggaaaacatcctaaatagtgtctacagacatcttaaaattcacattcctctgagaaaggtttatcccttaggttattacttttttttttttttccacacatgggttttttacctgggttctcagatctccaagaaatcggtggatagaattcaaggtgacttcttggatggagaaaaagtacgtctttattttgaccaaccatggatatttagcattttcatcaattaatgaatgcaggtgacaaatcacagtactattggccccatctttgagtttgtcctcaatagctcacagatattttcatattgtatcacagttgttgcagatatcttgaaatattgtttattctaatcactccttcaaaatttgggtggttattggcattatcaccagttttttttttttttttgaggcagtctttctctgttacccccaggctggagtgcagtggtgtgatcttggctcactgtgacctctgcctcccaggttcaagtgattctcccgcctcagcttcctgagtagctgggattacaggcacatgccaccacggcccggctaatttatttatttatttattctttattttttatttttaaattttttttagatggagtctcactctgtcgccaggctggagtgcagtggtgtgatcttggctcactgcaacctccgcctcccaggttcaagcgattctcctgcctcagcctcccgagtagttgggactacgggagcgtgccaccacgcccagctaatttttctattttaagtagagatggagttttaccatgttggccaggatggtcgcgatctcttgacctcgtgatccacctgcctcggccaaaatgctgggattacaggcgtgagccaccgtgcctggccacattaccaccagttcttgatacttaatgccataacaaaaggcacatgtatcactatatcacaaattagcattttataatattttaataacgttttcaatataagtggcttcccttgtaatcatatattttatttttgcacttaaaaatataattcctaaaagggatccataaagcttcaccagactgccaaagcgtccatggcacaggacgttaagaaccctgttccaaatggaatgaagattagaagcactatcatatgttcattttctgatcgcagtttaagaaagagtttcctacttaagtgcttttcacagaaaatctaaacttaaaggttaaaagggaattcttttgtgctggctcatgtgtgggccctacaaagtactttgcagtcatatctgactttcgtttgagagtttgtcttcagaaatggaagaagaaaaggcattcaggtatatgacaggttgcattctgtagaacattgttaaatctatgggaggggagaaaagttccattcagtgtcttgtggattgtggtaggagtcagttgtgttcttgcagaaatttccctagacagtgcctcttgcctcctcctttcttgtcccacagtactccatggagcagatgtgggaacttggatgcctgatgggaattgtaaccccatgctttgccttatcctggtggggactgatctgaggtttatccattaaactgtatcagttcatggctgggagtaggaatgcagaaaacacaagcaaaatgactgcaggaaggtttaaataaaatctcatatgtggcttttccttaacacattattttgcaaaaagtggcagagtgaatttgctgtgatatgataggatcattctggacttttacttaatttacgtgttctctagcagaatgctgaaggagcacacataaggagtggggagttggtatttggttctgtgacaagtgctatcttataacagaaaaatacatatttttgtgaaacttcaaatgcatttttattccccagcacatctgtgattctggatccactaccttcttccaagtgtgatcaagcactgtacctgacagtatcgattatccttacccgtaggcaaaaattgtattacatttattttacagtgatctggaaaaaaaaggatgacaacaaaaaccagacacacttcatttctattccggtaacattttttggtaataatttattactgtacaagtcacacaccatataagtcacacatttaaagtgtcaaattaaatggtttttagtatattcacaggatcgtgccatcatcacagtcaaatttagaacacttattacccccaacaagaaacctcatacgctttagcagtcaccctccattgccccccagttttctaaccccaggccctaacaaccactaacctactttctgtctctatgaatttgcctcttctggccatttcatataaatggaattacacattttgtaaccttttgtgactggcttttttcacttagcataatgttttttaaggtctacctatattagagtatgtatcagtactttattcctttttatggccaaataatattccattttctggatataccagattttgtttatccattcatctgttgatggacatttgagttgtttccactttgtgctattattatgaataatgctgctatgaacattcatgtttacatcatgtatacattttaatgtggacatatgtttttagttatcttgagtatatacctaggagtggaatcatatatatatgtttttaaaccaaaatcaaattttaatgttgcagaatccctgaagcacttttaggaactgttcacttccatagaacagtttgcaaatcagtgttaaagtggagagagtgttgatttttttgtgcatgtatttggtagacatcgtttgaatcttgattttataggctgtgtgaattttgtcaagttacctgtgaacatctttcttctagtatagaatgttagtacctctggatgtttcacgagttgatagactgtattattgcttgaaaaattcactgtccatttattaccatcaactttggccacggatttgctttggctagtggcctgtgaggggaagtgatgtgtgccttcttccaggcagaagctggtggtttgcctcatctcttttcctttctgccatgatgaccattgatgttccagttggacacaggctccatcagcttgtgtatcagaatgaaaatgatgtggggcagagccctcatagattttgttgcatgagtatggaaaaagtgtcattttaagccgtcaagatttggtgactatttgatactttagcacagtggtcctcaagcaatggcagttttgcatttctcacactgagatatctggcaatgtctggagacattttttggttatcacacatggggaagtgctcttggcatttagtgggcagatgctgctaagcatccaacactgcacaggacagctcccacaacaaagaattatctgatccaaaatgtcaatagtgctgaagtttagaaaccctgctttagtataacctagtttatcctggttaagatagggtgttgagaagattaaatggaaaaaaaatatataaaatacagcacacagggtggtctttttttggtaattatgtgacagagcttggcaatggctctgaggtcttcccttgcatttgtgggtcttttccaacttccctagggttcagtattcagtttaattgtagttgtgtttataaatcaaggctcgtttttagcagaatcatataccctttaaaaaagggggagaactaacattagatgcctgtttggcaccaggctctttgtatgtgttttgaatttttacagatattctctgaaactgatattccttacctccattttgttttgttttgttttgttttgttttgagacaggatctcactgtgttgcccagactggagtgcagtggtgcgatcttgtctcactgcaacctccacctcctgaattcaagcaattctcctgcctcagcctcctgagtagctgggattacaggcatgcgccaccatgcccagttaatgttttgtattttcagtagagatgggatttcgctatgttggccaggctggtctcttaacttttggcctcctgtgatcccccagccttggcctcccaaagtgctgggattacaggcatgagccaccatgcccggccctccattttgtttttgatgaagacattgaggcactgaagttaagtaatttgaccaagatcacatggcttataagtggtgggcctagaattcgaagcacatctgtttgcctccagaaccctcttctttccacactgctatactacctctttagcagtgactttaacatagagaaatgaaggtaatacctgatttctaacaattatgtgttgtattagttatctattgctgtataacaggttacctcaaaacttagcactttaacacaacaaacagttattgtctgacatagttttgagaatcagtaatttaggggaagctaagctgggtggttctggctcaggatctctatggagattgcaaacaagttgtcttccagggctgcagcgatctgaagacctgattggagcaggaagatccacttccattgtggtgcactcacagggctgttggtgggaggcctcagttcctcaccatgtgggtctctctttagggttgcttgattgtcatcatgacatggcagctggcctccttcagagtgagggatctcagagagacagcaaggcagaagccacaatatcttttgtgacctagccttagaagtcacagatgatcacttctgctcttttctattggtcacatacacaaccctgatataatgtgggagaggatgatacaagggcatcaagaatactatgagatggaaatcactgggggccatcatggaggctggttactacatgttaatgatcctcatttgccatagttacaaaattatgaattatatttccttttcatattctaatattccaaacacctgttttgtactttaagatacttaaatcatttagaatgtgagtgaaaatacaaattggcttttgtaaacacttactgaatgggtaaaataaaggccgtggtacagatacttcattggggaattttttttttaaataggtttgactagctgaggcttcttgaatcctgaaaagtttggtctgatgtacttttttttttttcctggaaaatctccttgtaccaaacactgaattcttcatttgccaaagtccacccaactttctgatgtttttattgctggtttgatgtgcttgaatgccagccagagtataaggtgaatggtagatgcaaggactgtgcagtttccacggagacttctttcaggagcccttcattttttcattcagctattgctgggaggcatccccttccagttaatgtgtggtacacatcaatttgagtggctcttagaaaggggctcagtttatacaaattaagaattgaggttttttttttctctgtatatcttcaacgttaaattagatttctatgaaacttgaagatgttaacaggaaatcttcctgaaacagtttaactatacttttgtttattacacttgattttgagcttttgggaataaaagtagggtcctggctaggtacagaggtatatggatttactgtgtctaatcgtgcaaccatgaaataaacgtttgcacttcaggaatcaacccatcactttttaaccactgttgtttgcattggcttagagctttgtgcttccttcaactattttccttttttctttcaaaactgtgttcagttggttgtgaccaattttacacagagactggctcactcacttatgttcttgactcctgctgtcccaatatcatgcttcatttacacagggatagcttttcctggctttatctgttgacttgacatcctgtgcatcatatttcttttcttagatatagagaagactgaaaaaaatccacgatttgaagaaaatttgcaaaagtgcagagcaatgtgaaagagatagctttaattttaattttcactgtagtcagaataggtggcctcctgatgggcagacttgctttctcattttactctgtccagtgtagatacccagatcaatcaaggtcaagctggtctggtcattaatacaacttttggttttaaacacagctgtgtacgggggttcttagcattattaatagaggttataatgaaaacaaggtatagtcatacagttgtctgtgtgggtagtggcatggaggtggagttgttgcttaagatctgaaagtcaggaagctggaggtttttgtaattttattcattatcaatcttaagaatttattttgatcattataaatgcatgactggtgctattttccaatcctgaggttttttgggaaatttttttgaaaagaggccaggatgaggataaaaattaattttgaaaatccatttcaaagactcattatgctatgctccatcactgcaattttaatgcaacttatatattgtgcttttacctttgggactagcattcttaaaagctgacttttaatttggactttctaatatgtgtcggctctgtcagctcacgagtgtgtttttatctgtgcatcatgttatattgggacctgggtggaatgtaaatcttttactggcctaaatctgagtctaatcctctgcatggctttggtagaaaatcaatttcctctgctctgtcaagatttttcaggtcagtgctctttggaagtttcccagttctcttagattaaaatagattttgtttctgtgctacatactggtattagttagtaggacactgggatctaaaagcaagagaacagaggcagacaagatatccatgagttcttctatttcagttaacttgttgacacactgcacctttgaggaaccaaggagtttgtgtgctttcaggcatcatttgggggagcaattgtaaatgactcctgtaggtgaggctgtgcacttaattttaatgagttcaggttcattaagtgacctgctcactgggtcattagaagtgacctcactagaagtgaatggtaaagagaagaactacctaagttccactcagcttgtttcactactgtggggtattggaagtagagtgacaacttggactttctcagttttagcactgaaaagtcccacatcccaggaacttactcagtccccagcaaactagggggagcgggggatggttggtccccctagcagtgaaaagtaaggggatggatgatttggaactggttagtacccttatagatttttttttttttttctgagacaggttcttgctgtgtcacccaggctagaatatagtggcatgatcatggctcactgcagccacgatctcctgggtccaaatgatactcccacttcagcctccccagtagctggaactacggggacaagccaccacacccagctaatttttatttatttatattaattaattaatttatttttttgtagggacagggtctcgctttgttgcccaggctggtcttgaactcctgggctcaagtgatcctcctgccttagcctctcaaagcactgggattacaggtgtaaaccaccatgcctggctgtcttataaatactttaaggagggatttattagagacatgtagcaccttgctgcccagtgatgctagtaaatgagtgactctactttgatttgacagaagaaacaatggaaagaggagagatggaagtttttctacctaaacttcctaagaggatgtgtttaggggatgtgttggtaaaaagttattagcattaatgtttacctgtatctttctcatagataatgcaaagacctttaactccacttatccctccttttaacttatgttgttattgccttgtattttaatactatatattaaactctacaagacatcattattttatgcaggcattgtttatttaatcagagttcagtaaactttttctgtaaatgccagatggtaaatattttaacccctgcaggccttatagtctctgtcacaactactcaactccactcttaatagtgccaaaatggctatagacaatatggaaatgattgtgtgtacccatgttccaataaaatttatttacagaaacagacagtgggccagatttggcctgcaggccttactttgacaactcctaatttagatttatctacatatttatttattttccctttatttcttgctatatctttgaggttctacctgggatcattttcaaggcaaggatgtctattctcatcactgtttttcagcgttgtgctagaaattccaaccagtgcaataaggcaagaaaaggaaataaaaggcatacagagcagaaaggaaaaaaaaaatgaaactggccaggtacagctgctcatactttgagaggcgagctaggaggattgcttgagcccaggagttccagaccagcttgggcaatgtagggcgacccccatctctacaaaagtaaaaataaaaaaaaaattagcagggtgttatggtgcatgtctgtggtctcagctacttgggaggctgaggtgggaggatcacttgggccttggaggtgaagtgagccatggtgactgtatcactgcattctagcctgggcaacagagtgacaccgcctgtctcagaaaacaaaacaaaaacctgtctctatttgcagatgacatgattgtctacatagaagaccctgagaaatctacagtctacagaataactcctagacctaattaagtgagttcagcaaggtttcaggatataagataaacatacaaaaatgagttgtatttctacatactagccataaacaaatggacactgaaattaaaaatacaataccatttacattcactcaaaaaatacttgggtataaatctaacaaagcatgcacaggacttgtatgctgaaaactatacaatgctgatgaaagaaatcaaagtctaaatagatggggaaacataccatgttccgggtttcaggatataagataaacttacaaaaatgagttgtatttcacatactagctagaaacaaatggacactgaaattaaaaatacaataccatttacattcactcaagaaatacttgggtataaatctaacaaagcatgcacaggacttgtatgctgaaaactacaaaatgctgatgaaagaaatcaaagtctaaatagatggggaacataccatgttccaggattggaagactcaacatagtaaagatatcatttctcccccaaattgatatacaggtttaatgtaattcctgtcaaaatcttagtaagatttttttgtagatataattataaaatttatatggaaagggaaaagaactagactagctgaaacaattttgaaaaagaataataaagcaggaggaatcagtctgtaagattttaagacatataactacagtaatcaagactgtgtgatattggtggagggatacatgtatagatcaacggaacagaacaaagaacctagaaatagaccaacagaaatgtgcccaattgatctttgacaaaattgcaacagcaattgaacggagaaggaaagatagcctttttgacaaatggtgctaggtcaattaaacatcaatatgtcaaaaaaaaaaaaaaactcttgctgtaaatagtacacgttatatgaaaaataactccaaatgtatcacaaacttcaatgtaaaacataaaactataaaaataattagagaaaatcttcaggatctaaggctaggcagagttcttagacctgacaccaaaggtatgatccataaaagaattgataaattggatttcatcaaaataaaaaatacttactctgagaaagacctcataagaggatgaaaagacagactacagagtggggggaaatatttgcaaactacgtatccgacaaaggactggcatctagaatatataaataactttcaaaacttaacagtagaaaacaacccagttagaaagtggaaaaaatacaagaagggacatttcactgaagagcatatacagatgacagataagcatgtgaaaagatgttcaacataattagccactagggaaatgtaaattcagaccaaagtgagctatcactacatacctataagaatggctaaaattaaaaatagtgacagcatcaaatgatggcaaggctgtagagaaatggaatcattcatactttgctgatgggatgtaaaatgatacagcccctctgaaaaacagtttggcagtttcttaaagacactaaacatgcaactaccatatgacccagcaattgcactcctgggcatttatcccagagaagtgaagatttatgttcatataaatgccagtatgtgaatgttttataggagttttattcataatagcccataactggaaacaatacagatgttctttagtggatgaatggttagacaaactggtatatccatagcatggaatactacccagcagtaaaaaggagtgaagtactgatacatgcaatgatctggatggatctccagagaattatgccgagtgagaaaagccaatcctgagtggtttaaataccatatgattccatttatgtaacattcttgaagtgacaaaattatggagatggagaacagattagtccatgccaggggttgagggggcaagggttgggagtaaaatggatagctataaaaggcatgatgaggccaggcgtggtggctcacgcctgtaattccagcactttaagaggccgaggcgggtgaattgcttgaggtcaggagtttgagatcagcctgaccaacatggtgaaaccctgtttttactaaaaatacaaaaagtagctgggtgtagtggcaggtgcctgtaatcccagctactccagaggctgaggcaggagaatcgcttgaacctgggaggcagaggttgtagtgagctgagattgtgccactgaactccagcctgggcaacagagcaagactctgtcttaggaaaaaaaaaaaaaggcatcatgggtccttgtgagcatgaaaatgttctctattgactgtgtcaatagagacacacaattatgttgtgtgtcacaaccataatcacaacattatggttgtgatattgtactgtagttttacaagatgttaccattgggaggaagtgggcaaagggtacataggatctctgggtatcatttcttacctctgcatataaaactacagttgtctcaaaaggtttaattaagaaagtatttaagaaaaagaaccccaggatctaaaaagatcagagtcagagaatcacaaatgctaaataagaagcacttttgtatttggtgatgttctgaaattctggctcagttttgttatgaaatggagccacgtgggtccatgtgagtgagtccctgtgcacaggtgtatgattgactttttccctcaagtgcttctaatttgggatgttcttcactgtgtgccctttgagtgtctcttgcctctggttttttgttagacaaaaaaaccagtttttaaatgtcagttccaaggtcttttctgggtacggttaacttttatgatttcatttatgcagtgggttttcacctaagggccatggtttctagacactagactcgtttttcccaagcgattcatctctttgcctgtgggatggagagattcattctcttcttctcttttgcagtagaaactccagttttgagctgggcacctggatgcccagagtaaaggttgtactgcccacatttcattgtagctaggtgtgcctgcgtgaccaagtatgaaccttctatttagattaagccacaagataagtggagctatcaattggctttaacaaatatttagtgaataggtaaaataaaatactttatataagagctgtgtgttctgggttgaattgtgtcccccacaaaaagatatattaaagtcgtaacccttagtacctcagaatgtgaccttatttggaaagagggtctttgcagatataattaatttcaggtgaggttataccggagtagggtgggctcctaatccaatatgatgagtgtcctcagaagaaggcagtcaggcacatgtaccctaaaacttaaagtagaataaaaaataaataaataaataaataaataaaaaagaaggcagtcaggtgaagacacagacacacagtgggaaccccctatgaagatgaagatagaagcaatgtatctacaagccagggaccgcctgcggctgcaagaagccaggtgagacacatggagctgattctccctcacagcccttagaaggaacgtgccctgctgacaccttggttttggacttccagtctccagaaccatgggataataaatacatttctgttgtttgaagccacccaatttgtggtactttattatagcagccctaggaaaccaatatactatgcttttgatattatttttaggatgttgtggtttgaatatttgtgtctcccccaaattcctatgttgaaacctagtctctgatgcgatagtattaagaggtggggcctttaggaggtgcatgagggcagagcccttatgatgggattagtgttcctagaaaagagacttgagggagcttgtttgccccttccagtatgtgaggatacagcaagaaagtgccatctatgaggcagagagtgagccctcactatacactgaatctgctggcaccttgatcttagacttcccagcctccagaatggaaagaaatttctgttgtttataaattactgagtctaaggtattttgttgtagcagccccaacaaactaagacatggagtattttaaaaaatgggttgaacattcagaggcttcttaatctgagtccttagatatttggactgactctgccttctttttccagtgaaaagatctcgctgtatgaaacatagacattcttcattgccccaaagcccttccaccttccttatgtttttattgctggtttgatgtgcttgaatgctagccaaagtataaggtgaatggtagatgcaaggactgggcggtttccatggagacttcttgcaggagcctttcctttctcagttcaacagttgtcaaggaaacatctagtttcaattaaataaatgtttgtggggtctgccaatttgagtgtctcttggaaggggatttggttaaacttcttaaacatcgtaataaacaaattcagagcagaggctttttaggttcccttccagttatattaggtttttctgtaacttagggatgttaactagtcctctgtctgaagtgatcagactatttattcatatccagaaaatattatttttgagtcttgtggggaggaaaactgaggcttaaagaaagagaggccaaagccagggagctggtgttacatggcaccagctatatatacatgactatagtccatgctctttagtacgtcctgcaggataagagatccaaggggcctgacctttacaaactgtttacaggctatggagtttgctggctcagcactgtgtgtttattgcttctagttagctattgttgtatcagtggctggagttggtgatggttcacggaaatagtggtgagagtacagattctaggtatatgcaattctaataaatgagacttccctagtgttatctgtattgtgacagcctccccattgtgctctttatcaaacagtaaggtatggtatattgcaaaatgctcacaatactttgcaactcttcccatcaagaggtagagtcagtttctctattcttaggatcttggctgtcctgttgatttggtctgaccctggaatacagtagaaaagaccctgtgtgggttttgatcctaggcgtgaggtagagcttcagtttcttgctgctttgggaactctgccaccttgtaaaaaaagccctggctggcctcctggaggaagagagactatgtggaggaaaatgaaggtacccagacaacccaatagtcaactgcagaagcataagtgaccctcatctgagatcaatggtgcctggctcggatcagtataattgtccagctgaactcagcccaaattactgacccccagagttatgaattaaataaatgctgttgctttaaggcacttaagttttggggtggtgtgttatacagtagtagataattgatacagccaagtttggaagctctggaatgatcagggctcacctttgacctgtcctctataaaacccaggattcttagtaacacagtcctgttaataacagaacttgcctatggcaaatctaagcggaaaagcagtttattggcaggatattgtgtagctacatctttctttaggaagaccagggacaaggcttgaaaactgcacaactagggggcagtactgccagaactacagccagataacctcacagaattggtagctactgaatattggatgcctccacctacaccaccaacattgcctgcattggacattgggtatggggctgctcctggaactggatgttgttcctgtcactagaaaacaatcatctactgttcttgctgtttcacagcactcattactgattcagatgcccgtgtgccacgtgtttatagcagtgcaatttgtaattgcaaaaatagggaaccagcccaaatgcccatcaatcgagtggataaagaaaatatatcaaaaatatattttatatgtgtgtgtgtatgtatatgtgtgtatatatgtgtgtatgtatatgtgtgtatatatacacacacgtacatatatatacatatatatacacacacgtacatatatatacacacacgtacatatatatgcacacacacatatatatacacacacgtaacatttataatacgccatggaatactactcagccataaaaaggaatgaaataatagcatttgcaacaacgtggatggagttggagaccattattctaagtgaagtgactcaggaatggaaaaccgaacgttgtattttctcacttataagtgggagctaagctatgaggatgcaaaggcataagaatgaaacagtggactttggggcctcagagggaagggtgggaggtgagggataaaagactacacattgggtacagtgtacactgctcggctgatgagtacctcaaaatctcagaaatcagcactgaagaacttaactcatgtaaccaaataccatctgttcccccaaagctatttaaataataataaaaacaaaaacaaatgcctgtgtgggtggtgtctggcagagcgtaggtcttgtgcccataccctgattgaaaagaaatcaggaaagtgagaatctgacacttttagcttatttagctgaaagcaggtggaaaatttcataaacactggcaaagggttcggataacaggcagccaaaagaaaaatggcaaatgttcattagtttctgttgtatactctggttagctcagttggttacagcacagttatgatgaagccagcattgtggtttgttcttaagttttattgaaagaaaatagttctgagattgtcccccttacacctgctccctctctcacagatgtgtgctgatagccatttgtaaggccaggcaatagtggggcctaacttgcatctgtctctggctgctaaggtacaaagattatgtgtctttcagttggtgggcccagagactccattcactggcatagtgtgccacataagagaactgaatgaatggtatctgtgtgaatctaaggggttggctaattgcgcagtgaatttggttcatgtaacatttataatacaaattgttgggcagcaagatctttcaatccagacggtttctagtttttcagaatttctctgataacttctctgaactctgaaattcttatttgcaaaaccatctatatagggttcatttaaatattagaaatagtactcataaagagaaaagcataatgcctagaggatgtgtaatagatgttcaataaatgttgatcatttccctcaaacttcttagattcacacaccccaaccagattagaaactctgacacggcttgccctttttgtgttcaattctctctcagttgttaagtgaagacccaatccagttgttaaaataataaatgcacctcttgcctccctgacattctggcaaccttactctgaggaggctggcccggttcgaagctggctgctccagggcactaaagctggagaagggcccttccaccctgttcataactgtggacagtaaactgtatttgggatagaggatcttgggaacaataaggacctagatccaagctcatgcattgtggtgggactgtcaatttagggggatgggtagattttatcagatctgtcagtggaaagtttggggagatggaatagtatctacaggtagttccaggtaggaggaagagatctacctggctcctagggatgtccatcctggcaagcattgctcagtggcaggagttgtaagagtagggaaggtttaggaatttggatatcagggaagtgtcagcaggtagctggggatgaggtgcaggacaaagacagacgagaggaagaccaagccttaaagtgatgagtatctagatagggaagaggatggatgggtatagcttggacacagaaaggggattcagtcatggaaagaggtcagtctgcaatgtaatgtggctatcaggtcacaggagggccaagagcaggacaggtttggggcttggttctggttagtcgaggcagagccccttagaggtgtttggatttgccatggtgatgcaggggacctgagtgtgctggttgtcatgagatcttgttgctgggagaacagtcaagaacagggtagaaaggcccttccccagctttagtgtgccttggagcaggcagctttgaatagggccagcttcttcagagagagctgccagaatgtcagagaggcgagaggtgcatttgttattttaacaattggattgggtcttcactgggagctctacaaagaaaccaaattagtgaagttagattgcctatcccaccaacaatggatgtttatggtatgagtttagctctgtgctagagaatctcaatatatttagatttgggcttgagagagagaacttcagtgtgatctgagactgaacttccattcacattcattcctcgaggaagcatgttgaggatctatgtgtaatatactggtgttccatttacttgaaatatcctggcttgctctattcctctcacttaggcactcactcctctaaaaaataaatgtgtatatgtgtatgtgcatgtgtgtgtacatgtaggtgtaagtgtgcataaaatatggaatagactgaaatcaacaaacttataaaaataccaaataacctcaatctgtaattttatttttgagaagcactaaaaatgtcaataaatgaattgtctgaaaaactaatcctttggctggtgagataagtctgagttgccagaaccagttaaagctttatataatttggcagtacatttgcgttcacctgagatttctctgcctccagctgtacaaaaattctgtgatatgcagagcctcgaaacctgggccagaatgctaaaactaattttctttcgtaatctgagccgtaattgcattttaactcagttctagtgtgaagactgcttttgtatgtgtgtgtgtttacttcatgtcattaatttctggcatttaagttagtgcctggcacatagtctaccctcagtaaatgttagttcttactgccgagtctactgttctttccttctaaaccagtggggtagatgcttcctttgtgcctcagtggttcattcccttgccctcttcccctctcctcacccttgagttgttagatcctggttttgccccaggcaggtgccaaccccgaggaactcctgaccctgtggtgatgcatgcctgcatgtgtgcagccagctgggcagcttggaaagccatagtattgacttgccaaataaggactagtttacaaaagtcataagagatcactgtcatcaactgctatcactatctattatcctttctctttccaaaacacaatttaggtgcataataaaaacatctgtagaattactctgtcaagcctatgtatgcccatcagttgtgcaagagcctcagttcctacttctaatgaattttatactgattatcccagacctttctgccagctccctaatagcagaggagagaatacactgttggagtcaggggcaaccaaagcagctagtctgagtatagaatttctttgaattctcatctttaagaaccatgctcagctgggcacagtggttcatgactgtaatcctagcacttcgggaggccaaggtgggaggatagtaatggcctggtgtggtggctcatttccataatcccagcactttgggaggccaaggtaagcagattgctggagtccaggagttcaagaccagcctgggcaacacagggagaccccccatctctacaaaaaaacaaaaaagtagccaggtgtgatggcacttgcctgtagtcccagctatttgcagagggctgaggcgggaggatcacttgagcctgggaggttgaggctgcaatgagctgtgattgtgccactgctctgtagcctcgaggacagcgtgaccctgtctaaaaaaaaatggatgatatatccacatgattcagaattgaagaggtacaaaacaataaccaataaactctttctccccactgtgtcctagccaccttgttttcttccctggaggcatccagaagccaattttgttagtttcaacttctggagatggcttatgaaaatataagtaaatgcatctatattcaaccccattttagaagaaatgatacctactatatcagctgctttctgtgcaccttgctttttttctttttcacactttagcatgatgatttttctgtattggcacataaagagcttcttctttgttagttggtggttcttatggcagacaactgaatccaccctagatggttaagccaaaaagggattcggattttaggtaactcatggaatcctttggagggctggaggaacaggctagcatccgggtgcccagaaacaaagccccaagacacacgtagtactagcattaagtggaagccacctgtgctgctgcctccactgaacagcagatgctaggtatttgacttgactgcaactgcctctacctccactcctgcaccgggaaggcaacctagcagtgacacctgcaaaagtagaagctctgagcagagcctctttccttacatttctcacttctaaagcaaaatctggtgtggatgtatctgattagtggtgactaggtgacacatttgcatcttagcttcaatagagtctaggaattttattctcaacttttaaacttggaggtgggacttgtaataggtgaaatttttgcaaatagagaaataattttcaaagtatgatggacagtcacagatatggcaaatgtccactagagctgcttagaattccattgtatggatcaaccacaattgattaaactaatatcttagatggtagacctctaagtgttttctagttttctagtctgtgacttaggcaatactgtattaatgaccatatacatgtgtcattttgctaatgtaaaatggaatataaatttctagcagtggaattgctagatcaaaaggtaaattgtaattcttgtggatattgccaaatggtttctggatgctatactgattttttgcttccactagtgatgttcctgattttttttttttttttttttttttgcacagagtcttttccttttttagattccttctgagccagagtggcaggctgagtgttccctgctactggggtgagttttgggccttgggccaagaatgctgacaaatcagatctgggccataacctatgccaatatagactgtatttagcatctggactggatttggcttatagtttattgtagtccttctagccctaaattaaatggcatcttggggtatctaaaagataatgttgcttccaaaattgatttgcaatgtgggagtagcttacatcttggattgttatgtgttcacaaatgcataaagatgttttcaaagaatggttctaaagaattataataccttttctttttaaaaaagcaaaatcttggccgggcacggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagcaaaatcttatttctagtgtgtgaactattgcatagattttgccaatatctgaactatggcatccaattgctctggttggttgccatgaaagtttatagtaacataggaagctcctgtttgaaagctcctgaaaaatttaaacaaatgtatataaatgggtgaaaaatgggggctgaggaagaaggtgaatacatgtgttttcttctcatggaagtgttcactattttttattaaattttttttagagacagggtctcactatgtttctcaggctggtctcggactcctgggcccaagtgatcctcttgtctcagccttccaagtagctgggactacaggcacgggcctccacatctggctgtgtttgcagtctttaagttggcatttacctagtgcagttgattatttcaagaaaatacactttctacatggctactgagggtatctgaaaggatataaagtatagcccagggaagtagcatgttgttaggcaggggttagtaactctttctggaaagggtcagttggtattttaggctttgcaggccaagaaacagaatcaaagatattacataggtaattctataacaagagaaaaaataaacttctacaagctttttattgacaaaattcaaaacataataactgaggacttttttttttggtaatacaggtctactcataagaagaacagcattcttactttggggataacattttgcttaatgggattcaaagaatagtgttccctttcatcaaatcgattgcaaatgttcatctgtaaataccatttattttctccttgtgggccatagaaaaccaagcagtgggctggatttgacccatgagcggtagttttccaaccactgatgtaatggaaagaccatgagctttggacctggatgcatgtaggtttgagtactggctctgaatttgtgaccttgaacatatcacttaactttctgaattgggaaggtttatttgtgtataaactgagtgtaatgacacctatctcatggaaaaaatattacccccatctttgtgattttgcattagtattctagttctgtagatgctgatatgatttagctagacttacctagaaaattagtatttaactgattttaaagctgacttttcaagggatagaacactcacatggtcttaaagtacaatgtaaaaacatagctttgcaatgaagagatctggcagtcaccacattaatcaaatgaccaagctttgcaatcagtaccaatggtgggatgttctgacattgtgtgcccctcactgctgtgtacctctcactatatctcagtatcacctgtgtggtgttcttgccagaaacttttgactttaatgtaatcacaataaaacagacaaatccaaaacatgggatgttctgaggacaactggcctggattcttaaatgattcagtgtcattaagaaccaagggggattgttctagattagggggagactaagggaaaatgagataaaaatgcagtgcatgaacattgactaaatcctggatgaggaaaagaaaattcagctctgtaggcattttctggataatcaagggaatgtgaatgtggaccatatgttgtatgttagtccattttcacgctgctgataaaggcatatccgagactgggaagaaaaagaggtttaattggacttacagttccacatgcctggggaagcctcagaatcatggcaggaggcaaaaggcacttcttacatggtggtggcaggagaaaaatgaggaagaagcaaaggcagaaacgcctgataaacccaccagatctcatgagacttgttcaccatcacaagaatagcatgggaaagaccgatccccgtgattcaattacctccccctaattgttcaagtccctcccacacacgtgggaattctgggagatacaattcaagttgagatttgggtgaggacacagccaaaccatatcatgttgtatgataatattgtgttaaagttgatttccttgggtgtggtgatgatggtgcggtggtgtacgaaaatatccctgttcttagaaggtgaatagtaaagtacttaggggtggtgtgtcatgaggtgtgtctgtaacccacttttcagatggtttggcaaaatgggagggaaggagggagggagagagagaatgtgtgtgagtttgtgtgtatgtagaataggtgattctgtgcattgctgctcagttcttagcatagcactcagcacattgcttttgatagggaggtgcccaaccaaaacttgttaaactaacaagtactttaaggttttagtaggattctctgaaatcacacctcagcactgcctgtctgccctctctttagcagtgtcatttggcttaggcatatactataatgcctaatgttgggtaatcagatatgggggttcatgttttcttgagtagctcacccatgtccctctggactgaaagtctctcttgaatgttacagtataaatgaatgggaaaggaaaacccagcatagaggttgacctgcgtgttcagctgttccctgagaggctgaggtacaatttgtaagcatgtacttcagattctcttctgtatttctgttgctgagtttgcccacttggggagggttgacacctcctggggctgtgctgagtaggaggtgcatctctggagttctgactggctggagcatcactgaggtattctcctgggctatgagggctagggccaggataaagaatggtggatgcctttccttatgccttgatcctaaccggtaccctcttagctgagcaggaagggaacagagaaattaatattctcttatattcctgcaggaactcttatggctatatggtgtgagatgactaaagccaatttagcagctacttgtaaaagtaataaaaatggaggggaagaagaaagattctgatgcaacaggctgtgaagactaattcaacatttatttattgagctactgagcatatagcaggcatagtaaagtatgagtcctgggggatacaaataataagaatataccctcgctttctgctgggcacttagggcatagggaaaggagatgggctacagtggagataattatcaaaataccaattgtgctgtgttgcaaggctagggatgtgttagaaagctagtaaaaagtgttatgggaatgcagagaacatgccatgtggaattgactacagtttcaaagataaggttggtcttgaggtgacttgaagaatgagcctggcaggcaaagaaatgggcatctggtgtgactaaagtcttaattagctgtagggtggggaggagagagacatgacgatgttggaaaggtagtttgggccagacaggagggcctcagaagccatgcttggtttcacaggaagggcgtgaagagtcccagaagccctttgaagttggagggtgatgtggttttgataagaggtcacggagggaatgtagaagctggtgtgtgaaggtgtgtgagtctggagacaggacttgaaacagtcgaggcgagagcaaagaatctggattttgctagctgcagcagagggagagtagaaaatggggtgctcttggagaattcttccagcccctcctactaggagtttttacattttcaaatctttctaaggaaacctttaataatacttgagagaagcttatttaaacctttgaacagttctgaaaatgtattacatttcagccaggaaagaaagtattatttcaggcaaactggaacatggttactcagcacagtcgcctaatcttatagaattaggtaggagggaagctatgttagtggccttcaaccttcttccagaactttgttcagatttctcccaaatggtcggtgaatttttctgatttgtatccagcatcccagccatttagtgtacatccgtaagctgtaaggaagttgatttaatctatttctttttttcatctcttgccttccacctgagaaaacactactccataggttcttattctgtattaggaatttgcacaatgtgtaacctaagatggatccagctgggagttggatccagctgggagtgttacaggtttggagtttagactaaagaagaggagtggaatcttttcatttttttcccctttattttgaggaaagcccagtgatttggattgtttgaaggatcaattatatcaaatatctccactaattgagtatctgggataaactttttttttcaccttattttctttagataccattaagcatttcgacccacaacttacagcttttccatggagattttaaacttagaaaactttgaaccttgatgaatgaaaaaaacctttcagaactaacctttttttttttttttttgattcagaagtccatgtgtaagttccaaaggcttataattcttttctcttccttgaggcttgactatttcagaacgttcttggtatgtctcttggaggtttggtgtacaaagagcaaggaaagtaacctatgggcttaactcacttatgtgtatatattctactttggctccaaagcaatgattctagtggtgatatgggaccaagggacagatttcaaggtaaataaggctgtttactaatgtcagattaaggtattagtcttcaagtaccataaatgttttactagcaatttcagttacctgtagtaaagagctttccagttccatgtggtagttatggtaaaggagcaactgaaagttaacttgatagtagattaacactcactgaaaatatagttgttattttttcacataccaaggattacaatgtctttttttttttctatttttaaaatagagacagggtcttgctatgttgcccatagtcttgaactcttggcctcaagcgatcttccttgaggcctcccaaagtgctgaggttataggcatgagccattgtgcccggcctacaatttcttaatattaggagttattttgcaagacaactatctcaatgttggaactacactaatgttggtgtgtttttttccttgtgtgggatagtctgtatcttaagatgtgtaatgtatatattcacaataagggctacattataaaattcagagacattttatttttgaggtaggtttcattcacttaattgagaatttgttgactgtatcttgggtgcctatccttatgctaggagatgaatggaagttgccccctgccattgaagagaagacattttaatgggaggcagagataaacagataattaattataatgtgatacatttggaaatagtcacaaaaaacttgaatatggagattttcaaaagtacaaagaataggatattgaaccctcatgaacccactaccaaacttcaacaattactaactcttggttatgcttgtttcacccatgtgccccacctcctcccttcccccttttattttgaagcaagtctaagacactgtatcatgtgatggacattaatagatacttggatagagtactctgagaatacactgggaaaacatactgtatcgggacagggaaaggagctacagaaaagtaacatttgagttcaatctaggtggggaggaggatgttgttccaggtgatgggatggaaactgacaattattacaatgtcttgaaaaatgtgtatatacaacttttttgttcctctgaactgagcacccaagatgtaatttccaagattaggaaattgttttgcctgaggactttataaaaataattaattcacttttaatttagataaactagaataatccatgagtagtggtaatgactaatctgttctcttttcaccccagtgactttctagactttgaacattagaatccactccctgaaaaagtcactctcctttgtaactagagcaacagctatcctttgtcacctttatttttctctttggaagaggaggaataatcagtggctcacttctgaaacatcatgaataggtagaatttagtaatctgaattaaaaacctccctgtaaactgaaggaagaggaaattgaccagtgggcacacagaggttctcaagggacttttttggttagccactaggtgaaatccttgatatttcatcatgtaccttgtctcattttcctgttgtgaaattgggtgttcagcattgtttttcttgtctgttctcagatcacagaactgtgtggtgcaaagcgggttggttattttggtccaacacagttttacattgccctgaaattaattgctgcagcacaatctggcctcccggtacggatagagagtattaaatgtggtgagtatctcacatttgtatgttttattgtccatggcgagtcgctcatttatgagaaccatttttaatgagtttaaacttttgtggaatttctccttgcttcctccaactcttctgcaaaataaaataagaaaacttggcaggtaggtagcttagtttctttcttttttaaatggggaaaattctgagagtaacctgagattagttcattttaactgatttgcagttaaaatagattttattctttagcaggaagagattgggccaggaattctagagcctgtggcaaataatcacattgactttaattttccacttgaggtatctataatgttattgaaggctctgttagaggagtaacaagggagtttgagtggaactatgccttttctctttcccatacctgccagtgctcagcctttaattcttagtttccaaagcactgttctgatgctagtaagtacttgggtgctaccaaaattttggcagaatgaatttatcttcttaaggttctgatttaatattttctcatcttgccatccctgccctcaacccactgtatgcttgagcactttctacaatttaaacaaaaagcaaaacccccaactattagcagtatttctgctgcctcaggattggttttaaaaatctgtatgaaaaaggtgattattcaaggggtgtgccaaggtcctctgataattcagtttgatacagattactttcatatgtccatacaggtatgtaggaactttttttctttttctcattctgagactaaaaacctcttaactgctcatgcctgtcctgtgaagtctctgatagacatacaagtggattcaggatttatggtgagcccatggaaacctcgtaggacaatccaaatggccgagaagattgccatagatggctggctgtggaagaccaagcccttcacactaaccgttagcaggtggcagtcatcatgctaatctttatcagggggctagcttgtgccagacactttcatttaatcctcatgacaccctactaaattaggtacttgtgtcagtttgattgcttaggataagctgcgataacaaatgtcacaatctcagtgcctcaaccagacagaggttcgttttccactttgcagtgggtcagggtgaccctccagggcagctgccctctatgtggtgaccatgtgatcctggctgctttatcttgtggcacctcccaacacaacacctgttcccataatcgccacaccagggaaagagtatctcaccctagcggttaaatgctttggcccagacatgactgaagttattgctgcccacactgcattggccagaacttgtcacattaatctgcttcagtgcagagcaggtgggagaacacaattctctcctgtgcctgcaaggagaggacaactgcgagtctctactatggctgcacactgcaagtctctactatggttatggctgcacactgcaggtctctactatggtgctgccgttgttcgtatcttacaagtatggaaatttgaactttagggaggttgagtaacttacctaagaatataaggttagtagaatttggagccaggatctacttccagtccccatgctcttaatttctatgcaaaatagccttgtctcaattttttctatttagtaagatgctgacagtaatctgttatacaatattttctgaatgggaaaaatattggacttgaaaggcatctcttggtatgacagaattttgttctttgaaataggtttcttgatggagtgtcatttgacaggcaggcttagtattcattgctgcaagacacagcggccatttgctttgattagttgaaagttgcatcacactgaatttggatttgtggtaggcactgatagtttttattccattgtaaatgatcattaagctttattatagtatcttccaattttatcttctggaaaagttagagctgctttattgtatacagaataaacttttgacacttttgttacttattttaagttagacctaagtcttttacctgatttgtgcccagattgacagtttaatttcctgagggcagggagcaggattgttgaagttatcacttgtgtaaaggattaacagtttatcacaaatataaggctttctcagttttattttataaacccagttgctgccttttacctctgagagtttatatatgtccagagttaattctgaattatcttccttcaccactctctactaatccatttaaagattgattaaataaaattatttgcagttagcatatgttgaataagaattagggcaagattgggccaaactttgagctgccacttagaattttccagtttgttgcttgaaatctattagcttaatgcttgatgacacaaatcttgaaggccaaagggatcactctgtgagaacctaatctgaaaggctgtgctagccctgtcacacccagggcatcatacccagggagttgtggatggatacccttatgtcatgaataacatgcacctgtgtgtatgtgcgtgaccctctaatccctagtccttcccatttcggtaaatgccaccaccatcctcagctgcacaagccagaaactcagcagccatcctggattcctccttttccctcactccttaatagaatccatcaaaagtcctagcaatgtggctccaatctcactccctgttgcctctatctctttgtccctgctagaccagacaaccttcatctacttacctggacaccacaatggattgacatcctagcccctcctctcttctctactgtgatctctcttttcccactggttttttgtttgtttgttttttgacagagactcgctctgtcacccaggctggagtgcagtggcacgatcacagctcactgcagccttgacttcctgggtgcaagggatcctccaacctcagcgccccgagtagctgggactacaggcatgcgccaccactccctactaatcctactaatttttgtattttttgtagagatggggttttgccatgttgcccaggctggtcttgaactactgagctcaagtgattggcctgcctcagcagcctcccaactttttttttttgagacagggcctcactctgtcacccaggctggagtgcagtggtgtgatcacggcttgttacagcctctgcttcccaggctcaaatgatcttcctgcgtagctgagactacaggcatacatcaccatgcctggctagtatatatgtctttttgtagagatgggggtcttgttatgtttcccaggctggtctcaaactgctgagctcaagtgactctcctgtgtcagcctcccaaagtgctgggattataggaatgagccaccatacccagcctcttttcctacttttgaaagtgtgatcttttcaaaatacacagcagattattccatcctcatcctttaaaccctccagtagtctgcttgttgtactttgtaaaacattcaaagtccctacactgatctgtaacaccctacacaatctagttcttgcctacttttccatcctcatctcaaatcttaaacccttgctcactacctgttccccagtctcagtggccttctagccatttctgggtgacttttcctgctgcaggccatatgtccattttatcttgcagtcttgggttcctagggatctgtttttcctttctgcttcccctggttggctccttcccaaccttcaggattcagagtctgtccctactatcctacctaaagtagttctgtcagattcattaattcatgaaggaaccagcatatggtaaaactggctcaagaaagtatagagagtcagatttatttatagtcatagaaagaaaggatgctggaatagaattgctaaattaggtataaagctaattaacgccctacggggtaatacaagtgcagcctggctattgtacttttttctaagatgaaagtatttgcattgccgtcagacaagaattacttgttagctaacagttttttccaagttaatatctaccctttcaggattatcaaatgcccaaccaagagtaaacagtaactcagagcagaagtccatatccctaggaagtgaggtgatccttgggtgggcctgctgggtaatgcttctgcagggcaatctcctccccactttgttctttcccagcatctgtttcctgatagcacttagcagagtttgcaaatattccttacaggtttcactattttttttgtctgtcttcctcacttgtccagtttgtgtaagggggagggaagaggatctgacaccccttgcattgtggggcattataggcactctgtgtgtattggttgaatgaatgaatgaagaggtgcatgtctacgcatgaggagggtgtcttaatcatctgccactctttaatctaaaacgattggaattcagattctcctggaactccagaggagtttttacagaagtcatctcagtctgcatatcatctttcttaggcactgattttcaaccttgtcggcacttgagaaccacctggagagctttaaatataaaataaaaaaatacagatgcctgggtccatctccagaaattctaatttcatatatctgcagtccggtctgagcatcagaatttttaacagctctccaggtgatttttgtatggagacatgtttaagaataaaagctgcatcaagcatttttaagagctttgcttaaactgtgtgtgtgtgtgtgtgtgtgtgtgtgtgtgtgtgtgtgtgtagttacagtagctgcatctgaactagggtgctgtacgacacagggcacatgatttaagggggcacttactctcagggcaagtgccgactctacatttacaccaccctgagagtgcgtgcctccttaaatgttggcactaggtatctctctagccccaccctcgtctgagttggggttaaacagatggcaaaacagctagggcagaaggaaagaaggtgaaaattaaggactggtagagaatttctgatgaggaaatcatgtggtgaacatttgccctgggacctgctgttacctttctttccagggtctgaagttgagcacgtgtgaggactgagggaaggttaggcagaacctagagtagggtttctcatcatttttgtgccaggagcccctttggcagtctgaagcctgtgggccctttctcagaattatgttttaaatgcaacaaagacataagattataatggaaaccaattatactgaaataatcactaaaatagttaaattgttatataacaacatacatgcttctaggcctggcacagtttctcatgcctgtaatcccagcactttgggaggccgaggtgggcggatcacttgaggccaggagttcgggaccagcccggcaaatgtggtgaaaccttgtctctactaagttcgagaccagcctggccagcatggtgaaaccttgtctctactaaaaatacaaaaattagccgggtgtagtggcacatgcctgtaatccctgctactcaggaggctgaggcaggagactagcttaaacccaggaggtggaggttgcagtgagtcgagattgtgccactgcactccagcctgggcaacagagtgagactatatctcaaaaaaaaaaaaaaaaaccaacccccaaaacatatatgcttctttattaatgcattaaataaagcatctaacagtgtttgaaataaccactactttttcaaattagtaatatgcataaacagtacttcaagatgttggcccggcatggtggctcatgcctgtaatcctagcactttgggaggccgaggagggtggatcacgaggtcaagagattgagaccatcctggccaacatggtgaaaccccgtctctactaaaatagaaaaaaattagctgggcgtggtgacacacacctgtagtcccagctactcaggaggctgaggcaggagaatcacttgaacccgggaggcggaggttgcagtgagccaagatcacgccattgcactctagcctgggcgacagagcgagatgccatctcaaaacaacaacaacaacaacaacaacaacaacaacaaacaaaaccctaatgtgataggtgacaaagttaccggtattgctagtgataatacagtggcttgttgcctacattcataatggaaagaaatgctaaatttcagttatagtagggaaaatgaagttgtaatttttttttttttcctaatcaaggtgacagaccccgtgatttcttttcactagtccctttgggagcctgtgaactctgatggtgcaatgacatgattcatgtagtctttggggctgtgttccccaaactggtttatggtctggttgcagtctggcacagtttagaattaggacaaaaggatgagttatttataaagctaaatgtattcaaatctaagattgggttttttttggttcctcttgttaagtgtcctttgtgaaactgctaatgggtaatagtttggggtaaaattcttgacgagataaaacattggcaactttatgttggctttcttcatttctttttttgttgttgttgggggagagatttttcctattttgtgaaatccccaaatttgtgagccactgttgtggtcacgattctactgccaagaagatactgaggcaaatcattgaattccctttgactcctcccttatctgcaaaacagttgttctccacctaggtgatttcgtccctttagggactttcggcaaggtgaggagacatttttggttgtcccagctgcggaaggggactgcctggcatctagccggtagaggccagggatgctgctcaacaccctacactgcagaggacaggaccccctcttccaacaacaacaaacttatctaatctaaaatgccagtaatgttgagactgagaaagccttctgtaaaataaggatcaagacttaggaactctaatcctgctgccttgcttcctgtgctctagttagtttttttgtttttttaatcatacaagaaaggtagaaggattttgcagcattgagtcctatttctgtggcttttgttttcaaagaagaattattttattcaaggaaaaataaaagcagttattctctggttgaattgagggtggggttccctgtgctttgcctatttgacaaaccctccctatctcttagggctaggagagaaatcttttgagtgtgacaaccagtttggtaattcatagaaaagacaggataggaagcccaagggtaaagaaagaagcccaggaggtaaggttgtagctggctctgtgtgtgtgtgtgtgtgtgtgtgtgtgtgtgtgtgtgtgtccacacagtgtctctgtattttgaacactaaatactatgttgggatgtctcattaagctaaggtcaactcatcctttctgactgacgtccaacccaatccccctttccttttttttcctcagtgttcctttgtcaatttcctttaccccctctcccagccctgctacagggacacagagctgctttggacaaagttcgcctatgcaggttcactgactgtacggctggacatttgtgttttctaggggtctgtccctctaccccatagcgctgtcattagctctattgttgctcctccccaaaggttctccccaaccttttgagctgtggattttcaccttatttgtaaaaatctttgttgtgggattctttgacaatctagtaaaagctctggatcttagcaggaaaatacacattgacattatgtaaaaaatgttgccttcaatgtcaggggtttctggacccctagagctggttcatggagcccagtgaagagcccttcttccagagaaatgcagtgtatgggatggatatagaggaggtaagttggaagatgcatagtggggaaattgaaggccaaagaggtaaaataaaagggatgctgcttgctagcagcagagcccagtggattgtggacctcctaactcactcctggggttctacccgtggtatggccaggaaattgaacttatccaccatcctcctctgccaaacatttacaagatcacccttcccattgtaacctccaccccgccatctagcgattacctacccatttcctaattgacaagaggtatttcagatcaatgggcagataggaggataataggagactagatagctttgattactcaggcctgggttgataagactggcctgatttttttttttgttttgttttttgttttcccccaaagtaacttcaggaaaatgtgtagggatggtttcactttggaattatagaacattattgtcataattctttgttaacgtataagtagctggtataagtgaataggtaacaaaaagcagtgggagagaagggagccagcagtcaggagtcaagaatttttgttacggtcttagctctgccactgtattgctgcatgactaaggcaagtcttgctctctctttcctgggcttatttcctcacctgcaaaatgcagacatttgagcaggttttctctagattattttctgaaatgccacagtttcatgctaaatgttcaaatctgtactagaaagaattttaatgttcaggatggtagtatagccttgtggctgggaatgtaggtcctagcaataggctacctcattatgaatctttccttcattaccttttatttgtgtggcctccggccagtttcttaatttctctgtttcaaatgactccctggaggaaaaggtataccaataacacctgccttatagacttgttgtaagcacaaaatcagggaatcccttatcaaacattgtagaaaagcatctacaactttgttatttaatatcgtagccacttgccatgtgtggctattgagcacttgaagtgtggcagtgtggctagtgtgactgagaaactgaatttttcattaaatgatttaaataaaaggttttaaacagtgtaaaatattttctgttaaatgcaaccttattgatttagtaggaccacttttcacttcaaccatcaaattctgtaagacaagggtcaacaacctttttctttttttttcttcttttttaaattttattttattattattatactttaagttttagggtacatgtgcacaacgtgcaggtttgttacatatgtatacatgtgccatgttggtgtgctgcacccattaactcgtcatttaacattaggtatttctcctaacactatccctccccccttcccccaccccacaacagtccccggtgtgtgatgttccccttcctgtgtccatgtgttctcattgttcaattcccacctatgagtgagaacatgcggtgtttggttttttgtccttgcaatagtttgcggagaatgatggtttccagcttcatccatgtccctacaaaggacatgaactcatcattttttatggctgcatagtattccatggtgtatatgtgccacattttcttaatccagtctatcattgtgggacatttgggttggttccaagtctttgctattgtgaatagtgccgcaataaacacacatgtgcatgtgtctttatagcagcatgatttataatcctttgggtatatacccagtaatgggatggctgggtcaaatggtatttctagttctagatccctgaggaatcgccacactgacttccacaatgattgaactagtttacagtcccaccaacagtgtaaaagtgttcctgtttctccacatcctctccagcatctgttgtttcctgactttttgatgatcgccattctaactggtgtgagatggtgtctctctgtggttttgatttgcatttctctgatggccagtgatgatgagcattttttcatgtgttttttgactgcgtaaatgtcttcttttgagaagtgtctgttcatatccttcgcccactttaaagggtcagatagactttgtgggcagtatgattttggtcacaactactcaaccctgttgtagtatgaaagtagccatggacagcatgtaatcagaggatcatggctgtgtgctaataaaactttatttatgaacactgaaatttgaatttttaattttttttattttttatttttgagacagagtctcactcttgtcacccaggctggagtgctgcagaggcacgatctcagctcactgccacctccaccttctgtgttcaagctattctcctgcttcagcctcctgagtagctgggactacaggcctgtgccaccacgcctggctaatttttgtattttagtagagatggggtttcaccatgttggtcaggctagtctcaaactcctgacctcgaatgatccacccatcttggtctcccaaagtgctgggattacaggtgtgagccactatgcctggcctgacatttgaatttaatataattttcacatcatgaaatatttttcttttttctttttttttttttttttttttgcaaatattcaaacattgtgcttgcgggatgtacagaaataggcagcagactggatttggttcttaggtatacacccaagataaataaattcatgtccatcaaaaaacatttataagaatttcacagcagctttatttacaatgggcccacactggaaacaacccaaatgtttatcacaggataatggattaaaattttcaatatattcttttagggtcttgctctgtcacctagactggagtgtaatggtgctgtttcagttcactgtaacctccaccttccaagctcaagccatcctcccacctcagcctcctgagtagctgggactataggtgtacaccaccatgcctggctaatttttgtattttttgtagagatggggttttgccatgttgcccacactggtctcgaacttctgagctcaagaaatctacctacctcggcctcccaaagtgctgggatcacaggtgtgagctactgctcctggctcaatatattcttaaaagtggattgctccatagcaatgaaaaagaatgaactatgtgtacaatacattgggtgattatcacagacaaaaaggtcgtaaaaaaagcttgtcacaagaacaaatactgtatgattcaatgtatgaagttccataatggcaaagataatctgcaagtatagaaattagtacagaggttgctcggtggaacaaagggaggggattactggaaatgaacatgaaggaaaattctgtatcttaatttgggaatttgggtgttggttacagggatatatatatatatatatgtatttgtcaaaattcttcaagtggaacacttacaattccctataaatcatcccaccatacagaatactctttacataatttaaaaagaaatcaattagttgcttacatttaacattgtaataataataaaatacagtaaaatacagatttctggccacaatggctcacattcccatgtagcaactatcaactagagctgtgctgtttcagtatggtagccagtagctgcatgtggctgttgagcacataaaatgtgacaagcacaaattgaggtatgcaaggagggtaaaatatacatgggagtttgaaggcttaatatgaaaaaaaatgtaaaatatttcattaatagtttttaatgttgattacatgttgaaatgataatattgggttaaattagattattaaaattttgccattaaaaatgttttgaaatggaaaatttttaattgtgataaaatacaaataacatttcccatcttaaccattttaaatgtataattcagtaatgtgtaaatatagtcacattgttgggtaactagtttctagaaccttttcacctcaccttacaaaatggaaactctgtattcattaaacaccttcccattttctttttcctacccagatcctggcaactgcctttttttttttttttttttttttgagtgcagtgacgtgatcatggcttactgctacctctgcctcccaggctcaagagattcttgtgcctcagcctcccgagtagctgggattacaggcgcatgcaccactacacccagctaatttttgtatttttagtagagatggggttttgtcatgttggccaggctagtcttgaactcctggcctcaagtgatctgcccacctcagcctcccaaagtgctgggattacaagtgtgagccactgcacctggcctgcccatctactttctggttctatgagtttggctactcttgatgcctcatataagtgaaaccacacagtacctgtctttttgtgaccagcttgtttcacttctttctttctttctttttttttttttttaatgtggctcacattcttttttggcagataacattgaaagactgtgaacagctgctgccattttgatggaacatgagttctctgcccagcaccctccactccatattgtctagctaatgaggctcaatgtcacttgccatttattattgcatttatgctgtttacattttttctaatggattgaggaaattgaggtatttttttttcttttttgagtgacagggtttcactgtcacccaggctggagtgcagtggcatgatgcagccttgaactctcagactcaagcgatcttcctgcctcagcctcctgagtagctgggactacaggcatatgccaccatgcccagctgattttttatttttatttttttaagagaaggggtcttactgtgttgtccaggctggtctcaaactgctgggctcaagtgatcctcccacctcggcctcccaaagtgctgggattacaggcatgagccaccactcccagcctaaagtattcctaatatatctgtatctctatcaaatatggaaaaacaaaggatttttctctcttgtagagggtcaagtgtttaaaaaggagcaggcataattttctttgtggaagggaaaaatagtcatttatgtttaatatacaaagcatttctgtgttcaaagaatgtaacctaagatgaaacaacaatgaagcaaattgtcatcttggatggccactctcattgtctcctcagaccctctaaacatttagtgtgaactcttactttgtttgctgtgtgtaattcaattcagtttgggagacaagattctaaccaatgactacaaatagaccttcttcttgacagacatcattgtatagcaggtactttattgattaattttttcaaagtttcactattaaattttgtgtatgtgtgactaggaaaaacattcagttgagtatggtgactcatgcctgtaatcccagcactttaggaggccaagacgggaggatcgcttgagctcaggaatttgagacctgtctgggcaatatagcaagaccccatctttacgaaaaataaaaaaagaaattagccagcatggtggcaagcacctggagtcccagctacttgggaggctgaggcaggaggatcagttgagtctgggagttcaaggctgcaatgagctatgttagtgccactgcacttcagtctgagagacagaccttgtctcaaaaaaacaaaaaccaaaaaaaacattcagactgaaaatttacaaactacttttacctttcactttttaaaagcttgcatcagtttaagggaaatggcaccttcatgaaagttttccatgataagaatattattatgtatggttatacttctgttaagtgagagttgcttggaaccacctgaccaaagaaagtatgagagaacttcagctgtattttgtcttttgctgtttggtggctgtctgggggagagaggtggttttctaggcacatagctctaaagaaatgccatagacagggtggaagaatgtgtgaagtgacaatgtcctagacaatatctgggagccctacttaagtcctaatataataattgatattcataattcagttagtgtattccattgttccttggaggtatctgttgaatgccagtaaggcactggtcagggagcttataaatactgagcatttatttcttttctccctcaagaagtacttggaagtagagtcatcctcttatgggtagatcagggtgcaaattattttatgtgatcttgtttcatctttttagatcctttttcctgactgagctggagcacatacctgagaccaaaaccatagagttagcttatatttgatttactaagaatctagagtttcttttctcttgcttttttgcttttgaagcccattcctgctttgagtgctggagagctgcccgagattgggaaacattaagattggttactctatttatgtctcttgggcccttggctgattgatcacacagggatttgtcatattgcctgcttcttttttttttttctggtacagaattttgctcttgttgcccaggctggagtgcaatggcatgatcttggctcactgcaacctccgcctcctgggtttaagcaattctcctgcctcagcctcctgagtagctgggattacaggcgcctgacgccacgcctggctaatttttggtatttttgtgtagagacggggttttaccatgttggccaggttagtttcgaactcctgacctcaggaggtccacccgcctccgcctcccaaagtgctggaattataggcgtaagtgagccactgcgcccggccgcctgctgctttgaatcaaatgtgaacatagcaactaaaagtaaacatcatgtggatgttagagaaccaggggccttctttgcctggggaactctaggatacttgcttgctgttgctaagatgttttctggccttagcacagcatcagtcattgaaagtgcagctgtgtttttggaatagagagctgatggaagtgcaaaggcacactgatgagtattatcctgaacaatggatacagatgcaaatcattatgcataatccataatgtccccatttttgtagggttttgtgctacgtgattgtgtgtgatttgatgtgctgagaactagaagtgtgccaaagtatcatttccgctttcagaatagttttgttagaattttgaaagatgagtaaatataccagaccgttgcttttcaactctttgtagcattttgagtggctaatggttttgacagaagaatgtggctgaatgatagattgattgctctgacttgatattgttttccttattccattatgaaaagacaaccagagattggatgtgaaaattccttaaagaattacataggatgagaaactgttctacccactaagtttgccataggaacaagggaccattctgtagagcactggtaaagtaccagcttgcctgcattcaaaccgtggctctgccacagatgagttgtgtgatcctggggacattacttagctcctttatgactgtttctacttttgcaatgagggggtggtaatgatagttttatcatacagagttgttgtgaggattaaatgagttaatatttgcaaatctttaatactgtgcctggcatatttaagcattatatgaattttacctgccaccatttgtcacttattattgtattatacagtgtcatatcctttttcttggttattgaaggatgaaatgggagatcagtcccaaatctgaatttattctgcgatttggcaacattgaaaaatgttaagccagaatactttggttaaaccatagcattttaaaaatcaggacgttattataggagtactcattgtatctaaatctaaatttatatttagtgctctggaatttttcctcaaaaatgattcatcgtttggccattgagttccccttttttgcagtttttaaattaagtctgactagagcttctctgatttctggtcccaaagaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacaggtaaacagtttgttcagatgtgttcatttgattctgaccatgaaaccgcatgtagcagggcctcgtatctactgttcagcttccagcaaatctcaccatctggaacccaattacagacttggaagtgagccagtaaagttttctcctagcaagaaagagagaccgacacatatgaatcaccaccacccacttaagggccctttagagcctactttaaagtagaattgtgtctaaaataaggctaccgatttaatacatttattgatttcactagctcagtggttttctaaatggattcttggaaatgtaacttccaggagtttttaataggttctcttctccaaaaagaagtctgtagaaaaggtttctcctattataataaatgtgtttggagaatgctgcttcatattcccttgttgagggaaggactaaatcctcagtcttggaaattcgtagtgcacattagcacggtaaaagccctgagaagttctgcagtgaagagacctggaaatgtgtgtttactaaacttctttcaccaggaaattctttcttggggaacatatttggaatactatcttgggaaatgctgccattacccatttagcaggtttggaaccagaacagggaggataggcttttaaaattagaccactaattgcaatggtcagatgatgattggtggagacaacagtataaaatctcagaagagtgggcagatccagaagaagtaaatagtctacacattggtgtaccctgcaggcatcaaggtatagctcatacttccagcaaagatactgaatcatgcagagaagtcaaattatgttcaacatagtgtcttctataaggtaaagaaatttattataggaacacttgaggctgggcacggtggctcacgcctgtaatcccagcactttgggaggccaaggcgggtggatcacaagaggtcaggagttcaagagcagcctggccaacatggcaaaaccctgtctctactagaaatacaaaaattagccgggcgtggtggcatgtgcctgtagtcccagctacttggaaggctgaggcaggagaatggcttgaatccgggaggcggagattgcagtgagccgagatcacatcactgcactccagcctgggccacagagcaagactgtgtctcaaaaaaaaaaaaaaaggaacactcgaatgaaaatgtttttaaaatgcaatgaatattaaatgattatgttggaaaactaacttctgtgacttaccctgtgatgttgtgtagatgaggtgttgctacagaagttttatatggatagttaggggaggtgtagcacatcctgttaaacaattccatgtactgtcactttcataattctgacacattttaaatcagttcttcagggatatatttaaaaaggaagaggtataggaattttcagtcaatattctttggcatattttcccaccagcatttggagaggaatgagggtccactgtcccacggtggttgatgccctgggaaatttccaggcccagtccctgattgtgtgaatgagaatacatcctttcacttcaggctgagtttatgcatgccccacccaatctatgggtgtgagctcatgctttagagcaaacatattttgctttttcttgaagaagagtatttgatcagtatttcagattacatatttctctttagactaagggagcctatatatatagtctgtgtgttgatagaaagcattgttttggctgggtgtagtggctcatgcctgtaatcccagcagttggggaggccgaagcaggaggattgcttgagcccaagaattcaagaccagcctgggcaacatagcaagacctcatttcaaaaaaaaaaaaaaaaaattagctgtgtgtggtggcgcatgcctgtagtagctactgggggtgctgaggtgggaggattgcttgagcccaggaagtcaaggctgcagtgagctatgatcacgccactgtgccccagcctgggtgacagagcgagaccctgtctcaaacaaacaaacaaacaaaaaaaagcactgttttcttggtacttgaatactccaaagttaccagtctactagtaaagttttttttttttttttttttttttaaagaggaaactcagcagcagataaggttgcttactttgcctagggttctacatcaggttcatatttgaattgagattcaaattgtagcttgttaagatttcatcttagtgtttgggagtaagctggttggaatggtttacctataatgaattgttttgcagtctctcattgttaaaaaaaaaaagctagcattttactttgacatggtaagctccaagaatattaagtattaagcatttagaaatatatattttaatattcacatttgctggaagacttgataagtataaatccaggaaataaatttattaatgaatgaaaatgaaatctatccacagagagatcacaattgggagcgggtatgaatgttatttcatgtgatcagtgtctttcattttccaaaggaaaatattattggaataaccaaaagtgtttcaggctggttttagtaatttaggtaactcagcactgatgagattttattctctgggagactttttgaatcctcagacactgctgtttaaccatgctgcatttttgagaaaacatttccccccatttgttaaaccagctgggtcaccagcagtagagttgcgttatgcttcctgactgcagctcagaacgccaggcttgagtgagcgcctctgaactctgatctggttctttgaagcaggaaacacagtctcccacgatgtcacccctcgcctcccctccttcttccccgcctcattaccagagggtgcccttgagccatggctacagcaaactgcggagcagcgcagaacagatgcatccaggtaagaggcgacctgggggccagctgtcccaggcagtgtcttagagactccttaatttaccaggcggtaacgcttcaagctgcttaatttcctgatttaattacccctgtctttggaaacatggctcaatttaattttatattctcaagcaaggtttttttttaaaaattgatttaaacatatttgagtaatgtttcatctcctgtcctagaaactagttcgtctttagacttgtaaacagctagatgatttaatctttcatatacagattttattgaatagaacataccatattaagggcttgtattttttttggaattgttattcctttctgtaagcacaccaaagatatttatatagtaactgctttaatgaaatttcttaagaaatataactgcaaaagcaaaagagttgatccaacctttgaagactgagcacgtaaatgaaaatatataggtcctgtgctttggaataaggataaaggaaatgctaggggtagcattttgctgaggggtatgtagcatgcacagttgtggggttgccttcttgctcacatttatgctctgctggcctcgttaggtggtaaaatacgttagttctgaggatgacttgcagagttggctgtttaggctgcagtgcctaaagcactggaaattcactgcagcatcttgtgcctcctggggttcagactcctagtttaagatatgaccaattaaaggtattctagaactggatatctgtaaacccccacccccccagttttgttttgtgggctgtggccccaaatgacccagtttctgcaggtttttactgcattaaaaatagtggtgacttttagagggacacagaaataaaactgcgcgctaggctgaataaagagaggctgtaatcttgcagagagaagcaggcgtggcataatggcaatagcttttgattggaagcagaaggtgtgtgggtttctgtgactagctgtaggactttgggcaggccattgaacatctctgaaccacgattacctcttctctcttaaaatggagtaacagtatcctagaggggtattagaagattaagtgagaatgtgagtataaaatctgtttggaaattaagtcctatgcacatgcaagatgatgttgctaatggatagtaacaaaaaaatcactgtcctgtaacttgaatatctcagtggggttagaaactaaatggagttgagaattcttcattttcctcttatagtttccctgatctgatttccctattttcaggagtgggttttttttttttttttcctatttctaatcttacttgggtttggaagttggtttttaattcacaggtgaaactttttgttctactgagtcagcctgtcagcaagttctacctttggtattccttagaaaacttttctgttcctcctccttaatgccccattccctcctcattccatacaaattgggcttccatttccccagtggtaaggaagcagcttgcttctctccatctttcttgactctcagcagcctgtgccaaagctgtccatgccttcatttcttttcatacttttttaaaagtgaggtaaaatatacatatgataaaatgtacccgttttatttgttcatttttgagacaggttctcactttgtcactcaggctggagtgcactggcgcgatcatggctcactgtagccttgatctcctaggtttaggtgatcctcccacctcagcctcctgagttggtgggattacagacatgtgccaccacaccgggctaattttctttttgtatttttttgtagagatgggatttcgccatgttgcccaggctggtctcgaacccctggactcaagcgatccgctctccttgtcctcccaaagtactgggattacaggtgtgagccacaatgcctggccatgcacatgttttaaatcttcaatttgagttttagcaaatggataggcccttgtagctaccactttgatcagtaattgaacatatccattatgccagagatgaccctctccggtcactccctgccccctaacgcaatcactgttctgattttcatcaccatcattagttttgcttcttctagaacttcatatgaatgaaaacacacagaatgactgactgtactcatatgtgtttgccatctttccttcagcataatggttgaaatttatctgtattgttgtatcagtagttcattcctttttattatttagtagtgggatatattgtgtgaatgcatcacagttcgacgatctgttctcctggtgctggacatttgagttgtttccagtgtttggctattatgaataaggatactatgaacattcatgtatgagtccttctgtgacatatgctgtcatttccctggctcctaggaatagagtcactcagttttagggtagttgtatatgaaactgccaaagagttctggtttgacactgaacttcagagtgatgaaatctttaggtttttttttttttttttttttttgtacacctccccttggagaaagatggtacttccagttcttattaaacctcttgtaaggggatcaaagaattatttgttttgcactgtattgcatgtttggggtttcatttgggaagaaagagagttgagtaatagctactttttaaccttctgaattcagatccaattaaggaaggagccagaagtcagacaattgatggcctgaatatcagctttattactgatatagctgatcagagcacatgtcttagatttgtgaccagatgggctttagacactcacctttccagtcacaggcaggcttggccatcccagatttcccacacaagtaggaagagaaaatctgcctctccaaaaaaggccccccatgcagctgagtcttcatccaagccctactgatgagataggtctgtctcttccaagggaaggcccttgtaggtgagggatagaagccaagggccagatggtggcctgttcccccatgtgtctcccctggaagtagaagtagaagctcttatgggaagcagaggcacgtgggattcacttcctaaggaaagctcatgactgctagcaccccaaccatgccacagttcactgtgtttcaaaccttttggcagagcgcaattggtattagtgatttaattcagtgctccatcaacacagaatgattttaaaaatcctacttctcagaagacaatggtggcctaccagctgagacttactttttaaaatttggattatgtgctctctatgtatgtatgttttgcagtttttatatctgtattcattcttagcaggttctgaaaatctacttgatgggttgccaggcaattgttttgctattttaatgtgtgttaatgtattgtaacattgtgttccagttactaggaagaaatacaaaaagcagatgtgagcccaagagtgatttatcattcttgatgtgctattgttgtaccttctttattttaaaaagagcaaactatgttaaacatgaggtcataacaggctgctctgctctctacctaattttatttgtaagtaagctacagaaataaaacattttacttatttatatattttcaaaaacttgaactattaacctatagagatgagaaagaatttcaacttgggtgataatttctgctttctgttggagctgcatactacctggttatgtttaactgtctccctgccatattggtaaggtcattattaagtcttctggaaataaaaggagtgaaaacatacattcatttttgtggcttaaaaagttattttaaaggcagcaaaattgttttttaaaagtttggttattgaatagtagaataataaatataaaatatatttattcattttcgtagtcttctctacatgattttacattctgtttgatttatttttcaaaaataatgttggttcttagtgttcaaaatgcacattagttttcttcttggggaagtggatgatcaatggaagacatttacttaggggggatatatagaatttacctcatatttagaatttgaacacttatgacacttttctagctattgttgctttctatcccaattgaagttctcactgttccaccttcacaatttattcctaatcataacccagtgtaaatatttttctgcttatcatgaattggttgaatgtctttagattgtttagtgaaattgtgccaaagagaatcaggggttgtcagtcctagatggccctatgagtattctgttgccagttctttcctgaaaagcagatgctgtatcagtttgaatgtgaagtcataatttttgaatggaatctttgcataccatactgactttcctttctgctgtttcagcaccttatgaagctaggcagccccttgtccagcccgagggatcctcatcagggggcccaggaaccaagccccttcggcatcaggcttcccttatccgggtaagtgatgatgcagggttatgccaatgggacagtagagtcaagctttgggcttcggggacatggctttttgatggaccctttttcattgcaaggaagatataaaactgatccttcatgcaaatattgcatgtcttgtttggttgcttgtataaattactaaatcttttctactgtgtatgtctctacgccttctcagtgtctctagaataaactaggctgcttcttgatctttagtatatctaaaatgtccctctgccttcacctatctaatcattagccaccactttcaggagagcttcactttttctaaagcagcccatcttgtctctgccttattctttattattactcatttaatgcatagttaactgttttccatttgttttgtgcctctaattacatggtaaacttttggaaggcagaagtagttctgtattctctctcagtgcctagaccaagagaacagttattgtacaatggcagcagctgctgtttccttatgtaataaatacaaaagaaatattatggcaaaagcttctggctataccacagcttagacaatttcagcttccctttctgcagtgttttcctttggataaagagctcttattttgttctctgtctgcagctgttgccttgtgtagtgtctctgggtcctgtgctggggaagttatattctcaaagaagggtgtgtgtgtgtgtgtgtgtgtgtgtgtgcacgcgcgggtgtgcaggtttactatttgacactaaagaggaagtggggcagtttgtataacatttcagtcatctaactcgggaataaggaacatttttgcacaggcacttctactcagaatagaagggtggtgtcagacactcccataaagatgtgggctgctaggttggaataggataaacaaagtctaaagaaggtcctggggttcatggaataccttctggggatggggcactgtgttagatgtggtgcagaacttgattttctaaggtgggactctgtgtacaaataatttcttaaagataataatttagccataggctattttttatatttaatgcttcctacaaccataagatctagttactgctgcttctaatagtataagtgagttgactgtggttgagagaggtcaaatagctggtttaaggtttcattcataactagtcagtgacagagccagaatttgaatccaggcctgtccaatgtcaaaacctgctcctttcattactttgtcctacattagagtcccatattacaagaaggctaggttctagagttgctacataaagaaacgttgggtgtagtaaaaaatactcttgaaaaatcccttattgataccacactggagaaccaatatgccatttgctcccagggccagtacagctcagttttatccccaagttggaaaacacatttgtttcttcagctgagctccagatgtagtagttggctgtgtttagagatcctgtggtacaaaaatatgtgcctttaaacacgagaatcacacccactgtggagtgaggtttacgttagaaaaggtatcagtaggactgggatttatccctaagctctccaaaatgtggctgtgtaggttcctacagagtgtgtcctgggaatacagaggccagatcctgaatggttaggatgatagtcaaactaccagtgcatactgagctttacagcagtgtgactgggctcactagaccctttctacctagcccctggctggcatgggcatggatgctcatttggattggcaccctgtggcttctcttctaatctccatgttcccttttctgctgacaaacatgcttcatgagcccttcactcaactaatatttagtgaacacctattaagtgccaggcactgtgttgagaatacaaaaatgaggtataacactaacagtttctgccctcatggagctactggagagatggtcattaaccaaaccaccacaaagtaaatgtataattatgatatgggatatcagtaggaattacactgtactttaaggatgaaaatgggcatggggtatgacctagccttgaggggcaggggctgatcaaagaaggcttctggtgggggagcaacattcgagttggaataagggtacatgggtgttatccaggtgacagggtgggagtgcgggagcaaggtgacaagatggagggaaccgcatatacaaagacatttcctatgggtttgccattttatgaacattatctctttcagtgcccacagctatcttatgaaataattagtgttgttatcccattttcagatgtcagaacctgaggtttagagaccttatttaatttgcccaagttcacagctaggaagtggcagggctggagttcaaacactggtcaaggttcctcagtctctggctcaggaaccagatagatggtggtgtcacctgttgagctaggaagccctagatgaaatactggcactggggaaagatcacaggttcagtgtttgatgtcaggaactgaggttttgagatagtccagagaagctgttgaagaactggtagattacatgggtctggagcttgggagagagcttaggctggacataggtatttggcagcaattggctatcagaaggtctcatggtatagtgcagaaaaaaccagacaggtgctcgcccaagtccagcaaaactctgtgtgaccttgggcaagttccttctcttttctgtaatacaaatgacttcgaatggatttaacagcccattgtaacaatcagcaacagtccgattctcttaatgtgtctgtggttttcatggctggtgtgtttttctttcctctgttcttaggtttccttcttatgcctgttaacttggtttggctggactccgtgttccagaaagcaaaatgccaacctggattagtcatgtagatgaggggatttgaagtgaaggttcttggtgataagggattaatgtttactgggcatggtgctaggcctaggctggggtgactaatccccctcatgttgtcacgttgatgtgccgatggcaaccttctttctcttctaactagttctctggccttgtattcaagttcttcctgcctgattacaagggggcatgtcctctgggtcctgggggaagcctttagggactcccagccagtgctgttgcaacccatggtgttggcattttagaggtgcttatgccaatccagtgcctaaacattggaatgatttgtctttttgcttactattttaggaatttcacttttgttcgggtgttggatttttttccctttgaaatttcagacactaagcatatcctatgttggtagatgattgatagtgctttgtaaagaaattataagacttattttctgcttcatctgttatcatatgtttagatgttgttttgtggtttgtttttcacaaattaccctcaacatctagatgatgtagtcatttgtaattttgctggcaaaagatttagaattgcacgctttattcctactgttctcagctgcctctgtttttgccagggtcatgagaaactttatgttaagccgttgtctttattgtctccttggcagctgtggacactgaccatcttctcgaaatgctctcatcatttggtgtccattatgcctgctctcctggttttcctcatgcttctatggctgcccctgcctcatttgtttcaatcctccttcctctgccctccccttgttatgctggagactgctgggcctacttctcactctacttactctttagatgtgtggatgctcatgaccacatagcaccatctgccagacatcttcactctaatgttccactgtcactttcagctgacatgtctttctcataaaatcagctttcactcttccactcctagctccacccacccatcagcacaggccagaatgctggtcattgtctttgacttctctttctctccttatgcctgttcagtccccaagtcctgaccataccacttttcaaatagcttgtgtctgtccatgcctctgtacttcttcgttcaggccattatccttttcactgattgtattgtattagcctctctcttgtttcttcttgcttccacccttgccttcttccaattcattattctcattgcacacaaaaacaatcttaaaaacacaaatctaatcatcctgctgacttgattgaagcctgtccctctctgcccatggctcttaacatgtcatccatgttgctgtctggccctcgcctacctcctcggccacagcagctcactgccgctttccctccactctctggccatttcccggatggtcagtgttctctgcgtgggagccttactcttcaccctcacttttgccttctttgttttctcctttgtctcaattcatctatgcttttttccccattaagaacgtgaaacgtaagtgttttctgatattttcttgtatatgcgatgtttcctttttttttcattcttaaaaagaaaaagatctattgcttgtcagctcatttatgtgtgcaactcagccagagggatgggcgtctgatcattattggtttcccatctcagaggcaaccagggttgcctgtttcttttgtatcattctaggaacattttacgcatgtacatgcaaatataggtattcatatatattaatatgtgtgtgtatgcactatatgtatttatatatttatttatttttttagacggagttttgctcttgttgcccaggctggagtacaatggcaccatcttggctcactgcaacctccacctcctgggtccaagcgattctcctgcctcagcctcccgagtagctgggattacaggcattctccaccatgcccagctaattttgtatttttattagagacggggtttctccatgttggtcaggctggtcttgaactcctgacctcaggtgatctgcccgcctcggactcccaaagtggtgcaatatatttttacctgaatttagggagacatgtttggcaaatgaatatattcttccagctagattgcactagaaaaaattatcttttatttaaaaccaaaacacattcacttttcaaaccctcaggatactgttgtgatgttttctttgctttttggagggatgaaagtaacagttttctagaacatattctcaacactcactactcttcttcagagatgaaaaaatgacaaacagaatttagatacctctattactctaccattcctcagggggcttagctatatttttggtgtaagttttctaatgatcaggtaggggaggggatgttaggcattgttagccagcaccatattcatctcgaagtgcataacttgaaaaatgtttatttaacttagttatctcctttcctcctcatctcagtttcttgccgtacctcctcccctagatataactgcaggtacttacggccagaagcaggtgatctccactccttgggtcctcttggaacccaagagaaaaggcaagtatatgaaagatgattaaagaaatgaatattcctgaggctctgtcagagtggtgttggcctgagtcaaaagataattgatagtcaccacaaataaattgttcattctaagagctttgatgaaaacagcaggaaatagcctttgggggaggctgatattgcaccgagagatcttcttgtggcatgaaagatattttatgggtagactggaccaggatgcaagcaggataaggagagcggaggagtgagaatgactgatggtttgggatgggattgagtgaggtgggttagagttgagtcatgagagagttggtcatctgagtttggaagaagagtgaagcaggtaaacaagcggggcatactgggtactgtcttggctactctggttgtctaacctaatactcagcccagggaattgacccacagagcaggtcaggcccgcccggattcttttggggttcaagaattatttaccaaggcattacttggtaagtaagtgttcatacgaacgtgtgtgagctctcaaacacacttgttcttcagagcaaatacagattttaaaaatatgtcaaacattcaacagatacaaaagggcacagtgaaaactgtccctaccatttccccgcacagccactcatcccaggggcaactgatatgacccatttattttgtatagtactatacaaaacatttatataatattgtatatgaatatcttttttatatacaagtgaaaataggtattatatataattacatgtaatatatgcaaaacacagttatgcttttttacacatatggtggcatactatacatctaacatgcatttagcactaacaataagctttattaacgttctatagcagcacataaagtacttcctcatctttttgttttttacagatgcatagtatttccttgtctgcgtcttgtgtaaatcatttagccagccccttttgattgacatcttgtacttgcaatcactgcgttgtttgcagatatatgggagaccaattcctagaaattgaattattgggtgaaaatgcctatatatttgtaatttttgataacgactttcaaattggaggtatagcagcctatgtacttgccaacaatatatgaaaatgtctgttttctcgtacctttgtgaaaacaatgtgctaacaaatttatgggtctttgccaatctgataggtgaaaaatgatagctcactgtagtttaattagcatatctctttattagtgaagtgaaatatcttaagtttatgagtcacttgtatttccttttctgtgaactgttgattcatatcaagtgcccctttttcttttgagtattggtttgtcattcttaatggcatgaaaccagaagctggtctgtcttttcctttggaccagagatatactggagtgtgtgtggaagatttctccctgagtggtgagaggagatgctggcacctgaggctctcgaaggaggttatggaccccagctgcttcccagttctggagaaccccaggcctgcctgcagtgcagatttcttgtttataaggtcatgacagtaaagttgaattacttagtttatgggtagagattagggctaaaaaaaaatcctctgttgttagagatggtaaatgtcaacactgtgtgtgtgcgttgatctctcagcattgcttagacagctaaattatgttcctttcactgaaatgggtgggaggaggagatagaggtagagataaagatagatagagggagagagtataagtgtgtgtgtgtgtgtgtgttaggaagagtgagtttgatgccttttctaggtatgtatgtgccttattcttgagatcttctttcaccaaattcattcctcgtttcatttgagaccccagctggacgtttataccatctcctaaggggtcaaaggttaacatgtcctccaggtgtcctacttcactgagtctactatagaacccacatatacctgaacggacactattgccacaaggaggtcctattttttcatagcctccagtctcctgcttacttattttcttcacctgcttgtagttctctttctgattttctagcccttaacttttgaggaaggatttctagctcttaacttttggggaaggaaacatttaatctcaactgatactgaagtttattttctcagtgccaatcttttctacttgtttcttttttcttttttccttttcttttcattgattgattgattgattgattgagatggagtctcgctctgttgcccaggctggagtgcagtggcgcgatcttggctgactacaacctctgcctcccaggctccagcaattctcctgcctcagcttcctgagtagctgggactacaggcgtgcgccactgcgcctggctattttttgtatatatttcttttagtagagacggggtttcaccatgttggccagggtggtcttgaactcctgacctcaagtgattcacccgccttggcctcccaaagtactaggattacaggcgtgagccaccatgcccggcctctacctgtttcttagtgtattcctcaggtgctcactgtgtaccacacttcttgacaataaaagagatgtttagttaatttagcctcccagaggtagctgaaaacactggtttgaactgctggttccaggcagtactttgtaaatctggaaaggatagtagcttattccccaggaccttttggtctcagttatatgccaggctatggatatggaagacttctttacaactggcaccattttagcccctgggcccatcagtctttcccttgatctcaggcgagcagggagtgtcatgcccccccagttgcctatcccaacaatagtcactactgactgaggtgcttctttggtcccagtgctgtgctggcccttttcagtcctcccaacaatctcacaaggtaggtattattacatcttccatttgtccatttggaaatacttaagtggcttccatgagtcagccaccatgccaggggtacactgaggagtacacctatagcctcttgctctctaggtgcttgcagtcaaaaggaggagatagatttgaatcaaatgatcccacctatgcatgtggaattaaaaactgacaattgccctaaaggccttaaaacatggtaccatgtagcaaaggaatccagcctatagctagaaagtgagagaaggctcctttaacaaagtatgtgttgagctgagctgtgaaggatgaatagaagttaaccaggctaaggaaggatggtcctgggaggtgaggagaggagtggagtgtttcctgtagaggtaagagcctctccaaaaccgcacagcagagctgggctgctgagagagctttgcttctgtcacaatcagaaagctacagcattgggaaactgctgccctagtgtcagctccaaccagatccacactacaaactaccttggcagccaaatgaaagctttgttccctgcctgtaacttgggtctgcatccgtcttccgtgggtgtatttgttgagtggaacctaagtcctatttggaattctagcagcaaaggtgttttgacagtggagtttttagctagccagcttgtgcagtgctgggacttatgctgacgggtggaatggactcgtgacccagtctctaccatatttcacagggagagcagatacatttgaagaactgaaagaaggcagctgtggctagagcctggagtgggagggagatgaggtcggagagggaggcagggccctgtgggctatgtgactgccttgcaggtgggagctgatggctcagaagttaatttactggttagtaagtgaccatgccaaattggaacccaagtctgtctgcctctggaacctgtactctttttgcacctccagtcagtagcctcattctccaaagcattcttgaattctgtccaagttgtggatgcatctgtttcccatctgaactcagactgccttgagtgtgaaggggagaacgtagtgaagagacaggcagccttggcctgaccagcaaggacaggggtgggaacgtcatcgcttcgttaatggaagtctgcagccttgtcagagtctcctcttactgctgatttctcatttttcttggctttctcctctaagcagagcacaaaatcctgataatagtgaaggaaaagtgcccttctggaacagcaaatcttggcccctgaggggagaattggaggcagtggttactaatgagcatttcttatgttaatcaaaatactgttagcgccacatactgcaatcacagtaaaatgattacatacctggattgtatggctagctctaggattcttttgtgatgacgtgccagatgcttacctgcaaaaattatgtgagaaataaaatggtgctctgtcagtatgatttaatagttcgccagccaaaatctaaaactaaactagatgatggggaggaaggtgtaatacagcatagtcatagctcaagcacagatcctcaatctgcaaaattgcagcaatgatttaggcattgcagtgaggttctttttgtaataaatgctctatttttacaggatggatgaacagatagagataactatagagcttgatgatcaagtgtacgtactttggacccagtttgtattctggctctaccatgtgccataggtgtgtggtcttggtaaattacttcccttacctaatcctcagtttcctgttctgcaaaatgggaattaccggatttacctcgcagggttgtgaagatgaaaattgattgtgtgcattaggtacttacagtgcctggcacttagcaaagcaatgaatgcttgttacctgacattcttctgtgtctaagtgatcgtttcaaaaagtatagcttattgtaataagcagcaactgtgtgttgcacattaggctcagagagattcctacagtttggcagtcagccttctgaactattgaaattagatccctaagtaagttaggtaatatgtggttaaaggcatctttgtgggtttatttccctgaagaaacagataaggttaaatttctctgttgggacttaattttaactaacttctctacagaaaaaccaaattatttattgcaacttcctgtgaatctataattattttgaaataaagactagaaagaaggagttttttaaaaagttctctgacttcagaggtaagggagagggctcagcctttatagtgttggatgacattatgtgataaatgcatataaagttcagcttcagtcagcttaagagaactcaggttaacctttctctgtctctagactgggattgagaattttttcgaatgtttgtttgtttactcattcagcaaataacttattgagtgttttgtatgtgttagtgacttttccaggcatttgggatatagcagtgatcaggatagacaaaattttctgtcctcctgggttttatgggatagcatggggtagggtgagaggcagagcataaacaagattgatcaagcataatttggaatcgtttcatgttaaaacaaaattgctaagctctgtctccttttctaggtccttttcttcatttctcattgaacactttccccacaattttacttgagctgtcttttctttttaactgggaatctccttcaaatccatggaagatgaacctatattactcaaacacagaaagactactataaaaatgaatcagcatcctggtcctatagattgtctgcatagataatcaaattagaatgagaaagttgtttgggctcataatggtctaatgtcattggtcagattgcaaaaccacaatagcttcaggcttccatctccaggatgggctttgtggttgtgaagggcagatcttcctttcctttgggtcttgcttgaaggatacattcattgagggaacagctgctataacaaataggccccacattttaatgactttgcacagtaggtatatttctcactaatataatagtttggcaggccgctgtcctcagcatggtgattcatgcaccagagctccttctgtcctgtcactgtgccatcgtctgttcagtgggcacataggaaagagagtagaggagtgctacagggtactagtcctgcttggaagtagggtaggccactggtgctcacattgcaatggctacaactcagtcacatggctgcatgtaacttcaagggaggctggaaaatgtcatttctggttgggcagccacttagtgacacctctacaccaggcatagtagagcatgaattattggaggagtctgctgtaatcccacctatcagcactgccaccacttgcttctgtgacttttttttctcagccccatgactgaccaatttccttgatctttctttagacaaattgatattcacttgggctatagtgtagtctcaccagcccattagctatccttttctttacagtagtcaagtcttctcacatctttgctaatgagatcgttttgatcagcaattgccttgtggtagtcttatttccaaaatatttttggcggaggaggcatcctcagatattcactgtgggcttagtatgagcttttgctactccaaatagtttgtttactaaggcactaacaggacactgttaaaagatcattacccctcataggtgaaatggctggactctaaaacagcatttataggatgccttcggggtaggtttatattttaaacagaaatgttctatgattgaaacaatacacacacccttcttaagttctctccaacaatgcttccttgcaattcatattatttagctttgtttgatttttaagatagtttgatagtaggggtaaatgttaccttttgggattttattaatagtattactttttaatgagtcttttgaagtctttcattataaacagcctgctttccccagagataataacttgccatgccaaatatttgcatttcacttgaaacaaaaccaaggggttgaatgttttaaatataagcaaatctaattctcctgtgtctagagaaactgtataatgaaccatatgtatgtggcttaagcagacagatgtgaaagatttctccctctctccttttatttaaaaaacaaaacactggcagagctcaaaattggcaccaagtagcaaacatctctgctcagccaacaaaaccactggagctggagttgatggggggaggcctctttagggtgcatgcaaaagtggagcttttcctggtcctggcttctacttggaaagctaaggctccacagcttatttgccctcatttctcagtgccttcaggcttcaaaatgagccattctcaggtgactgacttttcagatctttgagaagattgttgtggttgattgttggactggttcagaagacatgggtccacgcatctgggtcctgcggtgacatggcctctagctgctgacagagtggtgctgagctaccaaacagactcataggcttcctttcacaaagaacatcatagggcagtgtttccacatctcttgcaatacaagacatacctctgaacttcctcaagcttgccaataagtagagctcacactaccttttagtatctgtgatgtacctgccagggactataggtgggataaagtatctgatatggctcctgtccttcacattgaaacctgggtgaagatgtttaggaacactttaaatgttcaaactgtggtacttaccatgactatcataaagattcatatatatttttttgagacagggtcttgctctatcacccaggctggggttcagtggtacgatcatggctcactgcagccttgacctcctgcgctcaggtgactctcgcacctcagcctcctgagtagctggaactacaagtgcatgccaccatgcttggcagtttttaaatattttttgtagagatggggatttgccatgttgcccaggctggtctcaaactcctagagtcaagtggtctgcctgccttggcctcccaaagtgctgagattatgggtatgagccaacatgcccagccaagattcatattttttaagacgctcaaatcacttggcttagtaaatcaatttcaagcatacagcgagaagcaaggggaaagagatgggggggtaggttagcacacttagtgcaaaccagtagaagggccactctatgggttacacagaactcatgtgccctctccctttgtcctaaggcctttctaggtttaggagtaggaactctccttgcccacttaagttttcttggaagaggggttgggttctcatgggaatctaagaaatgagagccaaggaatggcccactggtctgtaggggtgggagttcttggctgttcatgcttgttctactgttaacaggccttgccctggttgtgttaagtttgctccactgtccacttatctttaggcttctgcagcctttcttgcccccccccccggctttgtgtcctttctgtacctacctcccagcttgtgctgatgcttggttctggcgccctcataactttaagtcccacctaccctttctctatactacagccccactgagcatctgtttagggtctactttctcttctcattggccttgatatttctcatccacattcccaagaatgagcatctgacctaagcccttgtcagagcatctcaaaggccagtatactgtgtgcccatgaacccttactcccactcaggtgacgccaggtgtgaggtgggtcatggtgcccacacaaggctgccaggcccacctttgcagcagagcatgggaacgagcagtgccgtctgtcatggccgtgggtacggcaggtacattggaggatttgagcaggggaagagtgttctgggaagaagacaaacatcttacccctgaggagtgagcatgtgcagtcggaaagcctgctgagaggaggctggggtgcgaggcttctgaaggccaggtggaggaggtggacttttctgttaggcagcaggtcatctctgcaggcttttaagcagaggagttaatcacccccttctgttcattcctgatttctgttgttagagtagacctgagacctgcctgctaagaggccactaatgccacgctggagtgaggtgatgtcaagaggagctagaaagcagatggttatggcattgaggaaagagcacacatgggctgacagggacagctaagcagcagcttcatgagcaggagggaaagggcgtgttctaggggagcagcagcttccatgtcagactcaggaatgcagcagacccaacatccagcttggagatttcttctctttttcttttttttcaatggaactgtattttcgcaaaatgttacagatcacttatagcaaacagaatggtgatggtcaaggaaactgactctgggctcctttttgaccgcagcagctatgtggaagcagctgcagctgtgataagggccgcccagcatggatatttctgtgtcttcgttcactgggaagtggagggacagagcttccgacccacatcccaccttcttcacgaatcatctttgccaccaaatcgttggctcataggtgtctgttcttgtctttcctgcccatgcctggcttttaggttcctttgctccagctctttctgtcagggctgacctggagggcagtgctcctgtgagttctccacattatatcatggccggtaatctaatccaattcaagctgacattctccaccctatgttctaccaatggaacctggtcagacatctgggctcattcaggaagtgctgctagggcatggctctggaatttggtgggagtattttggaaggttgtgtggtctgtttggttgtttagtgctcggactggattttgattttttttgctttacttatttttactgagacggagtttcgctcttgttgcccaggctggagtgcaatggcgcgatctcggctcgctgcaacgtccacctcccaggttcaagtgattctcctgcctcagcctcccgagtagctgggattacaggcgcctgccaccacacctggctaattttttgtatttttttagtagagacggggtttcaccatgttggctaggttggtcttgaactcctgacctcaggtgatccacccacctcagcctcccaaagttctgggattacacgtgtgaaccactgctctgggcctgtttatttttataataataagaggtttttgaaaaaaattcagatagatgcaacccagttaaaaaaaatcccggtatacaaaatcctgcctttgaataagagattaaaaaaagatggtcattatttgctgcctgcaggggttcactaagggatatgggtaagttcccttagctcggaaaaaggataataattaatacccgcttacatctccaaagtcttgaggtgctcaaacaagtaggagtgtgtgaaatgctttgtacatatcaaaacactctgtgaaatttaaggtattaactaatggataatgacttcttgaacatttaagagtggtttgatttacgtttagtagaaactcatctagtatgaaaatgatacatttattacaaatgattaacaaccctacagctctcaacctctttatgtaaccttccttctgactaaaggacccagatgactttgaggaatagcctgtttgctgggtgcattctcactcagcacttctggaagtatccattctacagttagtatttcatctcattgtcctggccttccgaaagcacccttaacccaaggtgtgagatatcaaagtaatacatattttacttcagagatgacatctcaaggttttacagtagctcaacattttctagtctcctttctctgaacattgtcagaggggagacaggcgttcctgggaagaattaattcctggaatggtgtgtgtgtgtgggtgtggggaatgggaggagatggccggccttcttttctagggttagtgggtggaattgcccgcccaatgattaattccctccttgacagtgtgttcagaagcaggcaccttgatggctctttagcagcaataccctcctcttctttcctagcctccttttgtcataaagcctcatcttttttatttatttttatttatttttttttttttgagacagagtctcactctgttgcccaggctggagtgcagtggtgcgacctctgctcccaggttcaacttctgcctcccaggttcaacctctgcctcccaggttcaagtgattctcttgccttagcctcccgagtagctgggattacaggcacgcaccaccatgcctagctaatttttgtatttttagtagagatggggtttcatcatgtcggccaggctggtcttgaactcctgacctcgtgatccacctgcctcggcctcccaaagtgctgggattacttgcgtgagccactgcacccggccaagcctcatccttctggtgttcacctcttggtcctgttaaggtggcccttggcaagtacctctttagtcttagggttcatgggagggatagaacaaaggcccacgcctccccctagcatcgacatttcccttcgtctgccaatgcctaccatagctttgttttctcccgcactgcttccctggttttctaggctcttaaatcctcaaatttgacttgcatgccctctagtggcaggtctgatgcaccccttgttaccctgtttattgtggtaccataacagctgttctcaccacccagctctgttactaaatattgtctgtaattcacaaatgccaaatgagaggttcagtggtcctgacttgccactcaagtaggagctggaaatgtgggatttgaattggagcttttgattcctggatttatacagcatttcagtgtaacggcaacagtaaaaaagatgtggttatagttgttctagtttcttttttgtcatttaaaaagaatccagattattttactatccactcagctaatctgaaagaatgaaaatgtgaggaatagtggaaaataagaatgatcatctttttttaaaccctttattacaattagaaatttttttgtcacttactgagtattcagtatttcatgcctcagtcctgttaactttgaagaatacaaaaaatacataaagcatgatgtctgcccctaagtttctgttctagttagattctagttatgaggcagttaaatttcttcacctgaggaaaaaaattaagcataacacatgataacttttattggtgtttaatttttctacttctcactaaagacaggttctctgagcatttactttttaatttattcttacagtccttttcagtggagagggaactacaggataacagcagttaccccgacgaaccctggaggataacagaagaacagcgcgagtactatgtcaatcagttccgatcccttcagccagacccaagctctttcatttcaggtaagaatgtgggctccctaggcatcactctcaccagaacatagccaccatcttgagaaatcattcacgcaaaatgagtatggcagccttctgtgatttcagtttgtttttcatctaaagtcgaatttcttatcagatgtaaaccatgcagaagaaaagttgccaatgacgtttggaaaattatatttccatttcaaagggcttaagtgggaatttgggggcaacttggcccagaccctgcaccttatcagctgaggcagttcttgaaatgctagcgtgtcgccccaaggggccacctctcattgcttcctcgttatattagagctcgggcaaggacagaatgtggcctcctaaggagttggtgtcacaagtctttttatgttatatgtgccttcaaacttcaaactcaggctcgttttctttggctcaaatgtttgtcctccagtttttctgagagaaattaaaatgggggaggaaaattggccagtgctttcccacttgtcagttcttctgggttgtcttcagatatatagattcctgttgagttctcatgtaaaattcaagctcagaggaactggtttaatgccagtgtggctacattttaccaggctgaaagactaacagtgaaatagtagagtctagaagaaaaattcataaagctttctttttagactttaaaatttgaagaataacaatatgtccttaataattgtaacctgccatattgaagtgtgggcaaagattagttttatcttgtgaaatgaggcacataattgaaatatacttgtataagtaattgcaaacatcatttactgattggtggtaatggctttattgacggcagaatagtacagatacaacaaattaatgttgacgtcatgattaaggaaaataagcagaaacccatattgcacgatttgaccacttgctaaccttaccccgtgctcaggtgagtttctttacgacatgtgcagatatttagccaaatacaaacaggtacttgttagaaatgtttttgttttcttttaacttttgtatcttgcagaatttcagatatagacacaactagtctggctgatacaacaaacctctgtgtacctatcacatagccccaatgattttctcttacctacagttaacacataaggttgtttcagtcagtcaatgatggcggtaccataacagtatcacggagctgaaaaattccagctccattaatcacctagtgatgctgtagccatcatgatgttgtagcacaaggcagtgctcacataaatgtgatgatgctggtaaaaacaaatctgtgctaccagtcgtataaaagcctagcacatatgattatgtacagtatataatacttaataataaatggctattattagcttattatgtatttattatgctatactttttttctttcttttcttttttgagatggagtcttgctctgtcgcccaggctggagtgcaatggcacgatcttggctcactgcagcctccgcctcccgggttcaaatgattcttctgcctcagcctcccgagtagctgggactacaggtgcatgccccacaccaggctaatttttgtatttttagtagagacggggtttcaccatgttggccaggctgctctcaaacccctgacctcgtgatccacccacctcagcctcccaaagtgctgggattgcaggcatgagccaccgcacctggccttttattatgctatacttttattgttattttagagtatactcttacttatatataaaaaaaagttaactgtaaaacagcctcaggcaggaacttcaggaggtattccagaagaaggcattgttatcctaggaggcggcagctacctgcaggttattgtcctcttctagtcacctccacagtatagaggtggaagacagtgttattgatggtcctgaccttgtgaaggtctaggctgataagtgtttgtgtttcagtttttaaccaaaaagtttatacgtgtttgtgtttcagtatttaaccaaaaagtttaaatggtaaaaaaattaaaaattttaaaaatagaataatagaataaagatataaagaaagaaaatatttttgtacagctgtgcaatttttttaaatttttaaatttttgtgggtacataggtgtatatatttatggggtacatgagatgttttgatacaggcacacaatatgaaataagcacatcatgaagaatggggtatccatttcctcaagcatttatctattaagttgaaaacaatttgactacactcttaagttattttaaaattgtacagtgtgtttttgttttaagccaagtgttattacaatggagtcaagaaggttaaaataaattttaaagtttatgaagtaaaaacttacactctaaggttaatttattattgatgaaaggatttttttttttggtaaatttagtgtagcctgagtgtgcagtatttataaagtctacagtagtgtacagtaatgtcctaggccttcacagtcactcaccactcactctctgacttacctagagcaacttccagtcctgcaagctccattcatggtaagggacctacaaaggtgaaccatttttcatcttttataccatatttttactctgccttttctatgtttcttctttctttcttcctttcttcctttctttctttctttctttctttctttctttctttctttctttctttctttcttttttttttttttttgacagggtcttactctgtgcctaggctggagtgcagtgatgtgatctcggctcactgcagccttgacctcctgggctcaagtgatcctcccacctcagcctccctagtagctgggactgcaggtgcacatcactatgccttgcctggctaatttttttgtagagaggaggtctcactatgttgcccaggctgttttctatatttagttgtgtttagatacacaaatagttactattgtgtcccaactgcctatagtattcagtacaggaacatgccgtacaggtttgtagcctaggagcaataggttctaccatctagcctaggtgtatagtaggctataccatctaggtttgtgtaagtacaccctgtgctgttcgcacaatgaggaaatcacctcatgatgcatttctcagaacgtatccctttttctagaaatggaatctcataatatgtggtcttttgtgtctctttcatttagcataatgttttagttttttttttaattaaaacatttgtgtgggtacataggtgtatatatttatggggtatgtgacatgttttgatgcagacatgcaatacataataatcacatcatggtaaatggggtatccatcccctcaagcatttatcctttgagttacaaacaatccagttacattctttaagttatttaaaatatacaattaagttattgactatagtcaccctattgtgctatcaagtagtaggtcttagtcattctttctaactagttttttgtacccattagcaatccccgcctcgcccctactctctccctgccactacccctcacagcctctggtaaccttccttctactctctgtgtccatgagttcaatcattttgatttttagatcccacaaatgagaacatgcgatgtttgtctttctgtgactggcttatttcacttaacataatgatctccagttccatccatgttgttgcaaatgattggatctcattatttttttttaatggctgaatagtaccccactgtgtatacataccacattttctttattcatctgtcaatggacacataggttgcctccaaatctcagctattgtaaacagtgctgcagcaaacataggagtgcacatatttctttgatacactgatttcctttcttttaggtatatacccagtagtgggattgctgggtcatatggtagctctaattgtagttttctgaggaacttccaaactgttctccatagtggttgtactaattcccaccaacagttagcataatgttttaaaggctcattcatgttgtatgtaccagaatttcattcctttttatggctgaataattccattatatcagtacatcccattttatttatccattcatcagttgataggcatatggtgttcttccacttttggagtattaagaataatgctgatttgaatatttgtgtaccagtttttatgtgaacatatatttttatttcttttgaatacatacctaggagtggaattgctagatcaaactgtactgggagctgaaagcattcaaattcaatctcagtaaggtctaacatttcaagaacagctgggtcttgcagttatgtaacatgtaaagtggaatgattgcctgatttcagttgatacaggtaaatcaacaatgaaggaagaaagattcctggataagtttctcaaaatgccactaggaattcttaaatctcaccaaaagctttcccaagatgtctgtcttatctctgtgtggtgtgatcaatggtattaattttcttctttttggtcagttttctattacttttctatttgaaatttctatttgaaatctgccaaatttgttcaaagttttgaacttcgtcttctaaatttttggaaaaattttgcagattttggtaaaaatgaagcagaaattaatttatgtgatttgcatctttcatgagcattatgttattgcttcttttgccctattgtaatttacatatttttaaaaaagctattcatgtgttgcttttggtcccatgattcataattgctttgaggaataaatatgtttgtggttatacagaagagattgctgaatgaaaaaattgtgattcatttgtatataaatgtaaaagctactctagctgagtaattaatggtttatttaaacaatggcacttgacaggttctgtggccaagaacttcttcaccaaatcaaagctttccattccagaactctcctatatatggtaagtacaattaatgccatatgacattcataccatcatccataactcatcctttagttcctacctttgcattttttaaaggcttatgttttgaatgatgtttttaacagactacaggagtgaatacaactcagatttttgttgctgtgaaaattaaatgttatatgaaaagtacaatgaacaatgtctggcacgtattaagcactatgagtgttaactattattttaaagtaatttcctaattattatccccatctcaatcccttttcagtctaggcagttgtgggcacatgagacttaccatcctgtagatttcattttcagacttttctgctaggtgtgatacaagtaaccagaggagcttgacaaactattttttatattttataaggctgagtgaacagaaggttgaggaatattttggagttaggttagatttgactattctagctgcctctgagctttgcaaatttggctggtgtttatcagttgggccctaattcagacttgcagctgtggtatccactgcacctttatgcactctggttccaaaagggctatgctgggatggtccagatggctctatttgcattcatgaaaatgcttggtgctgctgtaaactctcggctgtgtgtgggctagttcttccccaaaactgggcaggagatcgcactgctataaatatataattaaaaacattataatgtttatataaagctttttgcatgaggatttacagaattatgataggatttaaaattgcttgtcatgttttgtgcatcttattggaaaactactccaataatactcatgcatgtcaatgtatctgggattctgagctggatttaggttcttcaacaatatatactctggcataatttttttgtttttacaagccttatattagttttgtttttgttttgttttttgtttgtttgtttgtttttttggagatgagggctcactctgtcacccaggctggagtgcagtgacatgattatagctcattgcagcctctgactcctaagctcaagcgatcctcctacctcagcctcccagctagcttttcatttttttctagagacagggtcttgctatgttgaccagtctggtcttgaactccttgcctcaggcaatcctcctgccttggtttctgaaaactctgggattacaggcatgagccaccatgcccggcccttatattagattttctggctagggaagaataaagaaattatcattttgaaaagaataccatttgttttggcagaattcccagtctaaacattgttggcatgagacctcctatctttttgttgagacacgcctatgaaagctgaatggtattctttcgatctggcgtatgaagcagtttcctgacccctcactctggggaacagctatttcagggccccagtgcattcgaaattggaggaggaggatgtaaatggtctaaaggaaagttatggagcttaccttagaaatatattttctttcaaatagtaatacctttctagaataattttgtatttgtcttatctctatgcttgtcctaacacaagtacacttgtccctgtctacctaagagatggttaagcttatggggtcttagatataatactttggcaaataagtttcttttgtgctgagtaaataggtctgtgccttttagtgggaaataatgactgaagttaagcctgtttgagactccccctttcttcctttttgtcttatctggttccagtcagctttagttactagttttatcctaaaacataattcattccattttttattgagcttacttgtgttttcccaggagggagttctcaagcaaagaacagtttggtacaaaaatttacgtgacttgaaaagttcacggttttcctttaaagctgaaaaacaaagagcttatttctgtgctccaggtaaactgcataatggctaggacaactataaaatggctggggccacccttcctctgactgttttgaacaccatgtccagggcttttcaccccatgcagcctgcatttactgaatgactgtggacttctgggtatcatttttatttctgtgccatagtttcttgtcctatgtcctcagtgttgtaagacacaccaactagggaacctgaagaatttaaatttttatttataaaatgctactgatgctgatcccatcaatcggcatttttcttcctcggagtggcccccagagatttcaaatggatttggctaggagggtttgggtatctggtagggccatcaccacagagtctgggagttttattggcacgtttgggccaagtaacttgttctgtaagccccatggtaggtactcatgacatttgtttcatttagggagcttagtgatgctgactgtgatggagccctgaccctgcctgagttctgtgctgcgtttcatctcattgtggctcggaagaacggctacccattgcctgagggcctccctccaactctgcagccagaatacctgcaggcaggtaaggcctcaccatcaactgtaaaccttaagtacttttcctccaggctgtgtaaaaaacttttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacttggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaataaaaaataaaaaaacaaacaaacaaaaaaaaaaaacaaaaaaacttttgtttcttaaaatgatgtccagatactttggggagtccttggtatttacagttattgttctttaactgctattagactttcacatctcataatgtgaggaatagggctgatctgggtaagtgtgtattacctgtttttctcattctataccctctggatggatttgaaccaaagtcacttaccctttcatgacagttgtgaaataggcaagtactgaacctcccagctggtataaaatgaagaggaagatcctgtagagccaagtgttaacttggcatttttaggcacacccgagtgtctccgggtggccctgggcaatggagtggaatggaactcttatacctaatttaaaagtcaaaaaattagccgggcgcagtggctcatgcctgtaatcccagcactttgggaggccgaggcgggcggatcatgaggtcaggagatcgagaccatcctggctaacacggtgaaaccccatctctactaaaaaatacaaagaaaaaaattagccgggtgtggtggcgggtgcctgtagtcccagctactttggaggctgaggcaggagaatggcatgaacccgggaggcggagcttgcagtgagccgagatcgcgccactgcactccagcctgggagaaagagtgagactctgtctaaaaaaaaaaagtcaaaaaattacatgcagtgaaatgtgcaaagtgttgtcaccttaaatgtatgcttgatgaatttttgtatatgtatacacccatgtaactacaatcagatgaagatatagaatattctagcatatcagaaggttagaatagaactgttatatttctccttaataaaacagtctcgctcaaattattgttttggaccctttagatgggaaagagtcatggtgagtataacatatgtattaattcctttgggagagtagaaaaattaatagtgtgtcttgcccttttcaaaggcaaatgggcactggtctgatttccattattcatggaagtatagtgctcattgagaggccccagaaacagctggtgctttcaacaacctttctcactttttagggaagggctgttaaagaaatgagagcttagtcatgggtgattattagcaagagagagcagtgtctaaagaaactttaattacttattagtagagtatgaattttgtgattagatctgcaaaaggccttagattatcttgtctagccccttcctcatgatgacaccagattcaaagtggcaaatgtcttatctaagtttgtctcggggcctctgactctcttaaataaaaagtctgtcattttctgtgttaaatagtgagaggagaggaactcaaccaaagggcagaggccaagtttgtggctgctgctaagtgacaggtaaacatgttgggggaagagtgacccattctgggatcttcttcaaatgtcctcataaaatatgtgaaggggagagttcagagagcaaaacctactaatttctggacttggattttgctaacaatacctgctttctgcctattgcaggctgtaactctagcctgctgcccttccttagatgcttggaagactctcatgggtcccaggaattagcttgcaattgaggagcatgggaaactcctcttttctctttggtgtctttctgtctccatttcattctctccctcgtcttgtcttgtcttgtctttttcttttcttttcttttctttctgtttcttctgaatcagggcaaagaagcactggcattctgggggctatcttgacgcctacatggctctcattgccaaggcagtgcggggtcatagaggagccccttttcttgggattggagacacatggggcttttgtctctctctaaagggaattaatagctggcaaagggccaagttctgttctagggttatatttaataccttcgccgtgtcctctttcaagccctggagagagtcctgggtaacctcatctcccatacccacactgagttttctgtttgggggtcatgactagtactgttttattgttttgatgccatatggccatggaacctgtgggacatgccatgactccttatttgataagtcacttttgtaggtgtccaagtgtttcacagactatttcaaaagtcactgacataacggctgggtgtggtggctcacacctgtaatctcagcactttgggagtccaaggcaggtggatcactggaggtcaggagtttgagaccagcctggccaacatggtgaaaccccatgcactaaaaatacaaaaattaaacagatgtggtggcgcacacctgtagtcctagctactagggaggccaaggcaggagaatcacttgaacctgggaggcagaggttgcagtgagccaagattgtgccactgcactccagcctgggtgacagagctagactccttctcaaaaaaaaaaaaaaaaaaagtcactgacataatttttagacatctgaaagccctgagctaaaagtatgttaacaggaaagaagtaatctcttgattcctttcctactgccaatggcttcttttgacctgcttattcagtagaggggaatctataaaaaagagtgccaatgagccccatgtttcttcctggacttttatggagactgtcagcatgcatttatacaggaacaagggaagaatccatcatatacacttcaattaaacaaaaattgcacatcatttctagggcttgtgggattaatcttaaataataattatatagttctaacagaaaacatgaaagaacccataaaactctatcaaactcagtgacggtatattttaaaatgctttatcacctatgtttatcattgtatgaagcttaagaaaatggccagaaccacctaggtctcctctgtgctttttttgcttttctttgcaaaatatgagtgatcctattcatttttttgttcattttaatggcatctcatttagtgtttttcttttttctttctttctttctttttttttttttttgagacggagtcttgctctgttgcccaggctggagtgcagtggtgcaatctcggctcactgcaagctccacctcctgggttcatgccattctcctgcctcagcttccaaagtagctgggactacaggcacatgccaccatgcccggctaattttttgtatttttagtagagatggggcttcaccatgttagccaagatggtcttgatctcctgacctcatgatccacccgcctcggcctccgaaagtgctggacaacacgcccggcctagtgtttttttttttttttttaaagcttaactcttacctttttccaacttttttctaattgatctatattcagtctttaaaaaatctaatccagtttttgataagattggtgaagagtataaatttggttgatatcttcatgcattcataactagacaagcttgttttctaaaataataattttttttttgagatggagtctcgctctgtcacccagacttgagtgcagtggcatgatcttggctcactgcaatctctgcctcccgggttcaagcaattctcctgcctcagcctctcgagtagctggaactacaggtgcctgctaccatgcctgacagatttttgtattttagtagagacggggtttcaccatgttgaccaggctggtcctgaatttctggcctcaagtgatccacccacctcggcctcccaaagtgctgggattacaggcatgaaccacccaccacacctggcctgttttctaaaataatggaacaggaattgtatctgatgccattttacttgcaattatggaaatagtcccttttccctaatagtaaaacttcaaggacagagttgtattagttggtggcttacccgctagccttttgatagtttcatcaaaagtctccttttgatagtttcatcaagagtctccttttgatagtttcatcaagagtctccttttgatagtttcatcaaaagtctccttttgatagtttcagctgggtggggtggctcacgcctgtaatcccagcactctgggaagctgaggcaggaggatcaattgaggtcaggattttgagaccagcctgggcagcatggtgaaaccctgtctccaccaaaaaatacaaaaattagccaggtgcggtggcgtgcacctgtggtccccagctactcgggtggctgaggcaggagaattgcttgaacctgggaggcagaggttgcagtgagccgagattgcgtcactgcactccagcctgggtgacagagtgagattccatttcaaaaataaaataaaataaaaataaaaaaataaaaaaagtcaccttttgataggtgattgggtgggttctggtagaaatttttgccatagagtttgttaaaaaatacctatggagtacttactgcgtgagaggtaccacattgttcactgtggtcagaatgctgtatgacagagctcctactcccatgaacttgtgggcagttgatacgtgccatgaaggggaagtacaggtgcagcaagagggtgcatgatcttagggaagatttccttaaacgtttgggctgagatgtgaaggctgagctaaggactacataggtgaagaagagagaagcttaggttctgggaagggggaacagcaggtatgctggggaggctctgagagggggcttggagcataggaggagtgggaatttcaggccacagtggctggcgtgcacagaaccggggtagagaggctgggttgaagctgaggaagaaggtggggaacatatgacgggcaataatgtcaccttattttaggcagataagtgacacaatcagatttgctatgtgaaatgatcatgcaggttactgtccagagaacaggttttgaggggcacgggtagaaaccagaagactaagttgtggtagctggccagtcaggagcagcggggtgcttgcaatggggaggtgacagtgatatggagagatgtggacaccttggagagagatttagcaggtaattgacaaaattatagttttggaaagtgttagctttcttcacaggaagatccgctcatgataaagcatcagtcatataataccagtcagagccttgattgatagactagaaagagaaatcggtgaaattcagaccagagtaagcaaatgaacaaattaaggtgcttgtactcaactccatgtggtgctgatactcagaccagtacttccttacttacttactgtatgtatgtatgcatgtatgtatttatttaaattagatagacacgtaggtaggtaggtaggtagatacaaagacagatgaaacagggtctcactatgttgcccaggctggtctcaaactcctgggctcgagcaatcctcctgccttggcctcccaaagtgctgtcattacaggtgtgagccaccatgcctggccaatggccagtactttactgcagaaggatattggcatttcagtccctgatgggagtgggagggtggggaaggattaaaaacaatgccaatccacttttcacatttgattcaaatttttttaaaccttgcattacaattttatttcctaatagcttgttgtgacaaatttgatttgtagcttctgtttattatctgccacagtctgcttttcctctttggaatattgacaaattttctagctgttgagatatttctttcctaattactttgtgacaaagtagtgaagcagaatccgcttctaagacatagcctggtgtgaagtaattagcttaccaagtagcctgatctttcctcgtgtgaattcactcaactaccgaaataacagccagtgtcactattgcatattgaaagaaacccttaatgtgattctttttttctttgttgtaaatcagcaagaatttatgctcttatttttatcattcctgccaaccaaggagataaatatttcgtaaaatcatgttgggtgcacatcattataagatcttgcctatttctaacaatagttaaatgatgtatttccttagttaatgtccctatacattagaaactacactagtaacatagttaagacttacatattgtgatagtgatggttattgtggaaaattactatgctataacatgaagtgttcagagcacatacccttcagccagactgctgagagttcaagtccctgctcttccatttatcagctgtatgaccttgagtaagttgccctgttctcagtttcatcacatgtgaaatggggataatagaagtactgggttgtccatataaagaactgaaagtactacctcagcatgatgaatgccatatgtggtctatcagagctagctgattttgttgttatatttaacaagcacagaaaagctgatgggaaacactgattactatggctataggaaatattctgatatattctttttgtttcttcttagcttttcctaagcccaaatgggactgtcaattatttgattcttattctgagtcactgccggcaaatcaacaacctcgtgacttgaatcggatggaggtaaaagatcttcatatgctaataaataaggatgtgtatggagctaaatccattggcctatgttctttacaaattctggaaaatgaactttttttttgtttgaaaatgagcttttataacatttccttttcatacttggtaattattaatactttgatgctcagcctttcagatctagacaccagatgtatctataatttttttcccttttctccctaaaactggatgtggtaaagtaagtaacataatctctagaccttctagatgtgaaatgtagatatagccaaactaagacagaaaattctagccaagttatttactttaaccaagctttaattccctagtaaacaattttgattctatttttatcagttgggcattaataagctatactgaatcagaactgttttgagaagaggtttgagaactttatatgagggccccaaatcacattcggaactccctcagggtttttagcttttgaaccaaatgaggactgatttggatgatccccagaaggaacttggagaattcccccagtgttgggccatggatggaagggcttagccaagtgcttaggaagccttagctatggatcaataaataggagttgttatagttattgttgtcatcaccattgtcattatcatcatcatcaccattatgattactgtgatgacaatttaggatacctgcttttcccttccttaaaagatctggaaatgtttaataaatggagctttattcacagactccataatagtcagagactattagagtcctctgaccctagttgaaaccactgcaagatgatagaagtcaaagtcagggaacagggacatttctttaatttcttgtgactgtgcatgatgatttattctctcacatgaggccctcatgcctgtagcatgtgttatggatggcaccgtctgctcccctgtgagccagtcaagcctgcctttccagtgcccctctgactaacatctctctgccattttgcttctctttctttgagttgtgtcctccatggtactttcctcagatttctactcatgggaaaaagacataaagaaaagtcacttcaggaggaatgacagatgtgcatttgaagaattttggttaaaattttttttttctgcagaatgcttatgacaaagagagagataaaatagtttgccacttttcatggccctcagtttactttggggcttctagcagtgtttaaagagctttgtttatcaagccaggatggatacatctatggctctctgactatgtgtgtgtgtgtgtgtgatgggccccctgcttgcataaaatgatgaagttattagttggtcttctttaaaacggccataaaatctgttacacatgcacacgtctgttttactgttacacacacacacacacacacacacacacagtctctctcgcttgctctttctctctctctaatgtcctggatggcgttacatatattcacctttgtggattttatatgcagctagttttatatacttttgcatactttaagtggcctccttggggaggggagattaaaaactacctagtcttttttttttttttgccctatccaaagaagaaagcaaaacaacaacaaaaaatcccctcttttccaaccaaattgttatttttgaggatgctatggttttagacaatgaatgcagtaaacagaattcaaggacaaagtaatagggtttattgatggtttgttcatttaagaagtacgggtcagattgcaataatgattcaatatttcatgttcttctaaactattactgattgttctttctactagtcttttaatctatcatgaatgcatggagtttaattagattttggaaccagccctgtgatcgatgactccagtataggtggttgtgttctgaacaaagctgcagctgatttaggtctcacgtcatgagaaattggcttagtgatacatctttttctaaagacagcagagctgttagccatgtacttatttccattaagaattacagatgataatttcaagtatatttctttttatgagtgtctcttacattactggatttctttctttttctaaacagctttattgatagagactttacataccatacccatttaaagtatacaattcagtaatttttattatattaacagttgttccaccatctctacagtttaattttagaagaacatcatcagcccaaagagaaacccaatactcatgagcagtcacttcctattccactgtctctgccagcctctgataatcactagtctattttctgtctctagatttgcctattctggacatttcatataaatggaagcatatagtatgtagtgttttgtgaccgtattctttcacttagtataatgttttcaaggttcactcagatcataacatgtatcagtgcttcattcctttttaatgctgaataatattgcattgtatggatatgctacattttgtttgtccattcatcagttgatggacatttgcattgcttccacttttggctattgtaaataatgctgctatgaacatagatgtacaagtttttgtgtgggtgtgtgttttcggttctctcgagtgtatacctaggagtggagttgttggattgtatcataacttaactttctgaggaaccaccaaactgctttccaaagcaactatactattttacattcttccactagcagtgtatgagggttccaattttcccacatccttgttaacacttattgtctgcctttttgattttagacaccctagtggaatgaagtggtatctcattgtggttttgatttgagtttcctaatgattaatgacgttgagcatctttttgtgtgcttattagccatttgtatatcttctttcgccaagtgtctcgtcctttgtccattttaaaattgcattacttgtctattgaattgtaagtgttcttgtgcttttggcatcatatctaagaaaccattgcctaatattaaatcacgaagatgtacttccatgttttcttctaagagttttgtttgtttgtttttttgttttgttttgttttttgagacggaatctcgctctgtcaccaggccagagtgcagtggcgtgatctcagctcattgcaacctctgcctcccgggttcaagcaattctcctgcctcagcctcctgagtagctgggactacaggtgcgtgccaccaagcccagataatttttctatttttagtggagacggggtttcaccatgttggccaggatggtcttgatctcttgacattgtgatccacccacctcggcctcccatagtgctgggattacaggcgtgaaccactgagcctggcctcttctgagagttttatagttttagacctttacatttaggtgtgtgattttgagttaatttttgtgtatgttctgaggaagaggtccaactttatttttttgtatgtggatttctagtcgtcccagcaccatttattgaaaagatgtttttttccccattgaattgtcttgcacccttgttggaaatcaactgaccatagatgtaagggtttatttctgggttttcagttctattctattgatctatatgtttatgattatgccagtaccacagtgtcttgataattttagatttgtagtaagttttgaaatcaagaagtgtgaatcctttaacttttttcttctttttcaagaatattttgctattctgacttccttgcatttccatatgaaatttaggacaagcttgccaaattctgacaaagattgcattgaatttgtagatcagtttggagagtatggccaccttaccaatattaagtcttctaactcatgaacatgagatgtctttccatttatttagatatttaatttctttcaacaattttttgagatttctttttatctacattgcctacttctaaattatgttattctccaaaggggcctgatttataatgcaggtgggaaaagacaatgaaagaaatgcactgttatgatacattgtctgttctattggagatagtagactttgaatagaaaattatatctggatacttcgttttaatgagtaaatcccagcactatgtgaggccgaggtgggcagatcacgaggtcaggagattgagaccatcctggctaacacggtgaaaccctgtctttgttaaaaatacaaaaaattagccgggcgtggtggcatatgcctgtagtcccagctactcaggaggctgaggcaggagaatcacttgaacctgggaggtggaggttgcagtgagccaagattgtgccactgcactccagcctgggcaacagagcaggactccatctcaaaaaaaagaattacctgagtgaagactgttaaatcttagaccagttttctactgagtaatacttcagtctctttcttcagaacagtttaaaaacaaaagtattgcttatctctctggggttgtttaggttctgagaggtaaaccaattaactttttggaacaccagatggctccaggcatttactctccttccttcaagataaatgttacaatttatctttatttaatttgtgactatgttttaaatataaacaatatcaaaagacatatgttgacaagtcttcctcccatctaccaactcacctttcaattcttacatatctttccagagtttgtgtatataaataaagcaaatgtgaatatatattattcttgaacttaatcttataggcattagagtgcatattcttttccagctttgaggtataattgacaaaaaatatatatttatgatgttttcatctatgtatatattgtgaaatgattactgcaatcaagctagttaacatacctgtcacctctcacatagttacctttttttggtgtggtgagaacatttaacatcaactcccttagcagttttcaagtataccatacattgttattaactatagttagaatgtgtgttaaattgagaatttacaagaagtaaatttacagtaagtagattttaaacggtttaaaactaattcatacttgatagatttgggtattcatattagtgtgaggacttcccccctgtttgcattaggagaaaattttaatctgctcatcagtaaaattcttttatcccacaacaagaaggctggtttaatcaggtttagacaccatctgcatgacagatcttggcaaacacccacattgtggggccacttgtcagaacttctttgtgtttgtgaaaaaatacataaagaacaggtttgttcttggccaaatggaccagagttgctatgcaattctgtggctgaatcccagtctgaattcagatttaatacatgtgccttaatctgaatcatttttttcctctgtgtatgtaaaatttcaatacaaattaacatatacctcactaggaacctaaaaaaaataaggtagtattaaatgcagggtttactgcagatggaaatggtggcaagaaataatagcttttaagacattttcggctgggcgcggtggctcacgcctataatcttagcactttgggaggctgaggcgggtggatcacgaggtcaggagatggagaccatcctggctaacacagtgaaagcccttctctactaaaaaatacaaaaaattagccaggcgtggtggcgggtgcctgtagtcccagctactcgggaggctgaggcaggagaatggtgtgaacccgggaggtggagcttgcagtgagccgagatcgcgccactgcactccagcctgggcgacagtgcgagactctgtctcaaaaaaaaaaaattttttttcatcatatgtgcgcatcacttaatttctgttccaaccagtttaattcatttacttttctttttcaaagaagacatctgttaaagacatggctgaccttcctgtccctaaccaggatgtaactagtgatgacaaacaaggtaggagaagaatgagttttcttctttaaccagcgttctacctgttaccttatctactcctcttggaatggtggcttctagagcatatgagggtggttctcagcatgtaaacacatttggatagactaagtagttcaaatcattgtcataaaacaatagttcacaaagtggtagcaagagcttgagtgtccagagtcttccaactcattggccccttagtcattgctgaccctcagcctactcttaacaccttacactggaatctgatcgtagcaattaggaaatgacaggaagctgaacgaattgagaacatgttgtgtttgcggatgtgatcccagacatcagtgtaaatgcacatttgcatacagctctaatccatgaggaagttctcttctggacacagcttctgtccttagtgtttatctgtttcttggctttgtgagtgtgggagtgtgacatggagcccagctacaattttcctatcttactgggcagctgagaagcagtgcagcacagcattccgtgttagagctactcccagggaagagttggcttgggaatatctagaagtgtgggagggaccctctcccccacctcctatactttgtatagtgctttataatctaccaggtccttgctcatatactgtcttattcagtcctcacaaaactgaatggaggctggtaagttttatcacctgaaatttagagatgagtaaactgaaattcagacactatgaatcatttgcctagttattaagaaaaagatttgggacaagaaccaagattttttctaagcctcaagccagtattctgcctgttatttgatattgatttactacccatgaatgagaggcttatttgaagggactaaaaatcagtgaagctatttcaggttttattgttaaggcctgccattgattaggcattgtatgggggcttaacatgaaaaataagttttccattaagtgacagtaattgcatgttctctatttaaatacttgcttgggagagacaggtagaactggacattgtctgcagtagcgtgtactctgaccattctcctaactgcacagtggaataactgggcaaactgtaaaaatattgaagcctggatttcactcccagggattctcatgtcatcagtctgggtgtcaggaatgaaagagggagaaactcccaatacttcctggtaatacttctcctatctgcttgaggtgctgtctctggaaagttgaaaatacatctttgctctttgtagaaggagaacctatttccatactccaggaggtctttattgttttagtaaatgctatagcaacttttagaggtttgtgagacctgtttttgtaagtgatgactagcgattctttgtttgaatccaatttgcctcagaaataacattttatagttttaattttttttcctcttttctctttctttttgcttaaaaaacaaaacacaactagctttgaaaagtactatcaatgaagccttaccaaaggacgtgtctgaggatccaggtaggagaaaaccatttttgtatactttatatataattattttaaaataaaaaaacagcaagtcagtgagtagaagattgatacctctgtgatagtgtgtctgtttctctctatttatttgtcttgtattttattacaaggaaaccttttggctttttaccctttctctcttttcaggtatgagaacggggtgatatcttttcaagtttttaagtttcactgaaaggatcacgaaggatcactccgtgtgaatatagggtcttgttactaagtgcaaaattgagaaggcttgaggttgagatgatttcaacaagccattttgggttttgtgtagagtaaggaacttatagggtagatcaattggaggcccagagttggtattttccatttccaaagcagaaatctcaaatatttttattatgcttcaccaccaggaaggcaactatatgtgcttatatatggagtggattccaaggagaaaaataaaagttgtccagttttttggagagtcagacctgtgtctgtggagtcatggagaatggctgcccctgtgtccgcagctctctgttgatggagccatcattgaaccaagttgaatctagttaaaaacaaagtggctacagaagacattactatttggagctctagttataaggacatgaaaaaagttgttgctttctcttttgctgttttatttcttgtatatttttaataagtcaatcatgtttgttgtgataagctagctatcatcctaggcttatttgttgaacattggaacagaggaatcaatataatgttgaggcttatgctgtggtacaatattttccaaatgtcaagttcattcagagtttcaaagagagatgggtggagggagaggaaggagttgggggagtgggagaaaaatatggtagggggaaggagagagagagagaacatgagaatgagaataaatatgaatgaatgtggatgatgaatttcaattatggaagcctgagaaggtgtatttttaggcagctccccagttggttctggtacatagcctattttgggaaccaccagctctggaaggtgatgctacaaaatagaaaattaaggttatagatcaaccatgactccaaaagtgatgggaattcccaagcttaattttgactcttgaaacagatttgaattcattccttattgggtgaaatgctctgttaatgtaggccaacgcctggggtcagttctttctagctcttatttctggagctaaagtggatgcattccagtttttgtaaacttcatgttgtagtattagtaaaagctgtttaaatttggagtgttaaattggtgcttctccaacagcctttgaggatcataacttttcctacttttttttttttttttaagggattttagcacaagatcaagtgtcctctggggcatgagctttagatctcatttttaacattccttcattgactaggacatggcatcaccaaataaaacttgtcaggtgtgccacagcatgagaagtatgtcggaattgatttctcgttgtgcctggcagcatgctatgtgttttctgatttgttcttcccactactgcccctctctgggtatgagggagttcctcatcttaaacatagttaatccctccttttctgggaaatgtttggattcccagtgggagacacaagcgtttcaaggtggtgatttagaattctggatggctgtccttgccatgtggacctcagttcagttgctgctttttggagggttaatctctaggcctgctcctctttccattcccatttcctggaaagatgacatgccttgagtgttctaggaaggtggcagtccttttccctctttccagctacacgagaagctatgatccacttgttgtaattgctgagagtgtctatgttagtggagccttaagagattttttaaaccaatatcccattccaacctaattcagcagagcaccatgcacaatggtggtctttttcttgatgtttctggcccatgttgaggtgttttcagctggttcaccctcacagtgctgtctttagactgttgttggtgattctagcagctgctccattgccaactatcaccccatgtttttattggagtagagcagttctgtccttccattacctgctcctacctgcacctcctttgctgtcctagaagaaactaaatttagaaaccagatttccaggcttaaaaaattaggagcctttatttatgcactctacaatagtaatattttgcaattctaaagtacgttcagtttttaaattactttcaccttatctgtccctgtgagaaagaaactgcatttttattgcctttgttttctaggtgaggagactgaggttcagggaagtaacagctagttagtgtcatggccaggaggagggccttagtctcaggactcctggcctggtctctagtcctgtctctccactactcatccacaccctcaccccatctgtctgtctgtctatctcttaccagcagggctcacccctccttccacacccatccctaccagcaaaaagacaaagataatggcacttgacaaaggaattaacagtcaccatggtctgatttggggaacagtattttatcatggcggggacctctcctacccatgtatttcttgaaagcagtggggcctgagggagaagagggccacggagccagctgcaggcagcctgcgtagagggcttccccagctctgtggtgagtctggtccactctgtccacccagccccaaggcagcctcctgagctgggagagaggcttcctgaggtcgctttctttgctgcctggggtttgtaggagggagggaggtctttttctgtctatatccaggtgtgggtgcacgataatgggcaaaaggggactcaaactccttgggctttccaggctttcctgcactctggcagcgtttcagctgtttgaagttggaagatctctgtgttctcactacaacaagccaaaatgcttgggttgggagaagtgtatctcttgtgcagctgaccagtagtttgctttgtgccttgttagcatttatgaggattttcacctcccctctctgtcctgttatctaacccaaggattttaatgatcatcataaattcaggctgcttcataccaaggagggtttttatctttggagcaatgtaaaagaggatgagataatgcagtgagacattttctttttggaagaattcatgcagacaaagaaattacattcttcttgttctgtgttactagcaccttttctatgattttttatgacattttatgatgaaaaatttgcaatgtttgtaacacctgagcatagctactggttcctaaagttgtcttccatagaggattgaaagcataaaaagaggatcagtgtttttgtaaatgtttctaattactcctcacaacttgtgatggggaagaaggctgtatgggcgttggtagtgagcaagttagtttatgatttaaatttgatgaggaaaagtcatatggctgggaaaagattcagcgatattgttcataattctctgtatgatttggtcacagacatgtgggacacaaggatattttcttacaggagaagctgtatagctcatttccacttacttgtgagagctttgtttttttgtggccatgctgctctggtagtgtatttttttttttttaaaacgtgtagttagatagacttcttcctatccttcagggtagactagttcaaaatctattactagactatcatgatagaacaagaaaccctgaagtgtgaatccatcattatataaaaagacaaccccctttcaagggggttgtctttttatactggaatgtcttcattaattaacttggatttgagaatggcctctcaaatagtgcttgaccaaaggaaaaatatgctggtttttctttccttttaatcgtttctttagattttgaaataaaacaaggaaatcatgaaaatgtgggagccgtccagttctccacatgggcacttttacctcacatttacctgttgatgtgttctgtactagcccaggtgctgcatataaacttgtttaactgcagaaatgaaacccaagcaatatctttgtttcagcaactcccaaggattccaacagtctcaaagcaagaccaagatccaggtagtgttcgtttaatttctgctttaatgccctttgtgccgtgcccctgcctagaaataagaaccacaaaccaaaacccaacccatgatttcctcttcctttagatgtaaagcttaggatatgagccatttcgctcgtgcatggcctgatgggaacatgcagtaatgctgggagccttggtttctgtggtcattagtgctagaaggtgaccatgaatgccctacggcccctcaacgtgaagtggattgtgtgagacaacccagttgttgcaagatgataacttatagggggaagtagctttggaaagaggaaaatatgggtaaggtaacagacacgaaaatttgctatcatgacaaggtgaacaccaaaaagtaaaaagtctgggtaataaaatctacagtagggaaagaaaatgcttctgataacttcagtgaagcttgcagtttcaggtaagcgatgtttatggtctgtttgagcctatcttagtgcccctgtaagcttcacattttttaagaggctagtacaagagagaaagccagtaaggcagagctgtggttgatgtgagactcagaagagaggtgcagaggggaaatacagagacactaatagaattaatccattaaggaagggaaatggtattggtactgtatttcactggtagaactgcagtgtaagataggataacgaggataccatgtgtgtgttttctgttttgctttggctgttagtgacatttttccctcctttgcctactagacacaatcctgaaaaagtaaatttaagtctgatcatattttatatgcttgaaatactgatatttaaggaacctcatctctttgtaagtcaaagagttatcctttagtttatatgtgcattttccaaattggggttttgtttccttgtttatgtaagatacagatatctatatttttatatttatgtgtatttaaaaacaatagagtaattcatttaggtaggaagaaaaggtgtaggcattctttctgtggtcaacacatttactcatcctttgtaaaaggatgaatggatcttttacaaactagtctgtactagttgtgggatatgctttcatagtaggaattgcctttgaattgcagaaatctgttatgtgtactatgttaaccataaatcgaacctcaaagttttagcttctgctgacttcctctctccctgaaagccagtgaaattataaaatctcatagccacacgttctgttattaatgtgtctggctaaattttacatattatcctttcagagattgcgcttttggtctaatttggaggattttattttcattacttctcactgggaagaagagaattgaattgtttttatcctcctttttgaaataataaagttttgtagaaatataagggaaagagggaaaatcaccattttaacaccactgcattcatcattttgttaactccctgcacatttatgttttaattggttgcagcagtcatggttatacaatctcacttattttatattcagtaactttccatatgaagatataaacatacaggttatatatgaaaataaaatgaaaatgaggaatgtgcgctgtgggattgtgtgcttaacagtgtgcacgcatacacattatttacacacacattatttcttttttgagtgaaagatgtcactaaagctatatgtggcatagaaagctcttttcatttctagctagggtctctaattgtcttttttaagtgaagtgttcccatttaagaaccttgtccttccgtatcagttccctttgattcttgttgaaagagccagagcattcttccctgctagtttctgcctgttgctgccttgcctgtcttgccagttatgttacagggaccaccccagaacacgtcacatgccattatggtggctttattaaagttacaaccttgtaagacagacagaaccctcaactaccacaaagaatccttgagaaatttattcaggaaaataaaaactcacaatgtcaaaaacagctctgtcaagaactgaaggggtttaatagtaactgatatattctaacttcataaatgccactctaatagctaagtacgaagaaggttttcagaggttaatttgtctctctaggatgtacctctgactcagaggtcgttttctgctttgacatgaagctagttgagaagctaaataaaacagatgtatacatctacatcttagggccttttcgtgatcatcgtattgggaacccgtccttaaacctattcctaagcagtgtatggagttgaattttatttggaaagtaagtaggtctccaataaatattctagttgctatcaccaaagtattcccccgccaactcataggcagtatgagaacattttaaaaatgggatatagaaacagagattggagtttgaatcgaactgtgtaactttctatctgaccttttgcaagttatttagttcctttttaaaaagatgatattaccagagttacaatctcagaagttgcctagttaattatgccttgctatagattgaggaagaaggttgaaaatgagacttttgctttctcagggaaagacaagctagacccctcaatctgattgatgtgtgttttcctttcccagcttcgtttgtggcatattcccctgaacattgaattcttaccctcagcttatctgtcccaattccacatgagcctgtcatcacatttgcaagtgaacaggagaaaagttctctgatcagtttataccatgaaataccatgaagcccttctgttagaacatggaaatgcctaagctgaggggctccatattattcttattaacaattccaatagaaatggatttgaatttacacaaagttttttttggggggttgattcagatctaaggtataataagaacaaagaggttgaaaagatcccaattcatagttggatttggacaattattgtacatagtggcattcaatgggtaatagaatttatggctgctttggtagctcatcggttctttgtagtcactttgacttcgtgggtattttccatttcaccccaacttcagagagtaaagctttgctatttcgcttctgaccttcccttattttgctacagatcttactctagcacctccatagaagaggccatgaaaaggggcgaggaccctcccaccccgccacctcggccacagaaaacccattccagagcctcctccttggatctgaataaagtcttccagcccagtgtgccaggtgaagtgccccttgccccctgagcccttccatttcctgttggagccagcggatgtgtgtctgccacagtggcctctgtgagtccggagaaagagcagacctggcagtttcgcattccgtgaaggtcttcacgtggctatggtattcttgggagagaaagcaattctagacacatatgtagcacatgtgtctggagccttgcccacacttgttatggatcaagaattaggaaattctctaccaagaggataaaaatgcttcactcccatgcagcctgctgagtgtgtggctggggtcttactctctgcatcattggtaatttgtgaacaagatagatcgctgtctgtcatttcctcagatgcctgtgtggtcttctatgaaagatcttggagattaaggcctagccagaaccttctcctgcattttacacttatggagaagatcctgtgtcctgtaggatttaatgctgaggggactctgaatctgactgatggttgggtggttggtggagggtcctagggcaagggctccttcaggtgggctgctctgggcttctggggatgggatgttcttgagcccgcagttgtgtagtggggctggaggtgggggaggcccagaggggccctgtctgctcccttggcttcctgtgaagtagaagataccctcctaaggaacctaaggaatagaagatgggaggcatgcctttgctttagtgaaggtgataggatacggtgctgtcccaagtgttattttgggagcagcaagggcctttccactgactcatgcaggcaagctataaatacaatgatttcctggaactttttctccatctatgtgcattttaaatcaggccagcctcagatgctagtgatttgcagattattatcttttctgctaaagcaagaaaagactttccttggctcacacattagcatgacctctgtgtctgggcagagctcagcatgttttatttgttctaataaagtattctcctcacagtaaagttatagattgttttttaatatactaaaatctggaactctctatcaaatttaattctgtgccatgagttcatcagacaaaaatttgccttgaatttcctctcatactttgatctgaattctggcataaatttcatagtgactggtatgtagggtgggagtaaccacaggtgatgatgctataaaaatttcacatggctggcggattatgacctggaagattttcctatggatgcgagaaaattaaaacaatctgggaagctatctcagtacctttaccttgcaagaagggaggctggaaatgctcacaggtctctctcaggttgtgtgacccagtaaggagatgccagctgtactggagaattcacatgctgtggtttttacgacactgcatcacatagtggaagagacaaaactgggtttggagctcagctcagctgcttattcactgtttgattttcagcaagtagcttaatgtttatgcatctcagattcctaatctgtacagtagagccaatactccatggagttgtaaggttttggtgagataataaacataatccaaatatgggttgaatattccttatccaaaatacttggggtcacaagtgtttcaggctttggatatttttggattttggaatatttgcattatatgcttaccaattgagcatataataaaaaaatctgaaatgcttcaatgaccatttcctttgagtgtcatgttggcactaaaaagtttagggttttatagcattttggattttggatttttgggattagggatactcaacctgtagtactgtatttggcccacaggccttagtaagcatgtaaggcccatattcccgtggcctgcaagtatcaagaatttaatgcctgaaatggcaagcctccaccgaggaggataacaccccgacttccttgacccctagcagacaattctgtgattcctcctacccagtttctcagaaggctcgcaaaaggactgaaccccagttgcctgccgtagtacaccattcattgatgtactttttcttgttttgcttccctcctgccctgtctcactttcccctcactcgaataatatacctgttctcaagttcatatgtcaggggcttctttagagaaaacctgaattaagacagctttctttgatatctctgtgtcaatgtgacttcaagatgaaaagtattttggtttgataatgccctgacgatctcccttgtggtagggcctgataaatctaagatttagacaaataatagctaggtgggtgatgtctctgttcatagcctaattccattgtcttttcagtacaaatttatacagatgaaattttaatgagcagtttaaatttatcacatgaagaatagaacatttctgcagtatgaaaagcaggtggtataattgcatctactttatttattttcatgttggttaattctcacagaaaagtataagggtctgtctaaattatataaaattttagtgtattgcatattgctagaaattatcgaaatgctgacaaactagaaatgcatgaaatagagcttaaacctaccagaagagtctactcactgagaatcatggtgtacatttaggcatccctttgctgcacttatctttatgtatcactttagataaatgggatcacactatgcttgctgttctgtatcctgatctttccaattaaccatctttctatttcatatagaggattgcaccgttccctttaaggtgtgcatgatatggatataccatggttgactgtgctttgatggagagatctctcccttcttctctctgccttttctcttccccatactttcctcttaagctcacccaccaccccacgaccccagcccccgttcctttctcacccttgcaaacaaacctctctctctctccaccccgacccccgtgtcctcttcatacccctctgtttctctttttgtccttctcccccatcactccttcacaggtatgagcctcccctcactctccccttgccaagctcccccacaccaccaccttgttcttataatataaacgaggcagaggttattaataatttcatgtccgtatctttgtttcatcatctaattattttcttaggttaaatcctgctggttggagttgcagggtcaaaggctgtagatgtttaaagtgtagctatatgttgccaaagggtgaggtggaacacctgtcaacttgctccatcatcaacactgtctgaaagtgtttcctcacaatcttgccaacactgcttcatgttcatctttttaatcattacctgtgtaataggcagtttcatgtccctgattcctagtgaggctgagaatctttttgtattgttattggccataaatattccttctcttatgatttgcctgctcagaaggcttggccagcttctgttgctacatctctctttgcctaaccacggggaccacttctttcttcttcattttgcctacgttctggacctccctcctgtcaggcacttgggaatgtgagggtggccatggggaagcctacctcacctgctgctgtgctgttccttgtccctccagccccgccccccatatcccctccttctgccaactttatcacttaagacagactgcctgggtcaccctgtttatgacaatagaagaataaggaaaggtaaagaaaagaggggaaaataatgtgagatgaagcaagatgtggacttgagttgaaagggaaagataaaatgaagcccttgtttaataaaatgagactcaggattgtgaaaagcagtgattgaagctaaggtgctgatacagagtggcttaaagtggagtgatagtgtggaaaggaaataggatggagagaagatgcaaagaaaaatgaaaggaaaatgaagggaaagatgggatggttgttacataggagtgatgatgtttatccaaaggaataagcaggaaatagaataaaaaattgtagaaccaatggaaggagagtccacagactcttggtgtaggattcaagcagcatttaaaggaatagcttagaagtaggtggcattaatgcctttacatttatgaaaataggtaacatgatatggggaaaaagaacaaagggctgatttagaatgtaaatctataaaaatgaataaggccaactttggaaatatagaacagttggcttcaactttggtgtctgtaaagagagtgtgaatgtgtgatttatagtagcctagatgattccagggctctctaggtactggcatcagacccgaggcatgtgttttcataaggagaagcggatacactatgatcgctgtgtgtaacagggagatcaccatttgtaatagctgacccagttcttggagccattgcctcacagtcccacacagctgctgtgtttgagagatagcaaaaatgtgcaagaaagtctaagtcagtgacaatgcaagtatgcaaaacctagaggcagtcagacctggaatttgctcagtgatgtttggattttatgtctctatatttatagctatgaaacatcttttattactgagattcctgtaagaaaaatcacactaagctggtacctaacctccttttcctcaatgaaacagttattttcatgaggtaatttttttttcataaaaaggggtttcttctgtccacggagtcagtaagaactacccctctcttctactcttgattcagacctgcctcttctcaaagccatgcctgaggtttgtagcctgaggtttccatggtgacagtaaaaagccttagctctgccttgttccagtcattgagcatctgcctggcagaaggggcagagatggtgtggaggagacatagccattcctttaaagtttcagaccgggcattttcatcatttccactcaaatctagctgggggacctaggcccatggatagacctagttgccaggcagctgggaaatgtagtccttggcagggcagccatttcccagaaatacgtttcttactgcaaaaaaggagaaggggatgttgatggtcagttgtttttttttaaaaccacatcccatatggccaaatacattgagattcacacattaaaaccattgtgatggctgaacagaacacatccagggctagtgtctgtccatgggtagctaatttcctatctctgctttagatatactgataataacaactcattccatggttaagagactatggtacatccatcctatggaattgtatgaagctgttaaaaagaacaggcacgtatactacatggagagctatctcggataaattaagtgacaaaagtatgatgcagaatgtgtatgtttataaatgtgtagacaatttcaggatgatgctaaagaaactggtaatgatagttgcttctgggcaaggggaacagtatgactgaggacaggactgggaaacaagcttactttctgttgaatgcctatttgtatctttttaattttggctcatgtacagatgtcacctattataaaaaatttgcttttcactctttagctgcaatgatggtatctgaaagtaccagagatgtctttcctgcctgaggttacctatctcaatcttccctacgattctgtattcagggtatctttatgaccatctgctaccacctcctggaatgcagctgaaatgacagaaatgttccgagcactttttttttttttttttttttttgagatgaagtctcgttctgtcacccaggctggagtgcagtggcgtgatctcagctcactgcaagctccgtctcccgggttcatgcccattctcctgcctcggcctcccaaatagctggggactacaggcacctgccaccacgccctgctaattttttgtatttttagtagagacggggtttcaccgtgttagccaggatggtctcaatctcctgacctcatgatccacccgcctcagcctcccaaagtgctgggattacaggcatgagccactgcgcccagccccgagcactcttttaagctctgatgcgttcttcagattccatttcagtgcctttccaacactgaggagtagttctggaggacctcccaaagattacattgtgagatgtatagttgggtaaaacgtcatggtaagggctctgtcttaacttggaagtggctgtgtttattgagtggcgaattgagaagtctttcctcggttttctataaatgaatatttgtttctgtaacttaagaagtaggtaaactccttgggagtaagagatgttcctaataccaaacttacctttcaggttctctaaaagatgaatttggccacaaaagcagctctgaccttatatatttccttactgtatttttcctgtgagtgctacttgtttcttttaaaatctggtaggactatgggattcctgacccaccccaaacctttgggcccacagtgcacagctatccaagggttcaatttggcagtctgggcagtttttttgttttgttttgtttttttgttttttttaaatgaaagcgttattgagatgtaacccatatactataaaattcacctttttaaagtgcacaattcagtgatatttagtatattcatagtgttatatataactatcagcactatgtaatttcagaatattttcatccccctcaaaagaaaccccatacctattagcaatcattcccattccccccttttcttcctctatcccttggcaaccactaacttactttctgtttctatggatttgcccattccggaattctgtattaatagaatcatataatatgtggtcttttgtgactggcttcattcacttagtataatgttctcaaggttcatccatgttgtagcatgaatcaatacttcattccttttatggctgaataatctttcattgtatggataaaccacattttggatatttgggttgtttccactttttgactattgtgaataactctgctatagacattcatgtccaagtttttgtgtaaacatattttttctttctcttgagtatataggtagggctggaatttctggttcatatggtaactaactctatgttgaacattttgaggagctattgaagtattttccagagcagccaaaccaatttatttcattagcaatttatgaggattccaattgtgtttcttcacgtcctcaaaacacttgttattgcctttttaattttagccatcctagtgggcatgaagtggtattgtgattttgatttgcattttctaatggctaatgatgttatacatcttttcatgtacttattggtcatatttatgttgtctttggagaatgttcagaatctttgctcatttaaaaattgggttgtctttttattgttgatttgtaaatgttctttatatattttgcataaaagttcctttacagatatttgatttacaaatattttccttcgttctgtgggttgtcctttcatctttttgatggtgtcctttgaatcataaaagattttaattttgatgaggtctaatttatgtattttgttgcttgtgcttttgctgtcatatctaaaaaaccattgcttaactcaaggtcacaaacactcctcttttcttctaaaagtcttatagttttaggtcttacatttacgtcttcgttctgttttgagttaatttttttatatggcatgagttaggagtccaaattcatttttctgcatgtggatatacagttgtcccagtaccatttgttgaaaagactattaattatccatttaattttcttggcacctttgttgaaaatcaattaaccataaacataaggatttatttctggactctcagttctgttctgttggtctataggtctatccttatgccagtaccacagtgtcttgataattgtagatttatagtaagttttgaaattgcgaagcgtgagtcctcctgctttattctttttcaggattgttttggttattctgagtcccttgcatttccacatgaaatttatgatcagcttgtcaatttctgtaaaaacaaaaaagccagctgggattttggtatggcttgcattgaatttgtatatcagtttggttagtattgcggttttaataacattaagttgtccaatgcatgaacacaggatgtttttccatttatttagatctttaagtgtctttcaacaatgtttcagtatacaagtcttgcatttcttttgttaaatgtattcctaaaagttttattctttttgatatacattatacattatttcttggagatatccatgtcagtactgataattttgtatttcttttatatatcatctatatgctggctgctctgttaaaaaccgtattatgaaaaatttcaaatttatgcaaaagttgagaacctccacccccatattattttgaagcaaatcccaaatatcatataattgtatatataaactctttgtatatctctctaagagataaggtcttaaaatacttgagcacaatacctttgtcatacataacaaaattaacaataattctttaatatcatttaatatttggccagtgttcctatttcctgaattgtctcaagtttgtctttttatactagtttgttccattcagaattcaatcgagggctacatgcacattgcacttgttttggcatattttaagtctcttaactgataggttcttctctcagtcttttttttcctctttgcttttcatttattcataaaaagtcatctaccttgtagactttttcacattctgtattttgctgattgtttgttcttccatcccatgtatttcctataaactaataggtaggtctaggcttgattagagttagtttagatttttgacaagaatactacctaaagatgctgtgtacttcttactgcaccacattaagagatctctagtgtctaatgcctttatttttgtggtgtttgattgattaatgggtttacgtagtattggcctgatccatgtgttatgataaagatcccagcgacctttcaaataatggttttatcagctattgatcatcattgcctacatccagtggtgtgtcagtgaatgtttaacaaccggccacttgccaatttttatggtgtaaacactcctgccatggctaatttcattcctactgatgtgttactgaatgtggagtttggaacagatgcacacagttggctctcacaagctggcatgagctttttccagcaaaccactgcttagatccattatttcattggtagttgcaaaatggcgatactctattttttctacctttattaattgggactatggtttatttaagcattttcctattgttggacatttaatttgtgactattatgaagcttgtgagctgaaggagatcataaaacataattctcagtacatcagtaaattctttatatacatctgaatttatagaattgtatgaaaactgaaatagacttcagtaatggtgaccagaaaagtgtcttattcaaccagtatttaatgagcatttactgggtacttggcactttggaggatcccaagagggatatggatatgcccccaaactctgctaatcaatgtcacagttgtgtgtgattgttagaagggtttagagtttgggtggttgctaactagaatgatcagtggatttgtgggcagggggtgcacagggctggtgagctaaactttgaaggatatgacttttcagtcaaatcctattcttttttgacatctgtcttgatttacttcttatgactagtttcctgggtgtctactatagtagcctcaaatctggcttgcttgctttgttctttccttcataaagcaacaggattaattttctgcagcacacctatgatcacttccctactcaaaactcttcaggacctactatgtaatcaccaaatttctggtggaactgaacccgaagccatgtgattatattagctcagtaagggacacagtactgtggcctggagtgcctggggaggagtgtattacaggaaggaagtagagactagaagattcaagttggctggctggccaagaaaaatggagactggtggagaaggagtttgtagacggtgtctttgggaagtcttaggagaacatcccattagggtggtagggttaagccagattgcaaaagattgtggcataagcaaggaactttggtgtggagaagttgtcatcacaaagtcattttgaaatgtcgaaggtttagcagttgttctgactgtatgtcacattttaaaaaataatggtagtggccaggtgcagtggctcatgcctgtaatctcagcaccctgggaggccgaggtgggtggatcacctgaggtcaggggttcaaaaccagcctggccaacatggagaaaccccatctctactaaaaatacaaaaattagccaggcgtggtgatgtgtgcctctaatcccagctattcgggaggcttaggcttgagcctgggaggtggaggtttcagtgagccgagatcgtgccactgcactgcagcctgggcaaggacagagtgagactctgtcgatagatagatagatagatagatagatagatagatagatagatagatagatagataaagatacataagatagatagatagaggtagaagagagccagttccaagatgatagactgtttttatagattgccttcctcctaacacacatttgtattctctctctctcccccaccgcattattcagcgctaatgaaagtgtgatggaaacagctgctagtgaatgaatactaactaatcctgaaaaaaagatgtgtacttcttgaaattttagtttgatttacctgaaaacatatacagaaacacaactagtgatttcaaccaaccctagagttttaatagtaaaatgcttaggaggaatgcatttgtgtaaatgtaatatgagagaggaaaccagacacccatctttgaccaagattgaatctcatgcatttttgtcacttaagtctgcccatgtctccatccaggacctagttaacccttattgcgtatcctatggtacaggaaaaatgagttattagtaaacatggataaattttagaatcatgaagtgtcaatgctaaaagagaacttgaatgtcatcttggccaactctcacatattaccaacaaggagactaagatccaggcaatataatggctttgttctccatcagaatctttctttccttttttttttttttttttaagatggagtctctctctgttgcccaggctggagtgcagtggcgtggtctcggctcactgcaagctctgcaggttcacgctgttctcctgcctcagcctcccgagtagctgggactacaggtgcccaccaccacgcctggctaattttttgtatttttagtagagacggggtttcaccatgttagctaggatggtctcaatctcctgacctcgtgatccacctgcctcggcctcccaaaatgcttggattacaggtgtgagccaccacatcctgcccagaatctttcgaagttgggaaatctttgtttagatctttgttgcagcagatttggtatcaaagaaagctatctacattaaattaatttggagggcacaccctactacttttctacgggcaataacactaattaatatctaaagttaaaggatgtattaaagaatgaatatggtaacctttgcaaggcactcttcaatgtgtttttttctgtgtttccttctatgtgatttaaaatgttagtagatttctctgaggtacttcagggagataggaaaggagcttttgccctcatagatacttggaaataatatatctattttctttttttaatttcaaaaatgaaattattattaaaagctctaaatatagcaagaatataagacaaatagtatactgaacatccagcttcaacaattaatcaactgtgtcccatcttgtttcatatctgtcttcccccacattattaattatacttttttctacccttagcttaaaaaaaactttattgaggtatatagatcataaagtttatccattttaagtgtaaaatttaatgatttctagtaaatttatcaaatagtgcaactttcaccataatccagttttaggtcattttcagcactccaataatactgcacatacctgtttacagttaatccccatgcccagccccaggcaaccactaacctattttgtgtttctgcagattttccttttctgaatatttcatataaccgaatatacaatatgaggtcttttctgtctgactttgtttacttagcatgatgtttttgaggttcattcatgttgtatcatgtatcagtacttaattcctttttattgctgaatagtattccattatatagctatatcacattttgtttatccagtcttcagtttgacagacatttgagttgtttctgctttttgtctgttatgaataatgctgccattaatatttgaatacaagtctttgtgtgaacatatgtttcatttctcttagctagatatataggggtggaattgctgggtatgtggtaaatttatgtttaactttttaagaaatggacaaattgttttctaaagtatctgcaccattttacattcacatcagaaatgtatgagggttactatttctttatatcctcacccacacttattattatctttttgattatcctacatcctagtgtgtgtgaagtgatatctcactgtggttttgatttgtattcccctgatgattaatgatgttgagcatcttttcatgtgcttattagttattcctgtattttatttgatgagatattgtgttagtctgttttcacgctgctgataaagacatacccaaaactgggcaatttacaaaagaaaggtttagttggacttacagttccacgtggccggggaagcctcacaatcatggcagaaggctaaaggcatgtctcacatggtggcagacaggagaagagagcttgtacagggaaattcccatttttaaaaccatcagatcttgtgagacccattcactatcacgagaacaccatgggaaagacctgcccccatggttcaatcatctcccactgggtccttcccacaacacatgggaattatgggagatacaagatgagatttgggtggggacacagagccaaaccatgtcagatgtctactcaaatcatgctcattaaaaaattgggtgtttgtcttattgttgagttgtatattctgtaattctttatatattctggatacaaatcctttatcggatagatgatttgcaaatattttccacagtctgtgacttgtctttttgttttcttaatgatatgttttgaagtacagaagttttgagttttgacaaagtgtaatgttaaattttttccttttggattgtgcttttgatgtcatatctgagaagtctgcctaacccaaggtcttgaagattttttcttgttgtaaaatttttatagttttagctcttacgttaagatcttgaatccattttgatttaatttttgtataaggtgtgaggtaaggatctaagttaatctcttcgtatatgaatatccagttatcccagcactatttgtcaaaaaatactctccttttcctgttgccttggcacctttgttgagaatcacttgtctgttaaatataagggcttatttttggacactgcattctgttctgttgatttatatgtttatttttatgctagcactatactgaatgttttttaacacaggggagtcatacataatcttgcaaagaggtaatcccacgactcagaagtctttaagtatttgctacaatggcatattttttagatagtatatagtagcttatttacttcatttgtggtttgtagcatgttcagaaggatcctttgagctccttgaggttgcagtacttctttgctttgaagccttctgtcatgtttattccctgaatgtagaataccctctgtctagctgtttatcctccatctctgcatttttctgctctacctgccctgtaggttcaaaatgtggtactgattactgctcgatagtagccttgtgtccttggcaaggtcattttatttctccaggtcttaattttctcatctgtaaagtgaaagaatcagattttatctcactacttttctaaactctgtcgttaatattttccttgttgaacagttacaaggatgtgtaagttaatctcttttaactggtgaaaaagtatattctgttccatagagaattaaatgagcttgtatttcggggggtggtgtgtggtcatcaggggatagaggcaggtatttctggaaaggtgttcttggcaaacattttgttacatacactggtgtatatgacatacatgtccatcactgtatgctgggtgatcaagagatatgtataaggtcatacatgcttttatgattagaaaggagagaaagaatgaacaatttctgttacaaagaaatagccatttttatgaacttgccaagaagaggaatggtccttactgatgaaatccttaaagctttgcatgtggctctttacttgattgatatttaaaagtataggtcccactgggaggctcctttcaacattttccattccttgagtgtttttcccccctttggtattcgaatgcttttattttcttcacataaaatattcctagttaggggggatgggagcccctttccacagctgaagttattccaagttttgttccccctgaagaatcggctctctgttcctgaagctttcaatggccacatctgctgctttatttccactcaataagttggaatatattttcatttagttattgattaggggctatgtaaaaatctgaaggaaattagtaaatagtaatgtttatgaataacattttacctagaaatttctaagcgtaatgaaataagaggataaaaattgttagaggttggagttttggatgaaggtaccaggaagcagagatccaataaatcagtatcagaatctgcatgtctttcaataaacttaagaaattgttttaaacactaggaattattagtctgtcttctgaatttaggattaaatgacagtttcttttcctgaagtttttaatgtggttttcaggattggggtatttattattttcctttggattacacttataaaaatttttggctggacaaagccttgctgatacctagtatcccactttattaactataacacttgacgaataaacctgcaattgcttgacgaatatggtcactttttaaagtatgtgggaacaacattcttctctcgtcttcttgccttcttttccctcccaggaaagcagttgttactattaacaagtatattgtcatcttttgcaactgcacactagattattcagctattttttttcttttttttttcctttgccttccaccatgcgatcaaagtattttttaaatttcactttgcatgaaggtgtactttttcttttgactgattagggcatactggataaaatatttggatccaattttaagtcaagagcagactgaaaatattgtaagagaagatttttaaaattaaatttaattccaattttcaaccactgtgtgagtacctactaaacataaggcagtgtgtttaggtgctgtgggagacaaaaagatgaattagacagaattgatagaatgtagctagattaatatctcccaccattaaaggaaaggaacacagaattataaatgcaaggaagagatttttcagcagcaaccgaacaaggaaaaatgcatgagttaatgctatatatatatatatatatatatatatatatataattttttttttggaaagagtggcaactgagggaaacctgaggctttgggtgcacttctgactctgcctgcttccttgcagaagctgtgtgtgtgagtaggcaaatcttgagagttctcatcgagaccctaggtctagagcaaagtgaaatgaatgagtactcgtaattttcctttttcttgactaagtggaaatgacttcaggaaagagagttggaaaagtaaataatcatagctgatatcctgatattgtagaggggaaggcccagagcttcatgctgaactggggacaaactgaagtctgagaagttcctccaaggccattgatagaactccaagacttaggagaatgcactctgctgcagggttttaaaatgttgattattttggtatttccttcgtaattctaaatagcatatttgtgtaacttcttgtagacttcaatttttgccatcatcttccctcccccattatctttctcctccacccttccaatatagttatattataattttggttagattaatatttagtgtttatattattattgttatagccatgtaagacatatagtaaattactttttttttttacttgcacaggtttttgtttgccttggagtgaataatcaacttgtttcttttcaaagtacttgcccttgattcaaccacagacgtcttcaattttccagagttcctcttatgaaattctcacacctcaggtgttctgtcagtttcagctttttgaagcaatagaaactgattgtcttcaatgcctggtacatagttttcatcatgggatctctctacactgtcatccaaggattcccttcctctttttcccatgttggatttcttttattactgtatcctgtgtctttctctttctttgtttactttcttgttttggtgaagcacatccttcagcagcttccttagaaagggtgcatggagctcaatttgagaccctgaatgtctaaaaatgtatttaattatatcatcatgcaggctgctagtcttggatatacaatcatcagttggaaataagttttctttagaattttgatggaattgtgccaatggattctagcttctaatgatatatgaagaagtctaaaaccatttggacatctgatcctttgtatatgacttgctctcttctcctatgccctgctgaaaacttgtaaattattttgactctagtactttgaaatatcatgatataccttgtcatgagtctgttttcttccattgtcctggatattcagtgagtcctttaaatttagaaattcatattcttcatttctgggaaattttattgaaccatttaattgattatttttcctgctgttttctctgtttctctttgtggatcttttatttggctactaccctattttctggaagatttcctcagattatttttgacctttctattctctttctgctatcttttaatttccaagtattctttttgttttgttttgttttctgaatgttctttgtaaatagcatcccattatttcatcttagcaaatagcatttcttatgtcttactgagactttctctggtgactctagttaaaatttcatctgtcactctctaccccattgtctcttttctcagtagaatatgagcttcataagggtatagctttttttttccctgtttttcccatggatattttcccaataccttgaacaatacctcccacatagttagtgtttaaatgtttctggaataaacttaatgatcattctgatgatattaataatatatattttaacgttttctcctagtaaaggtctagtctgtttctttgaggtcatttcttcctgtttttattgatccctaccttaggttagaacattttctgcagatatctggtaatacttagtcatccacttatatttaataatgaaggataaaaagttgcttggaatatatgagcaaattgatggaagttgccagctattggcttcatggtagaatggtctggccaggccatcctgttggagatcccttgatatcaactctttagatgtctcttcctggctgatctgattctctggaacacattctcctaatctctagaaggaagcagcagtctgggagcagaagggaagaaggctggaagaatctcagcatccaaagtgcatatttttactgaatctgtctgttttcagcatggccctcatgccttcatctgggcctggtgccttccctgaaaagaaaactatatctagcattttgctggagtgagaaacatgctgaaactgtgcagaatgtgggagaaaaaactgctcctaaactgcttcaatcagtctttttttttttttttaatgaggatggaacataatcctatagattttaagatagtttaaagaactatttgttgatcacttactgtattttgagttatcaggtgagacagatataaggcatagctactacagcagaggggactgtaagagtagggcccctgaagccaaaaacagcatgaagaatagctagaaccagatcctgaagggtcttgtcaaagtatgcccttttcctgaagggtaggaaataaatccactattagttcattgctttaggtttttattgctttcctcattttacccctacattcagaggtgtttgatgccaccaattcctgagaactggggggcttctgtggtacaaatttgttactccctgctttctcagatctgtctagtcagctattagttgctcatctgttttcccagttccaaatttaaacaagagcatttaaacagttctcttcatttttgtgttaatgagttaagagtgagattagttacatgtatttgaactgctgtctatactcaaaagtctttggataggacatttaataaaacgttgggtcatacacaagaaacaaggaattttacacagtatcaagccaagattttagtttaaagtggtcccaggttgatagtaccctcagatttctggcagaagcgatagagggaagaggaattcactttccacatgcctcaaagttttcctgtcggtaaagttccaaggaatttgagtttagagtcacaggttgctaagcacactaggaaatgaagcacaatgagcaagaacaaacaggaaatacaaagccctcagatactgaaattatataaatatgttgaaagaaaagaggaagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtcgtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaagaaaagaggaagaaaatgaatggccaagaaattataaaaatgaaaaaaacattttcaaaaaagaccaaatagaacttctagaaaagaacaattctgtaacataaactcgaagactggattttgttagacattaagaacgactaaagagggaattggttacttggacagtagatcgtagaaaattgtctagaacacagtacagttagaaagctcttgaaggagaggggagagaaaaatggtagaaatacaacatttaaagaatcactgagaattgaccaaaattaatgggttgctacatggttcagaaattccagtgaagctcaagcaagtgataaaatgatggtagagaaatacatgtgcagacataggataaagtttgatatttcagagtacccaaaacaaagaggagatcttaaaagcaaccagagagaagatgggccatctaacaaaagagtgatttgactgagagctggcttcttaatagcaatagtagaaaccagaaggcagtggaatgttaccgtcaatgtgctgggagaaaatagctgtcaatttagaattctatacccaattaaatcctctttcaagaggggaaaaatgacttttcaatcaaataaactaagtttgctactaatagacttctcaattaaggaaattctaaaagacatactttagacatcataaaataaactgtaatggaaattaggaagcttttagcactgagtgataatatcacaaataaaaacctatgatattctactaaagaggtacttggaaaaaatttataaccctaaatgcttacattagaaaataaaagctacaaattagtgaactaagcaaccaatttaagatagaaaaagaacaagatatgcccaaagaaagtaaatggaagaagataagcagcattaataaaacagaaagcaaacatacaatacagaggctcaaaaaagttaaaagttggttttttgaaaagagtaacaaaactgacaaatgccagctgagattagtgaaggaaaactggagtatgaggaatgggaaaagacaattacacatgcagagattaaaataataataagaggggggtatggacaccattatgctaataaatttgaaattttaggcaatgaataaatgcctagaaaaatatcatttatcagaatcgacttaagaattagaaagtctgaaaagtcctataacaattcaagaagcagaatcatagtttaaaatcttgtttaaagaaaactccgggctcaggtggctctcctgggaaaatttttatttgatattcaagaaaaaatttccaatcttatacaacctatttaagagtataaacagggcatggtaggggtttgggggtggtgctctccacctgaatgaagcataatagaggaccatatgagaaaggaaatcacttgcaggtctcactcatgaagatagttgcaaaaatcctaaacaaaatatcagctaaccaaatctagcagatataaaaaacttaccaagttgagattatcccaggtctgcaagggtgttttaatattagacaatccagaatgtaatttaccacattaacaaattataaggaaaaaataataccataatctcaatggctagagttacagctctgattaaaatccaacaacaaattatcctgaaaagaagtctcaaaataaggataggaattttcataataatctatttttttcagggattatatatctatagttttattaagacaaaaactgagagtgtggtgtgaagtttacattcaaacaaagttttcaaagaaatctaacacatgcctaaaaagattttacaatgtagctctagatccaagtctagataatatcaagaactgatggatctcatgactcaagacagagcattttgggtatcagttacttcttaggatttgttaaaaaatggttttgtgtgtgtgtgtgtgtgtgtgttttaaagtgaaccactgcccagtatgaaagtttaatctcctgagaccaaggcttttgaaatcactcaactcttgagtcaattcagtgaaacttgtgctgtcagtgactgaactctgccaccaatggtttcagagttcaaagctcaaaagagaatggctccaaaagttgtcccaactaagagcatgggccctttacttccctcctgtcttatctcctctaccaccctctttcccttccccaacacctcagccagtggctaggatgaacaagctgatatttataactttattattggaaaagaaagggtcttctaatttcaggaattagcacctctgaggcagaatgatctgcttgtactgtatactctccaataaaagaccttccttcctcagtcaatttccatctccaaaatggcaactctggtaacttattaactggcttagtcctttgtgagactaagtacattaagtttaggcagggaacaccatggcttatagatttcagacattcacagcttttaaagtctctcacagtccgtatttatggtgccagtgacatttttttcaaaggtaaaatattctggacatagaagcaaatcattagttttctgttctttgcattgcttcaccatgtcccctatcaggccccaaattttaatcaaaatgatgctacccatctccctttccaccctccccattcctccctctcccacataatacaccagtaatagccaaaaactacacatttgctacgctgtaaaaatgtagagttaacactattgggaagaaagttgtgcgttgcggagatgctctttgattatctacagtatttttttgctctcccacacacccagttctgcaagttttgtccttcataaagggccctttgctttttctcagcaaagtgcagaaaaggttgccttgaagcacttatcccccttcccctccactgggacgggtgtgcaaactatacagcttggaatggctttaaaacacttgggctgctgcagggcacagaaacgatactggctcttcaaagggcatcttctcaagctacctctatggtgtcaagacaagtagaacttctttccttcccacctgaaacccacagtcagatgtgatagaggctggtactcaggagagttaattcttgtcatcatcctctttggggtaggaatgccacgtcagcctttcctcatagaaggatatgacaacccgtgggcatttgacattgacttccttggcagggacgaggtcagcctcatcagaatttttccctttcatcaggaacatgagctctccactggagtctgtagctccaataatctgctccggctccaaaccctgagcaaagcctcgtggcttttctgactcttctttcttcttctttggtttgctctcctctcccttatcttcagaatcagaatcagctttgtgcttgcctccctctgatttgtctatctcatgtgctgttttctgtgacggcagaaactcatgaggtcagggcaatccaagttctcttctgactcccatgtgttgtcctcatctgagaatcccttccactttaggaggtactccactttgccctttaccaatcgacggtagagaactttttccaccacatattcctgttcctcctcttctagcacctcctccactttcttcttgttttgttttttctccatagcgtgtgtgtaaagggtgatgctgctcagagcagtgcccaggagccggaaaggaatcggtgctgcgctattggcgcattgggtcggccagggcagtggcgctcagaaaagcagcaagggtagctgcaaaggagccccttgctgaaatggtgtaccgcaggcctcggctaatggccctcctctcagccgaacaaaagagccctgcactctgtgctgcccactgcccactgcctgcaccgccttcataatctattaaagggtatctacaacatacctacagcaaacaccaacaccataccttatggtgagctagtaaatgctcccctttgagatcaagagaagacaagaatgcccattatcaccatttaaattcaacttttacagtagataattctaactaggtaagactggaaaaataaaaaacgtggcaaaggtactgaaaagaggaaacaaagctgctcttagtatttgtttaatatggttgggcacagtggctcatacctgtaatcccaacactttaggaggccgaggtgggaggattgcttgagcccaggagtttgagactgcagtgttaatgatcatgccactgcactccagcctgggcaacagagtgatatcctgtcaagtataatatttttgatataaatgtgggggcttccccccaaaaaatgctctcagaatttaatgaggaaaataacctatgccaactcttgtttttttttctttttctttttctttctttttttttttttttgagatggagtctggctctgtcacccaggctggagtgcagtggtgtgatctcggctcactgaaagctccacctctcgggttcacgccattctcctgcctcagcctcccaaatagctgggactacaggcgcccgccaccatgcctggctaatttttttttgtttttgtatttttagtagagatggggtttcactgtgttagccaggatggtctcgatctcctgacctcatgatctgcccgccttggcctcccaaagtgctgggattacaagcgtgagccatcgcgccaggcctctatgccaactcttacaatgagagattcagaatgaacaacggacacatacctgtgatactgttttgttgcttgaagctcaattgtgagaaattaaaacaattccatattaaatggcctcagtcttttaccctatttcttcttcatatttggggcaatttctgataaaccacaataaatgatgttgtaggtgacatgcttttatctaaaagtgtattcagaaatagacccacacatcatcttttacaagagcagggcatttgtctttaaaaaaaattaaatcatacaaaagaacttaatgagatccgaatcaggatctaaatactgtttctaataactctcaaggcagtgagtagggacagtcagccacagggctcacctggttggttcctctctctcaggggtcactgtcttttgttgcctgattttctagtgccttgaaaactgttgtttcatatttttttttctatgtgtttttggttgttttaaatgggtgggtaaatctctctgttacttcatcttggctggaagcacaagtcaatttaattaaatggctcatcatttcttgtatagtcctcttttttgttaataaggagttgttttaacacacgttaatacaattgcttggcctttcccttaaagtttgcgtagatttattttattttattttatgttatgttatgttatgttatgttatgttatgttatgttatgttatgttattttattttatttatgaatgagacagggtctcactctgttgcctaggctggagtgcagtggcacaatcatggctcacggaagcctcaactcctgggttcaagtgatccttccgtctcagcctcccaagtagctgggactacaggtgtgcactaccacgcctggctagtttttgtattttttgtagataaggggtttatccatgttgcctatgccagtctcaaactcctgagctcaagggatccgcctaccttggcctcccaaagtgctaggactacagcatgaggcaccatgcctggcttgtttcatttgttttgaaagtaactgttaattttaaaggtccaatctgtgaggatctaaagagtaggagccctgagatgaataattcctgaaggctttcagcattctctcctgctgtgtgctttgttattgacagctgttcaaggtctcaccacctctggagttttaacccaccgatgtgtttcataaattttaatgaaagacagatagagagaaatcatagataggccaacatgattgtaccatatccatgcactggctcaaaatgaaaatctctgtgatattaccctgagttacatttgtggaacacaccaaactccgtcttctagcttgtctgatccagctagctaagggaaatcaaaagtaatttgcaaaatcttttatgttcttttatgttcttggtacattgctctgatttattttttaaggcacagaaaattgtccaaatgcatagtacaaatttgcaaataaactacatatagttatttggacgatggtgtttttctaaggagttttgtaaagaatgtggtttaacttgccagtgtgtaatgctaaacttatttcttgtgtgttattatgaactttatttataatttcatagcagctgtttattttcattgctaaggtacaattcagatgttcttggcttaactcagtattctctatctcacaaaatttaaaattagactgatactttgtaaagattcttcagatgtggccagattattttaggaacagctttagttatccctgataataaatattagggagagaaaaagaaattgaggtctttgaagaatccctaaatatcatttcagtctatcactgtcagcctccctcactgctttcagatccattcccaggagcatttacagggtggccaagcttcctcatttgggttccagctctcttagtttctgtagcctactcattgagctaatgagcagtgtagtggctgagagctagggagaaatatgagagaaatcaaagaagaccctttctgacttttgccctagattgtttgaaacgaaataacattagaataatgaggaattgaccacctttcccttgctgcgttttaggtgtcttttctgtaccattttattatgtcgtcttaatcataacagcctacataaatacttgagtttgggttaggatgacaatgaaaaagggattagaaataacgtgtactcttttttcttaagccttcagaaggactgtaaaaacttaaagatgttaaatgcaaatgccattgccattccaagttaacaagcataagagttttttgttgtttatttttggggggtgatccttaatagtatgtgtttttcttttcagctaccaagtcaggattgttacccccaccacctgcgctccctccaagaccttgtccatcacaggtaggagacatatttgatttatgtaaactgttcggtggtagggaagttgtcctatcgctgtgcttctttgcaagggttgatcgccacagatctggtccatgagattcccaagctgataccctgtgaagagagcagagagtggtttaatttattctcatccagccagctccccagcctcatgtggaagagagaaagtttcctcaataagccaccaagcatacatatactagttcactcttggctgtccaggggtgcgtctgttttcatccccagagaagggtagaagaaggggcctctctctaattggaggtggagacatggtttttctgtatagtatgtgcaatctgggtgcctatattttcgtcagtactttaggagctatgttaattctacataaatgaaaaataaatggttatcaacatggggttagtgccgtggttttggcctatggtgctttctgtaggatggtatttttcctcagaacaaaaagctgagatagcaggagggggagaacatgtcaccaagatctgtttcacccctaaattaattctgccttatttacatgtgccactatggccttattcatcaacactttgcagagctgaaaatgagaagcaaacagtggagtgtggtatatggtgctacagatctttccttttgttaattgctgctgaagaaactttctatctttaaagaccctttctgatttttggcagaaaattttgggaaatttctctgtacacagtccctgtttctacttcattgttctgggtggttcagagctatccttccatacggggacatctcaggactcatgagtcactgaaaccacttttaacacatgcttgtccttctttcagtgaatgaaatggtttttagcatccactcaaccttgagatgcaaatactatgagatattggcttcctgctttagtgcgaagggtaataaaaagcccatttcttcctgacctgcatataaaccagcgagaactcctttccaggatgtaacattggccttaagagatattggttgaaccgtcaacaagtatttattgagtccctgctgtatatctaatgccaaaccttagttttgccctaagcctttcattggctgtaatttcttctcattcaaattattagctgtgtctgttgagcatctccaataaatcaggcattgtgctaagtgctttcagtgcattatttaatcctcacaaaacccctctgaggtagatacaggtactaatattatcccttttttttttttaacagataaggaagttgaagtatatgggggctaagcaagttacccaaggtggcatagctagtaaatagtagagccagctcccaaattgcaatctgtctcctaaaggctcctcctgtcaccatcactggagtctgagtgtctatgtgtacagccagacagcagatccattacacttgcaatggaggctttcatcacaggcccctaaggaggaccttgatgagatgaggctcctgctccacaccaacagcaaacctggacttggtcacaacaaaatgagcaggcatttgctagctgctagttcaagcctggggcttgagagccacctggttgaatgcatggaagacctgtctgaattgacttttgtaaccaaccttctagctttctcttcctgcacaaatgccagtagttactacccggtcccaaaatatgctgctgctatcagcagtcttcatctgagctgcttgaggtgggcttcttgcctgcttttggagcttagtcaccaaagatctgactgggggatctgggaattctctagtcactgttaatgaatgagtctgcttctttgtctaccagatttcccatcacaatataaacagtgagcccagtactcagcctatcagctgcctaactatggagatttcagatttcaggaacaggtgtgtaagaaatggaggcagaagatccacattccatttctctcccctattccctcctttcacccactgtaagtgggacacacatattcagatatatgaagtcctgggcaataaacacatggttatatttagtttttgtgccatgtcaagttggtattgaccctatgagcgtcttactaaccactttgtatgggacacctatatattctagtctttcccaaactgcttgtgataaaacagtctctgggagatattaatagggctctgtggtacagatttgcagactgctgcccctctacccctctgggagagtcgctgtgcaagtgagctcactaaaggctttggaggcctacagtaagtaaagctagtaaattttgttaaagccagcaatttcctagcttctgtgaccattgatatctttatttataaaatacctgttaggatacaaaatcagtgtgcaaaaagcacaagcattcctttacaccaagaataggcaagcagagagccaaatcatgaatgaactcccattcacaatcactacaaagagaataaaatacttagaatacagctaacaagggatgtgaaggacctcttcagggagaactacaaaccactgctaaaggaaattagagaggacacaaacaaatggaaaaacattccatccttatggataggaagaatcaatatcgtgaaaatggccatactgcctgaagtaacttttttttttttttttgagacggagtgtcgcactatcgcccaggctggagtgcagtggggtgatctcagctcactgcaagctctgcctcccgggtgcacgccattctcctgtctcagcctcccgagtagctgggactacaggtgcctgccaccacgcccggttaattttctgtattttttagtagagacgggatttaactgtgttagccgggatgatctcgatctcctgacctcgtgatccacctgcctcggccttccaaagtgctgggattacaggcatgagccaccatgcccggctgcccaaagtaatttatagattcaatgatattcccatcaaactaccattgacattcttcacagaattagaaaaaactgttttcaatttcatatggaatcaaagaagaccccatataaccaagacaatcctaagccaaaagaacaaagctggaggcatcatgctacctgacttcaaactatactacaaggctacagtaaccaaaagagcatggtactggtatcaaaatagacatatagactagtggagcataacagagacctcagaaataacaccacacatctacaaccatctgatctttgacaaacctgacaaaaacaagcaatggggaaaggatcaaaggtcaaaataaagggctctattttaaagtgaaatcaggttctgataaatttatcatttgccctagataacattgttttaagtttatcaaggttgaatattcaagtggaatgcttgttttgtgtaatgtatttttcctttgttaactttggcagtaccttttactgtatgttccctagttatagaatcggttcatagattgctcagagctactcatatctctggattcatgtattatgaagaaacaattctgtttcagaccagcttgtgttgattgaatctcaagttttggaagttctcttgtgaggatttcttaaatttgaaaactactattctcaagtagttagggaccataggcacacactaccaaacctggctttccaggttttaagtatgtaagaaaaatgagtttgtacatttgcaatatgcatacagagatatataaagattgtttctacatacaccaaaagcatatattcttttatcaaatgagagagatgaagtataggttttcagcataacatgcagtttagctggctcatacttattcaagcaccactgtgatatgaacatctggattaagttatacaaatggggccctggagttaggaaaaggaataagttaaaagaaacatctttttatttttcatactataggtaagatcaagaagaacctagtgactatatacaaaattaagtagtttgtgtttcacattttcctgtggcaagactagagactagggcatggtcttttggctcagctcagaagaggtgacttttttttgaaaaaagacttatttatagcataaataaccaaaaagcaattaaagtaaactatttcatatagagcagtgcattcttttgtttgtttttgttttgttttcttaagacggtctcgctgtgtcacccagactggagtgcagtggcatgttcagggcttactgcagccttgacctcccaggctcaagtgatcttcccacctcagcctaaagtgttggggattacaggcgtgtgctactgtgcccggcctagagcagtgttaaagtgagagttaaatgtattagcccactgtttgtatcattttaataaatccagtaaattgccatctgtagagtttgtgtttattcttttttttttttttgagatggagtttcgctcttgttgcccaggctggagtgcaatggcgcgatcttggctcaccgcaacctccacctccccggttcaagcgattctcctgcctcagccttccgagtagctgggataacaggcatgcaccaccacgcccggctaattctgtatttttagtagagatgggggtttcaccatgttggccaggctggtctcgaactcctgacctcgtgatctgcccacttcagcctcccaaagtgctgggattacaggcatgagccaccgtgcccggcgagtttgtgtttattctgtaggtcagttctctgccaagggactgtttggtacttcagtagctaagtccttttaatagtgttgatctcatgacagttttcttatggcaattgtgatagagccacagcttcagtgtaactataataaagaaaagattttgggggtgcaagacattatcttttaagttttctattagcaccacatttgataaattggggttccctgcagactaatgtgctcagaattttcctatttctgccactaatttctcaccttatatgtaacaaagttttcctcactagcaatgtaatgagtactaaaaatagcactggaaggtgaaagcactgtgggagaagcatttgatgaatacctttaagcttagagagaccaagaagactcatggaaggggtgagatgaccaatgaaattagttttaaagaaacaacagaactttttttttttttttagctggctaaaagatacagagctttactgcagatttaaaaaaaaaaaaaaaacccaaatgcagagaaacaggcttgcaagaggtcctggtatgtttgaggagctgcctgagatttggaaagccagattgtagggaaaatggctgtagtgttctggaagtggccatggggagcaagcctcctgctcacttccagttccagttctggtagggatgtgggagagaaacagcccctaccaaaggagttctgtctggggagcagaaactgacgggaggacagggttttagcctagtggttctcacccttggctgcacagtggaatcatctgggggagctttgaacgtgctgaggcctggagcccctcccagagattttggcatggggtgctgaggtccggccactgggaggtttaaaaacctctccaggtgattctgaagtgcagccagagttgagaagcactgaattagggcaagaggaaggaatgctcagagaagaggttgagaatatagggaattttattgatgagttcttatagggcacaatgaaaggggttctggagttggggaggcatgaggtcagcttaggggatgtactcagaccctatggggacaagaactcagatcacaaggggcctgggagtcaagggattcttgtggtgactgatgtgaacagggctagaggatgtgacaggaaggtcctgctggaagaactagtcactgtgtgcctcaggtcctgtgtgtactactgtgagaggctagccatgaacacagatggcctcaagaggaaaccagaacaactgtggtccattgagttaattcttcatctaacttcataatctggctagaatcaggtcctgaaagtgatattgaacccaataggaatatggcagtcatgctactctttttcaaagactaattttttagacacaactttttataaaatactacatttgttttatttggaagtaaaaactgcagctcacttaaacttaaatggcagttcgtaggccctgaatttgtgaaatattcaacaccattttaaatactctatccttttaattaatatcctgtcatttaaattattctttccacaagttaatacacagttggtgattcaaaatagtaaattcttctgggagaaattaagagttttagaccacacatacttttttggggcaggggaaggaattcctggtgattatgtaagtctcttacagggctatctaatccatttttaagtgttaattttattaaagcataacatacatactgaatctatttttaatacatactaaatcaatttttaagatagtaaaatgaagtataggttgagtaccctttgtctgaagtgcttgggaccagaagtggtttagatttcacttttttttttttttttttgggaatatctacgttacacttacctagttgaccatctcaaatctgaaaatccaaaatcctaaatgctccagtgagcatttcctttgagtgtcatgttggtactcaaaaagttttgggaggccgaggtgggtggatcacctgaggtcagaagttcgagaccagcctggccaacatggtgaaacctcatctctactcaaaaaaaaaaaaacaaaaattagccgggcggggtggcaggcgcctgtagtcccagctactcaggaggctgaggcaggagaatctcttgaacctgcaaggcggaggttgcagtgagccaagaccacgacattgcactccagcctgggcaacaagagtgaaactctgtctcaaacaaacaaacaaacaaacaaacaataaaaaaagaagaggccaggcttagtggctcacgcctgtaatcccaacactttgggaggctgaagtgggcagatcacctaaggtcaggagttcgagaccagcctgaccaacatggtgaaaccccatctctactaaaaatacaaaaattagcctggcgtgatggtacgtgcctgtaatcccagctactcgggaggctgaggcaggagaattgcttgaacccaggaggttgaggttgcagggagccgagattgagccactgcactccagcgtgggtgacagagcaagactctgtctcaacaacaacaacagaagttttgggttttggagcattttggattttgtattttcggattttggatacttaacctgtattatattgttgtcagctttcaaatatctataagaaaatagcaagaaacattatttaatgtgaacaatagagaaatgtcactgcttttaaaattgcatgttttttttatcaaattaaaactccgtgaataaacaccaaacatcatgaaatctcttgctgtaatatattcaaatgacctcatgtaatatataagtcattgaatcaccttaagatactgcctgttaaagcatatttatgaactttcaaaggtatatacaacatcctaatttttactcatcaaaatacgaatttaatatgtatcaagatagtttctattcatgcatgtattagaaaatcagaaattattccaaagtgaatttataaacgtatatcacttaagatgccaccttcattttcttccaaagtgttactttgttctgtcctacagtgtatgctgtagattagctgaaaatcacaacatgttaatgagtatttcagtgattaaggaaagaagatataaaccaaggctgtaccttcatttgtgatgatgaaagaacatactgaaagctgtaccacactgtgctgaatgtagtaatatgaatgtgtctgtctgtggtcttatccttagtcctgctactgtgtagctctctggctttgtgggaattaagtaagttagtctcatggacctatcgccccttctataaagtaagaagattggactagagggatcctactagtgctaagatgtctgattctattttgtattctctgttcaagaattttttttgtaatatagataaaacttcatgaaacacagttgagggacaagataggttggactaattttctctgctcctccctgctaagtacaactaaaacccccagaaatactataatggaaagaggattttttttttttgagacagggtctcgctctgttgtccaggctggagtgcagtggtgtgatcatggcttactgcaccctcaacctcctgggctgaagggactcagcctcctgggtagctgggactataggtccttgctgccacaccgagctaatgtttttattttttgtagagacagggtcttcctatattgcccaggctggtctcaaattcctgagctcaagtaatcctcccacctcagcctcccaaagccttgggattacaggtgtgagccatcatgcctggccagaacagactttgaaaggtttaaagaggaaagaggactggcatgacagtgaactagagacttcaagtagacagaagaccaataaggaaatagaaagcttgaacaataccatggttcaacttgatataacataactatagaacacccagcatcagcacaatagacatttttctcaagtgcacttggaatattcttcaggatagaccatatgttaggccacaaaacaagtctcaataaatttcaaaagattgaaattatattaaacatcttctctgatgtcaatggaatgaaactagaaatcaataacagaagtaaaatggaagattcactaatatgtagaaattaacatactcttaaaaacacaaagaagaaattataagtgaaattagaaaataccttgagatgagcgaaaacaaaatcatatcaaaacctatgggatgcagtgatagcagtactcggcgggaaagttttagctataaacacttaacattaaaaaagaagagatccaaaatcaacagttagctttacaccttaagaaactggaagaaggctgggcacagtggctcacgcctgtaatcccagcactttgggaaaccaagacgggtggatcacgaggtcaggagatcaagaccatcctggctaacacgggaaactccgtctctactaaaaatacaaaaaaaatgttattctgggcatggtggcgggcgcctgtagtcccagttactcgggaggctgaggcaggagaatggtgtgaacccaggaggcggagcttgcagtgagccaagattgcaccactgcactccagcccgggcgacagagcaagactctgtctcaaaaaaaaaaaaaaaaaaaaaaaaagaaactggaagaaaaagagcacactagatccaaagctagcaggacagaaataataaagagtagagtggagataaacaaaatagagaacagaaaaacaacagagaaaatagttgaaaagttgattttttgcaaagatcaacgaaattgacaaaactttagctagactgaccaagagtataattaagcatgtgttaacctctggtcaaaataaagggctctattttaaagtgaaatcaggttctgataaatttatcatttgccctagataacattgttttaaatttatcgaggttgaatattcaagtggaatgcttgttttgtgtaatgtatttttcctttgttaactttggcagtaccttttactgtatgttccctagttgtagaatcggttcatagattgctcagagctactcatatctctagattcatgtatcatgaagaaacaattctgtttcggaccaacctgtgttgattgaatctcaagagttttggaagttctcttatgaggatttcttaaatttgaaaactattctcaaatagttcgcactgaatgacaaattcaaaaggcaaaggaaatggccatagtgataagtgcaaggagaagagagggtgagaattagtaatgaaataccagcattggaatggaggagaaaagtgtaagcctgtcccccttccttctttttgaaagaagtactcagcattttgctctttatcaataagtgtctttagaattaatcctagtaactaattcaaaagaaaggaaaagttctatgatgacatttattttagtattataaaaataagaacaatacagaccaccttaatatctaggaagaaggcactggtcaagggtaatgtatatctgcctgattagaatattaggcatctattaaaatgattacatgacaaaacagtagaaaagaggggtaacagctgaatacagaggtgtttcctgattgtaccacataagtatatggtagacctttgatggtaaggttttctcatctctgaggatgaccttgaaggtccatggtgcatggtaattggcccctttccagtggtcggatttcgaattacttttacattagccactgttccctccccagtagggttttgagattcttagctgcttagtgaatttctactaactctttttaggggtctaaagggatcgcttaggtgactcatttataatttacctatcttgtcttataacttgtttttataagtttttatattttgggagatgatgtatgtgtagtatttatgtgaattgggatatctgtgaaggtctccagatggttcagtcctaaatgtcaagtgcctactgttaaatacttggagaagactgctaagtaattggtagaagtttaaatggctgttttggtggggaagttatgcagtttttcttttaaaaattttgtcttaaaattaaggattggggaaaagaaaaaaaagtcctctgatatgacaactagaataaaaagtcatttgaagatttaccagaataaaatgacctttggaaactacttttagagaccagctctcagaaatagtgataagacatatattgcataattacattgttacgatgactctagcaattgtgaggttcaaagaaatagtgtactgaagtattatcatctagtcattttttaaatctatgttctttggatagtaaactcttattgccctcactcttaaatagtaattctgctgtgtacagaattttagactgaaagtaatttttcctcagtattttgaatgcattacctcctcttctagcatttattgctgccactgctccggattgtactgtcaatctattttttattcctttggtgcagctttgtctttcctctgggattgcttttaaaagtttatttttactttctgaaggggtgggttgcccctccacacctgtgggtgtttctcgttaggtggaacgtgagacttggaaaagaaaaagacacagagacaaagtatagagaaagaaataagggggcccaggggaccagcgttcagcatatggaggatcctgccagcctctgagttcccttagtatttattgatcatttttgggtgtttctcagagagggggatgtggcagggtcataggataatagtggagagaaggtcagcagataaacacgtgaacaaaggtctctgcatcatagacaaggtaaagaattaagtgctgtgctttagatatgcatacacataaacatctcaatgcgttagagagcagtattgttgcccgcatgtcccacctccagccctaaggcggttttcccctatctcagtagatggaacatacaatcgggttttataccgagacattccattgcccagggacgggcaggagacagatgccttcctcttgtctcaattgcaagaggcatgccttcctcttatactaatcctcctcagcacagaccctttacgggtgtcgagctgggggacggtcaggtctttctcttcccacgaggccatatttcagactatcacatggggagaaaccttggacaatacctggctttcctaggcagaggtccctgcggccttccgcagtgtttgtgtccctgggtacttgagattagggagtggtgatgactcttaactagcatgctgccttcaagcatctgtttaacaaagcacatcttgcaccgcccttaatccgtttaaccctgagttgacacagcacgtgtttcagagagcacggggttgggggtaaggttatagattaacagcatctcaaggcagaagaatttttctcagtacagaacaaaatggagtctcctatgtctacttctttcgacacagacacagtaacaatctgatctctcttgcttttccccacactttcagtgttctgttttgatggcgctgcgatgggtttaagcgtagatttaaatttgtttatgccaggtgacacttggcatgcattttccttctggaaaatcatctttaattttaggacatttagtgatatctctgtgggttttgcttctctacttatttcttctgttttcttctggaactaactatatttctgtcaacacatttaaaaaaaactctagtaatgtgtctttcatcttttttttttcttttttgagacagggtcttgctctgtcacccaggctgtgcaatgggatgatccatggctcactgcagcctcaacctcctgggctgaagctgtcctcccacttcagcctcctgagtagctgggactacaggcgcatgccaccacacctggctaattttttgtattttttgtagagatggggttttttcatgttacccaagctggtcttgaactcctgggcccaagcagtcctcccatctcaacctcccaaagtgctgggatgtacagatgtgagcaccgcaccttgtcactttcatctatttatgttgtgatctttctgggcttgctctggatgaaatcttcatcttccaaattaaaaatcctctgcataactatatagcctagaatttttcctattctgttattaagcctctatcactattctttgattctaggttttataatccattcttttttataacaacctgttcttgttttacttttccctatttttgttttatacccatctattcttttttaggatctattctccacttttaactttgaggattctaaaatacttactttaaagttatttttaacttgttctatttttgtttttgtcaggagcgaatttgccttttttatttggctgttctaccatgctttttggaattttgttttgtaggcttattttgagttggagttcaatctcattctcagttctctgagctcctcactttctgccagttcagtggctgtctctaccaactattcctggcatccatggcctccagtcaagagctgattcttatacttgaaatacagtacttccatctggtgcaggtgtcaggggtcttgtagatggcacccaatggtgcttagcccagaaccaggcttcagtgttatatctgcttcagttcctttcctaagtaggcaacccagagcttctccacaggcttcatcttggttttgcagcttcacaggtagcaaagtgataccttagcctctggcatcagggaatgagcttggtaccagtcccctgcctcatgcgggacatttatttatttttattttttattattattatactttaagttttagggtacatgtgcacaacgtgcaggtttgttacatatgtatacatgtgccatgttggtgtgctgcacccattaactcgtcatttagcattaggtatatctcctaatgctatccctcccctcttcccccaccccacaacagtccccagtgtgtgatgttccccttcctgtgtccatgtgttctcattgttcaattcccacctatgagtgagaacatgcagtgtttggttttttgtccttgcgatagtttgctgagaatgatagttaacagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctctgggtatatacccagtaatgggatgactgggtcaactggtatttctagttctagatccctgaggaatcgccacaatgacttccacaatggttgaactagtttacagtcccaccaacagtgtaaaagtgttcctatttctccacatcctctccagcacctgttgtttcctgactttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagacggggtttcaccattttagccgggatggtctcgatctcctgacctcgtgatccgcccgcctcggcctcccaaagtgctgggattacaggcgtgagccaccgcgcccggccgtttcctgactttttaatgattcatgtgggacatttaaatccctgttattaggaactctcagctgcctctgtctgcttctgcaccctctgcctgcttctgcaccctctgcctgacctaccactttgtgatttggccccacagagacctttatcttgcttctgagtgggactgagtcttttaaattttaacagttcatgctaacactctcacatctgtcattgcatatcattttatgtaaggggaagttgagattcagagagcagaagttaactacttgggcctcgcagttggtaagtaagccagcctgctgtagaagaaaagggctggaaaaggtttctggggaagtgctagaaatttaataagcatgtagagagagaaaaatcattcattatacatcacaaaaattaactgtagatctgctaagtaaaagttgattaaatttctacactctgtgcccaccaataattttctaaatgtgaactctttcctacattaatctcaaatgcttatttttaaagtgccttccccagtgcagacttacattcatcttagccaaaatggccttcacatttggtctgtgggacatatttgatgtagcaaaaggccaagggtaacccttattctaccccctaaaagggaacagaaagagaacttttgcataataaataattatttatgcatttcaaaattgattttaagagtacacaaaccatagaggctttgcgattcttcatgtattttattaatttatcaagcacttcaacagagtgcccgatgctcttctagatgctttacaaatattaactcatttaagcctcacaacaaccacgtgcagtgggttctattgctatcctaacattgcagataagtaaacaaggcacagagaacctcagcaacttgcttgaggtcagtgacagaaagaaagagttaaggctatgattcctaccttggctatttagccccagtgtaccagctcctactatactactatgctgtgctgtgaaaccacgtctcacaattattttattaacaatcaaactgacacactatctttgtcagggacacattttatttcatggaactagttaaaaattagctttaactcacttctggtgacttgttttctttcttaggttcttcctcattatattatgcccatgctattgttatataaagctcactctgctggtatcattcttctggaagatgccataaattcatctaatcatttcatcagatgttaacggaatgtgctcactgtaggcccacagtttgctgagaactataggagcacaaagattgtgatgtgatccttatcctgtagttcctttatcctgcgtcaccctctcacagcagtcatgcccaacactatctattctatagtctctcatggttcttacaactgagtcattttctgtgtgtctcatttaaacccatttcttaatgctttattgacacaggttgtaagcaataaactggtcaccatgtttctaataactaccaatatagcccagttttcccctggggggctcagttatggtggttttctaggtttctgagcaatggaatcctcatttctcttctctgctgtcccctatcgcactgtgacttttttttttttttttttttttttttgagaaagagtcttgctccgttgcccaggctagagtgcagtggcgcgattctggctcgctgcaacctccgcctcccaggttcaagcaattctcctgccttagcctcccgagtagctgggattacaggcacatgccaccacgtccggctaatttttgtatttttagtagagatagggtttcaccatgttggccaggctggtctggaactcctgaccttgtgatccacctgccttggcctcccaaagtgttgggattacaggcgtgagccactgtgcacggcccacactgtgactttaaggaagcactcctgagggggtcaggggaggagcagatgtggattgggaggatgcccaaatgtgctactgtgctaatgggaaaggacaatggaggacaaccaggggttgggctcagggaggcagcttgacagaggatttaagagcatgggcttggggtttcaaatcctatctgcctcttactggctttgtgactttgggcaagttagtctctctgtgcctcaatttcatcatctgtaaaatggggatcatggtagtatccattttcatagggttatgatgattaaatgagtgaagatctctaaagcacttagaatgatgcctggtgccatagtcaaccctcaataacatttagctgttataattatcatcaccacaggcctagtgaaacagaggtggggtctagttggcaaacacagaacagactccagatagctagaaattagttgcaaccagcccagaatgagtgctgaagtggctcgctaaagcacttgcagtcaaagcacattgttaccctcatctgtgacctttcatgggctgtctctctgcctatgtcaggggttggcaaactatagcctacaggccaaatccagatggtcacctgtttctataaataatggaaatgtgaaggagaatcaattggcaagaggcacgcatagcgcatcttcaaccttttccatcggggaacatgagtcttgagaatcctgccatagatcaaaagaatggcaatgagaagaaccagtggacaggtggataggcctccccatcagcctttaaccctcctgctcttatctcaaggatcatatgcccgtgtctgtggtttctgatttttccttgaggacctttgaccgagatgatctgtctttcagactttactagcaaaattctgagcagtatcttttatacaactggcagcttcaaaggcttgcagtgggtaggcctccccaactctgtttcgcaagataattaaaagaagccagactccttcatccttgaaggagaggaagaagaaaacaagcctgtccagagaaaatggggtgaaggaatttttctccccaacttcctcctaaataccctgctctgcccatcaaattttgtaagtatcacccagtggtgtgttggtaaaccttctcccctgcggggtgggggaaagccccaatttgcagccgttgttgctgtctgtgttgtgaatgctcccaccatgctgactgcaagtggagctgggaagagatgtgtaccatcggctcactaacactagcatgctctgtggtagacagcttcccttgcctctgaatccttgtgtcaggattctacgtgccaggcaacaagagctttttttctttatgtatcatgccagtgattttagtctagggcactgttttagcccaatcccagaatgtgctattagaaatggggccatatttttgaagttgctaggggcaaaacttccctcttgtttatgtttaacttgtgccactaggtggcactttaaggacattacaggaaatcggctctactggatttttaaaacttttttttttttgagacggagtctcactctgtcgcccaggctggagtgcagtggcatgatctcagctcactgcaacctccgcttcccgggttcaagcaatttagctcactgcaacctccacttcccgggttcaagtaattttcctgcctcagccttccgagtagctgggactacaggcatgtgccaccacacccagataatttttgtattttagtagagatggggttttgccatgttggccaggctggtctcaaactcctgacctgagttgatctgcccacctcggcctcccaaagtgctaggattacaggcgtgagccactgtgcctggcccaaaacactttttattgaagtataattgcatatagaaaagcaagctgcacatttaatgtgcaactcaattttcacaagcagaacacatgcatataatcagcacccaaatcaagaaacagaatattactagcaccccagaagccctccttgtgctgttttccagtcgctatctcttattcttagggttaccactattctgacttctaacagcataaattagtttgacttgtgttctactttatataagtggaattatgcggtatatactctgtgtctggctttttattaaatgatgtttgtgtgatttattcatactgttgtgtgtaattgagatcattgctgtatagtattccattgtatgtgcaaatataacactgttttctactattgatggacatttttgtacttttcagatttgggcaattatgaatagtgctgctgtgaacactcgtatccaagttgttgagtggatgagtgttttcatttctcttggatatatacctaagagtagaatttctaggtcatggtgtaggcatatgttcagctttagtaggtactgccaaacagttttacgaagtgtttgtactgatttacactccattaatggtgttcccactccagttccatgtcctcatcaatgctgaatttattttatggatggttcctaactcttaacataatttttatagctccctttctggccagctatttctaattgaaaaattttaaagccacattattctgatggacatggctcatgcaggaagggctatgtcaacccaaaaggggacatttatcacagtctaagtgtgaactatcagtaagtcggaaaggatgttactctaatactccatcacactgatacacagagcaaagaaaccaggaaaggaattcagattgtaagtgtgataaaatatcggttcataggccagggctctgaggcattttgaaatttgtatatacatttgttattattgccaggcctatatatgtcagagattggggcccaacagaaagaatttctaaaggcctcataatgaagtgcctttcaattgtgctgctggtgggtgcctgttttactaagggtctctttggtttggcaagaggcatgcatggggcatctttcttcaacctcatccctggggagcgtgagtctctagagaatcctgctttagatcaccttacctgtgaggctcatgttgttgactctgcagatggtgttataatatggctttaggtatgtgatatagagagtacagttcagacttgactcagatttctgttccattactagaaattggacatagaagaacaaaacccaggtcatggtcaaaatatttgtcttttagaccaaaataaagtgctcatagtcctttagttgtaacagtaagtctgtctcatggatgttgtccataatctaatgggttccaagaatccccaaggcattctgccatgtgactcttgaatccagcaactagttgcccattatagtcactggtacccactttcaccaaagttgttcctgagcccctctgtcagtgttttcctgagtgtctccagtgttggattggtctaccgaggggggtgcccaccagagatgttcactgcacactgcctgagatatccatgttaaagcagccgtgaaacatgaaagtctgaccgggcttttatttttaaaattttctccccccaatattagtagcggtaatatccagtggcacagatttagactgtggatagcctgctttgtgggatctgcttatattctaaattggagccagcattttctcagcctaggttttcatctgtttggcaaggaggaaaatgcccttatgttggattggctgctgcttgcagtaggaggaactatgcctgggaaaccaatcataattttaatcctaatgataatagtagctgctgttgtcaaacagttactgtgtaattgtgcttagcacactagacagatattttgcttaatcttcacaatattgtgagttaggtgaattatcccactttgcagatgaagaaattgcagctcagagagactaagcatgtgaccagctcacacaatgagcaactgcaaagcctgggtttgactccagagcctatatcctgtaactgttctgtgctctgtgggtgcagttaccaaggaatgaattactgacctcttctccagtggaacatgaaacagtattgggttcattgctggcttattccacacattgattagaggacctgttgtttgctggcatgcagcttaggtatcaagaaaatgatagggaagcaagacagatcctgccctccaggtgcttaccattcgtttatcatgttctgtctctcacaggtgacttgagtcatggattttggtaatcattcttgctgagaattcagtctcttggaccttcttgaggctctatttacccctctctctgagcctggttggggaatgatggggtggaacagtggtgtgctgggccattggttctacatcttctgtgactgggtttagcaaatggctttctgttgtgttcttgcctagcggagatgggggacaggtgaaaactaggcaccaaatgacatttagaatactgacagaatgctggaaaggccctggaggcagcagcaggattgtcttcttgtctgcctagaatttagctgctgcctttgtgatccccattcttggaatccacctggatccttggatgataaagcctgagttcgtttttctgacctgccaatattgcaaacctaaaaaaaaaaaagttacctattatccacaccttggcaaagttctacagatggacttcttttttttttttttttttgagacagagtcttgctctgtcacccaggctggaatgtggagtgcagtagcgagatttcagctcactgcaacctccgcctcccgggttcaagtgattttcgtgcctcagcctcctgaatagctgggattacaggagcgtgtcactacgcccagctaatttttgtatttttagtagagacggggtttcatcatgttggtaggctggtctcaaactcctggtgtcaagtgatccacctcccaaagtgctgggattactagcgtgagccaccatgcccggccagactattttttaagtgggatttgactttttttttggttgcaaatttgacttttaaacaaaatcttactgctgaagattttgcccagctgcaaatatttatctatagaaccatgtggcatatacccccattccctctatgatgaatggatgagaaaacaattaagaagcctagttagttttgcaagagcacctgtggccttgcccagactagggccttggagacttggttttctcatctcttaaatgaagagtttggaccatcagtggttcccagttgatctgggctggctacataaaaatcacttagggtgcttgttaaaatataagtttctaatgccccatccctaagggattctgatgagggaagtctggaatagcatctacaaatctgaatttataaaaagttccccagataattatcctgctctggttatatttgggagccactgggctagagggtctagaacaaacataattaagttagggagaaacttctgatgtgcttgaagatttggggaatacctatatgcctggagcaggttccatatgggcgaactaacccagttatgttgcagaggtaaattggagccagaggatggaagacctttaactggctgagggattgtgttgtgtgccataggctttggggagccagtgaagggctttgagaaaaagcattttgattagatggtgctttaccagattaatttctcagtggtgtgcagggtggatcagagtgcactagaactgaaggctggaaaaagacccagtgaagtctttgcagtggcccaggtgataagtgtgacgagtacctggactcagatgggaccagtgggacctttgtaaagctaacctgcctcagtggaactggaatctgagacatactgttttaaactccttaaaaaatgcataatttattaatgtcatgttcatctgcctaaactattataattaactatttttattgtgtttttgtccaagaggttttaaaggagccctgtaaataaattcatgcaaagaagtagttggcagcagcaacagctgctaccgcagggagaagggacccccttctggccaggcagcaacctcattctcaccctgtctccatactctaagccaaagcgagaggggaggggagtgcaacaggggcccctggagttggatctgccaaccacagtggagaatgcacctccccaagggttaggtgtggaatatggcgtttggcattaagtcaaatagaatattcttcctttgttcctctaaaatccagtctatagtcaatgtttctcaaagtatgttccacagaacattagttcttcaggatgttaatagaagttacatgagaataaggagatgaaaccaaataaatttgggaactgatgggctacgcaaaggcaagtgacttcctttcagaatttcagagtgtgtaatgttctgtgtgctcagtgaatctccaagagggagatagaccaggcagtgtttcctaagcttatctgtagattcttcttccccctaggccaggggctgacaaattatggctcataggcctcatctatcccaccactttttttttgtaaataaagtttattggaacacagttgtgcccattcatcgtattgtctgtagctgctttagcacaacaggagagttgcagagtggctacagaggtagtctggccctcaaagcctaagatatttactatctgcccattacagaaaggtttgctaatccctgctctagacaattcatggaactggtgcttcctggtaccccctttcagagatgctactagaagaagatatacatgggttgttctagcactgctttatgataaatctgcctcattttattctgtttccatactgccatcattcctgcctcttgctttaaactactttatctctcaaccatttacccattatccaggatccaaacctgggttccatgtgtccttatcttttcttgcactcacaacattccaaaaatggccaagggtgtcttcaatttccagtctgggtagctcttaagtcagcccgaacccattcctaccaacctggcctacatgaccgtcatcttttctttttcagcattcgaattaggttccttttccccagatatgagttacctctagtcctttttactcactgaatctagaataacctttgtaaaatacaaatctagtcagattgattccttacttaaaatccttcagtggtccctgtggccctcaggataagctcagatcctcaggatggatgtgtgtcagtctggttgggcaaacagaaactactcctggtatttcgtactggaagagatttaatttaaggaattagttacttaagaaaaggagtagatatttccaggcttctgcctgctgtggcatagagaagggcatggaaatgggggatggtgttgagtgtttagcaaatgacccagaacaaaccaggtctgggaaaccatgtgttatcccctgctgcccttctccagcttcagctctcccatttttctcctgactcctcacccttcctccaccctgcaagtccccaaattctagatatatcaggatgcctttttgtccccccagaaacttaaaacaactgacatttacgaactcacagtctctttgggtcaggaacttgggagtgacttagctgggtggttcggggttacatcctctcatgaggcttctgtcaagatgtcttccagggctgcagtcatctgaaggcttaactggagctgatgatccacctctaagatggctcactcacagggctgttggcaggaggcctcacttctttgctgtatggaccccttgttaggactgcttgggtgtcctcacaatgtggcagctgactgtctccagaacaagtgatatgagagtgagagatagagatagaaacagagacaacaaggaggagcatactagagtgctttcagtcccctctcctgggagtacgttgcatagtgtctcaggtcagcttccctagaagcagaaccctgagatgaggattcttcaaaagtgatttgttgaaggagtgctctttaggaaaaaacctagaaggaggagagggaagaaaagtagggaaggggaaggagccaagcaatgatatagtctcagataaaatctgaccttggcctgatccacacaggcaggattctggtacataattgcataatagagttaaccctgtttgagacaggggactggccttttatatccttctctaagtcagtcattataggctgctggaggtgggggtgggaggtaggctcccattagttgagaataagtctctagagaagagggtggctgtgagtcctcagtagctaacactcagagcagctgggggatggtgtgccagccagggaaaggtgacccaggtggggccaacacagcacctactacagtgggcctccccgtacccatgtcccaagcacctaccatggtccctgacataccagaggtacgaaaaaaatatctgtgtaattgaataaatgaatgcatagaaatgcttagcctctctggacctgtgtccatttctgggaagtcagctcagcagggatcatattgtcccatcaaccatgggaatggtcgaagacccaggacagtttgccacatcatgagtggcagcactgtctaagtccaggattttcattgcaaaattagagtgaaagtatatttgccatttgtgaataaggaagtattaatattacaatattatatatttttaaaaggaactttagctcacatttcagtgagctctttgctaaaagtacattttcctggtttgtcacatcctgactgggtacatgttgttacacatggaaccgtgagggcagaactgccatttgttatattaattgtaatccatatatctgtttttttcccacaagaatcagtcactggatttcagttcagaaaaccaaaactgtcggacaaagccatattatcgtgttggcagagttgttccccatgaccccaaatacacagaggaggaagagaaccactgaggccccttgttttcttggattatcattcttccaaagttggtaactaagaaaagtctcaagaaatagcaaagaaacctccccaccttattctgctttccacatcccaagcctaacataagcctcaaactatttttatgaaggaaagcttattgtgaagagggtcttttacatgcctaaatctcatctttagtttttcttatcacacagccggttatctttgcccatctcttttcctgggataatgtctggctctgtcaaggctgtgccttattctgggaccttcctaatgcctgtgttccaggtccctcctgagattcgctcctccgaatgcttgatagatggatcaatttaggggattgatggtcagatttagcctgacataacaccatgcagtggtctgttaccagacatagagctggaaaacccaggcccttgcatacaagttcaggaaggtaaatttgcaaatgaaaaacattttaagacacatctcacagctgcttcctcatcccccaccctattgtttgtgtttttagagatgtttaagagaaaaggaggcaataacaaagacgctctgctgtgctttggaatcctcatttatgttgaaaaagggtccatttatcatctccttggatatttccacaaggagactttgctcatctcaccagggaatggagtggtagagcaaacacttctctgtccacctgatgatggaggagaaccaactaactgaaaggcagagagcctgaaattattatcctctctctgcctgcctgctgcaagatattgctgcatacctgtggtccctgcaggaggctgcatgcgtagacttgggccagaacatatattaccttccaagcaatagatttctaggtaaaaggcaagaaggggcctcaggttcaagttgcattcttcagtggggttcacaggaggccctgcattcagggggttactgggccctccttcagctgttaataaaactgacttttggctcatagagcttggagtatgcgtccatttgtatgaacctccagggaaagcagggtgagggcttgtgttccctagactcctggcagtgaatggctcctggacagctttgcttggttgtttcccaggtacttcaaactcaatctgcctaaagatgagttccccctcactcctgcttctcctgtgtttcccatcttggggattgaccttagtgttcttgtggtagccctggctgaaattatggatgttggagcatgggaggccctttgtgaacttacttttgggtctttctcaccattcccacacattgctcttttagcccaggcctcagctgagacatcacctgctcctgagtctttgccgacccatgagactgggtgcttctgtattccccatacttgccctccacagtccactgaagcaagttggctttgtcacttccctgttgctcccactagacttcaagcttctcttaagcaggatctgtatcttgttcatccttgagtgccagtgctagcacagggcctgcctgtagtagctgcttaataaatatgtcttgaatgagtaacactcaggcctgagaatacctgagactgtatggcatagtggttataagcttagctttggaaatcaaggcctgtgttcagactctgctatttgtgtgattttgggtgagttccttaacttcttgatcttcaatttcttcaccaataagatggggataataactacttcctagggctgtgatgatgaattgcaatgatccatgcaaagccctttgatcaatgtatgacacatagtaagtgttgtgtgcatcatagtacctattagtaacaacaacaacaatatagttatcgttaatggaagggagaaagctataagaactagttggaactagaagtcaggaatattgagtgcttgcatagtggatttagaggagatggggaattgcttgggataaaatgtaggaacagatgggattaccctgggagagaatgaacagggagggaaaaatgggtggagcaactaaagacagaaccttgagaaatcctacatttgagggataagaggagtcaaaacaggaaaaagagtgaatgactacagttaggagattgcagcttctcagatgccaggggcaggagtttaaaaaagatagtcaaaggtgctatactgggcagaagatcaatgaggagaagacgagaagaggtagccataacgtgttaaatgggggtatgttagcgcccttgggaactagccatttcagtggagtcagaggaagaagccatgctctgaaggaggttagagaaggccacgttagggatgaagtgggcatactaagtcagtttgttgtgctacaatgtgtgtttctgtaatgaggattatctgtgggtcagtagatgactggtgtcagtatgatgtagaagtcacattggttcatatgtagggttcattctcagcacatgaatgttttggcatcactggctactagtggctgaaagcagactaacacacctgaaggcagaagactgggggaaatgggggacatagagagctgctcatgaggcgcagtcaccctgtgttcttccacttgactgattggcacccactctgtcttgaagtgctttggggacattccttgccaatcttggtgagtttagtcactgattccattccactcagcacccttgacccttctgataactccttcgaccacagtcccccttccttttttaagaagggccatatttactagagtttttttttttttttttcccaaactgtgtccaggtttattaaagatactttttgtgaacagtcatggtatttcaggcaggacatgagcgacaatcattaacagtatacaactttcagactccctccttcaatggacttccaaaatcagaaagccatggtaaaacccaatgaagtcttcatttggtaccctgaagagggaaagttcagagtgagggttgacatttcacattcaacgtgctgtttaacaacttttcatgagctgaccctgactttcaggaaatgaaatgaaaatggcagaatttatctgaagatccacaatctagaaacagagcacgtgtctttcaagggttctcgctggaaagtccagattgccagcctgactggtaaccagttattgggggccagaccccaacaggtatctgggtttgagggagttaagtgtatactgaaggcagagagggagagggggaaataaagaggaatttgtttctccacaccacaaggcctttgtgcgaaggtgactgtgtgtgtcaacgtcagacagtccctctttctgggagccaagaagatgtctttaaaactagaagggaaaggtgttttctccacatcagtccagcttcatagacattctttttcttttttttctttcctgagacgaagtcttgctcttgttgcccaggttggagtgcagtggcacgatcttggctcactgcagcctccgcctcccggcttcaagtgattctcttgcctcagcctcctgagtagctgggattacaggaacccatcatcacgcctggctagtttttgtacttttagtagagacggggtttcgccatgttggtcgggctggtctcaaactcctgacctcaggtgatccgcctgcttcggcctcccaaagtgctgggattacaggcatgagccacggtgcctggcctcagagacattctattagtgacatataccccttctccataaaacaacaatgacgtgttccgtgtgctaacaacatggcttaaaataaaggcataaaaacaattctgcatttttataaaacttaataaaaaaataatacttcaaactgcacagtcaccagaaatacacagttatcaaaaatgcacacacttcccttggcatccccagcgccttcaactttctgtgcctgctctgttttggcctctgcattttctgcagagttattcccctccttgccagcatgggctttttcctttttcccctttaccttctctcccttctttgcaggggcctctttaggcttgggcttcggaggagcaggtttggcagacaaccttgcagatcttctctgtggtttgtccttactttggttttatctcctttagcgtccccttcagcctttctcttgggcatggtggaggcgactgcagtggaatgtaggtgctggatctggggatgcagcagtgcgtgggctttggttggcctgggggatagttcttacctcttcttcttcacactgctcatagagtatttctttattagaaatttaacatttaaaaaattcagtgtttttaatgatgttgattgtttttgttggtgctcaagttaaaatctttgttttcaaccctgtttttccgataagccttgttacttttagagtttgttgttgcgaagcattagttttttagcaatacatatgttcaattacagaagaaattcccatgattccttttcctaaggttgaacaatctgggaaggagggatgggaaggttaatagcagcatctatgggaggtttttcccaaggatcagcagacttaagcattcttggctgcaacttggcctaaatcagttttcccttggtgactatcttcctaagtgctctttattgtatatttaggtgattgtggttttgcatttctgtcctctctctgatctcttgctacagtctgaacaagtgtcggaggccgagttactcccacagctgagcagagccccatcccaggctgcagaaagtagtccagcaaagaaggtaaggtcagcctgaggatgctgtcagatggcgttgcgagtcccaccccgggcttcttatctctattagctgatctattgttttaaggtttctgtgtcctgaaatgaatgtcaatgatccagatttcctagaatgtgggttctttgtgaagattggggtcctgaagattcctgggcttgacccttgatgcattttgtacatgacagtacatactcaacctccttagccccccagctaaacatggtggccttgtttatggcaagagctaaaagggctgtggggagggacagatgtctttagcaaaaccccatccacctgctaagcctctgtgaatacctcttggggtggggtagtctctcctttttggtctttgtaccatggtttcctcttgcatcgtggcattttcacctggcatctgcccagccatgccattgggtcacctgtaatttgctcagtaagtacccctcactcatcatgctctccattcatctcctcaccctcttcttgtccttctcccaggctcttctttcagagagagtgggccttgggctcaggagcacaggtgaggtagagtcctccaaagaagcagaccaactgtgtccttccagaatacactgtggctctttttcttgactttatgtaggaattggggataggagaatgatgagcatatgactaagacctttaaaaacttccaaagcttaggtttttttttgtttttgtttttgtttttttttcctgagacagagtctcgctttgttgcccaggctggagtgcagtggcgcgatctcggctcactgcaagctcccaggttcacgccattctcctgcctcagccttccgagtagctgggactacaggcatcttccagcaggccggctaattttttgtatttttagtagagacggggtttcaccgtgttagccaggatggtctcgatctcctgacctcgtgatccgaccgtctcggcctcccaaagtgctgggattacaggcatgagccactgcgcccggccaaaatttaggtttaaaaggcttcaaagtgaggcaggagcctatcttgtcttcagttaggaaaggccccatggtgtgagatgcacacagggtctgtgtgagtttcaggtgacaagaagtaatagacttcttgaaacatttaaaaagaaaaagaaaaaagggaagaccactggactctgatgcctgtgtccccccagttcttgctgagccatgggtcagtaaatagagtaccctcctgatcttggggttggggctaaaggcatgtgggacactggaaggaagagtggagggaacattgaaatgtttaactttttaatttttattttgttttaaatccacaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagtaagtagaccacataaacaagagtgaggtaggaatctcgctctgagatgtcgacggatatgtaaatgtgttgacatttacgtgcgcaccaacagaaggatttcatggttgtaagtttatcttgctcatctctgtgatgggattcaagtctcccagtcacatagaaggctttataagctataggacttaacctgacctaaaggggcaggcgagtcctaggctgtggtgtttggtttggtttgatttctttcccttcctctcaccttctgttgtttcctactcctcttccttgtgagggcccaaattttcctggcaagatgaaagtattgtaagtggcaattttgcctctctgcctgtgttatctccttttccttcagggcaaatggctagctccttcacccacagacacactttcagtaggtgtggtatgtgattcttttaaaatctccgtaaagagtttctgttgttggtcgcctcagcacagaatggatacatgcagaacttccattatatttatctaaccagctggaacaggtattggagggagggtgaagacacctgtggacatggccagggactgagacaatgatgctctggacaaactatccttctctgtaaaactttggctttgagaagagccatcacttgcttcaatttctttgtagtgaaattgagggaggtgttgaggacagaaacctgctcctgtcacttgactgcaagtgagcctgaccggtcactaacataaatgctcaagacccatcatgaccctgcttttggggtcttgcaggtctcagatgctgctgcagattttcttctgcttacacgttgtagaatgaaaagcagcaggttctgtgggagatgttagcaacttgtctttgaagccaaagtcccattctgaatctctgcagccctctccttcagaagattttctttttttcaaatggacaggtccctggtggtatcagtccataaaggaagtatattttgttcatcacattcaccgagaactttgaccatcttccagcccctgttaagcctggaaggtgaagaatccctatcagggacaaagatggctcaattttcttccatgttctaccccagcactccactttaatttcagctttatgttcattttagtcagcagtggcttaacagtctccagagtagatgtcagggcatctggtggagttcatacagagatcttttctttttctcttttttataacagctttattgcaatataattcacatagcatacagttcatgtttttaaatgtacaattcagtggttcttagtttattcacaaagtcatgcaaccatcaccacaatctaacttttgtcatgcctaaaataatatatatccacgcccattagcaatcactccccattctctccttccccctcagcccctggcaaccacgaatctcctttctgtctccatggctttgcatattcttgtcatttcacataaatggaataatgaaacgtggtcttttgtgactggcttctttcacttagcataatattttcaaggtttatccaagttgtagcataaatctgaacttatctttttatggctgaataatattccattgtatggatagaccacattttattcatccattcatcagtcaatggacattttggttatttctgcttttttggctcttaagagtaatgccactatactgtttgtgtacatgtttttgtgtggacttacattttcatttctcttgggtctgtacctaggagtggaattgctaggtcatgtggtaactctgtctttaatatttcgaagaactaccacacttttcatagtggctgcaccattttatgttcccgttggcaacgtatgagggttccaatttctccattttgtcaacacttatcttttttttttattatagccatcctagtgagtgtgaagtgtgatctcatggttttgatttgcatttcttttgtggctaacgacattgatcatcttttcatgtgcctattggccatttgtttatcttctttggagaaatgtgtattcacaccctttgcccacttttaattggattattaatctttttacttttgagttatgaattctttatatattctggatacaactcccttgttagatatatgagaaaattgagccctctttgtaaatattttctctcattctgtgggctgtcttttcactttctattttttatttttattttttagagacaaagtctcactctgtcacccaggctggggtgcagtagcatgatcatggctcattgtagcctcgaattcctgggctcaagtgatcctttccccctcagcctcctgagtagctggaactacaggcatgagccaccattcccagccaatttcattttattttttatagtgatggagtcttactatgttgcccagtctggtctcaaactcctggcctcaagtgatcatcctgcctcaacctctcaaagtgctgggattacaggcctgagccactgcacccagccaattatcaatattaatcagatctgtacagtggtcacagtccattctagttcagttgctcttttctagaacctatctcccagtaatggcacatatggctgtttttctaggagaacatcagttgctcttttgctctaagaattcggtgtttcttgctgtgggatgaaaggttgtagattatccctgtggtaactgcactgatttatcatcccaaccatggacggttttgaaaagtaaagagagtgctaatgtacttatgctggacagacagttttaaatggagactgtaatgggcgcagtaggatgcgtggtcactctggttatgcgtgttctgtgaatttgttgttaattgggaaatactggtattaaaacgttctgtatttttctcaagagccacagatatatgctggtccatgcacatacacgagtgcacatttatgcacacacacacatatacttaggcattcatgcctaataatacataaggtagaggtaggtagtctggctaagttaatgtagaatttttgctaaaaataatgttcttgtattattttccttcagacttgttcacaggggacacctgcaggtcttctaagtgctattaattcttacacaaaaagggcattccagttaatatggtttgtcaggaagaaatacttattaaaatgtcttggaataaatggaacacaaatgtttgaaaaggcccatttcacagcttttattcaagttataaaatgggaattacttcaggtgtaaataattcatcccaataaatttgtttcatttggtgtctatcttcctgaccgcctgtgaatatgagattttatttttggagccctgtgttgttaaccacttgttagtttaacacctctcatgaatcagagttctgaccctcaagggtccagacctctaagtcctttttcactgaagtgtttgtgcttttctataggcagtcttccaaacagaagaaggccattcaaactgctatccgcaaaaataaagaggcaaacgcagtgctggctcggctgaacagtgagctccagcagcagctcaaggtaaggaatgagtcccagatttggatgaccaggcttttccctggcttttaaaaagcttttttttaatttaataggcatataataattgtacatatttatagggtggggtacatagtgatgtctccatacctatcatgtacagtgatctgatgtgtccattggctgaccatttagttccatccctgttgataagacttgcctcttcgttctcaaaccctttttggaaggtggagaattactgtatttaagtttcatgggttggttcttgcatagtcagaggaagactagtgactttaatatgtaggcttcatattgtgtatgagttaaaaggaaagacaatctattacgaaggctgtttgaagcattctttattatccaaagcttctgggtaagcccttaattatttacatcctctctgaaagaggatgtaaatacttatttcagtagaaggaagtcaccttggtactatcaaagcccagcccctcctctggtgccttgcaaatggttccatttcaccttctcaatgacatcacccctgtttctcttcatcgttactctcccctgtgttagtttctcggggctgctataacaaaatactacaaatgtggtggcttaagataaccaaaaatgattctctcacagctctggaggctagaactctgaaatcaagatattggcagagctatgatctctttgaaggctctagaagatgatccttccttacctcttcccagcttctgatgttgctggcagccctgggcattccttggcttgtagctgcgtcactccaatctctgcctctgttgtcacatggccttcttcctgtatctctctgtgtctgtgtccaaatttctcttcttattgtatcctcttataaggacaccaatcattggattaggacccaccctaatctagcatgacctcatcttaacttgattacatctgcaaagaacctatttgcatataaggtcacatttacagatactgggggttaggacttaaacatatattttgagaggacatgattctacccactatatcccccagttctctactggatcattcgccatccacatgtaaatatgctccagtattgtccattacacttggccaattactgcctcatttctttggtccccttcacagcaaagtttcttaggagtggttttattcattatctttactttcaaaccagtaattttctcttccttccacttcagttggcttcgtcctcctccactcacacccgtcttgtggctaaatccaatagggctgttttaatattattatttttttttcagaagaattctacacaattgatcatttcctcctctgaaatggcttttataactggtttttgacataccatactctcctggttttccttctgcttcactggtgcttcccattttcattctctgctgtctcttccttccctgacttaacttttataccccaaccccatttgccccaatattttagtatgaaaattttcaaacatacaggaaagttgaaagaatcataagtgactgcttgtatagacatcacttcagttctacaataacattttactatacttatttttaatcacatatctacccatttatccttgtgtccatcagttcatcttatttttgacatattttcaaataaattgcagatatctgtatactttccctgaatattttagcatgcgtataattagctagagttcaatatatttttacagttttttcttatgatgtaaaatgtttatacaaaatgcatgcacaaatattattattattattattattattattattattattattattattattatttgagatggagtctcgctctgtcgcccacgctggagtgcggtggcgtgatctctgctcactgcaagctccgcctcctgggttcacaccattcttctggcttagcctcctgagtagctgggactacaggcgcctgccaccacgcccggccaactttttgtatttttagtagaggtggggtttcactgtgttagccaggttggtctcgatttcctgaccttgtgatctgcccgcctaggtctcccagagtgctgggattacaggcgtgagccaccgcgccagcgcacgcacaaaccttaagtgtacatttgctgagtttgtaacaagtacatgtacttacggaatccaaacccccaaaaagatagagaatattaccatcaccccaggaagctccctcatgctttttcctagtcaattcctgccctacccacacagaggcaatcactattctaatttttataccatagttttgcctgttctataactttatataagcggtgtcttacaacttatacttcttgtaaagcttctttcactaagtattatgtttttgagattcatttatattgttgtgtgtatcagtaattcattcatttttattgatgagtagtatcccattgggtgaatatgttacagtttggttatcaattctattgacagacacctgagcggtttccagtttttggcaatttggaataaaactgcattttttaataagtctctgtatggaaatatgttctcatttctcttggattgggattcgtaggtatcatggtaagtgtatgtgattagtttctgagaaactgctagatcattttccaaggtggttgtagcaatctgtactcctaccactaatgtatgagagttccaattgttccgcgtctttgccaacatttggtgttatgattcttattaattttagctagccctgtagtgatatagtttttatcatctccttgctgactaattatgttgtccacttttctttgtgattatttacctttcatatcttactttatgaaatatcttttcaaatgttatttttctccaaagtagtctatagatttattacaaaaccaataaaaatcccagcaggattttttgtgagtatagacaagctaatcccaaaacttatatgtaaaggccaaggagctggaattgcttaaacaaatttgaaaaggaagaacaaagttggaggaatcactttactgtcaagctccagtaatcaagatgctgatgcacaggtcagtggaataggatacagagtcctgaaatagaccacatgaaaacagccatttgatctttgacaaaggtgcaaaatcgattcaatgagaaataatagttttcaacaaattgttttataacaatttgtcatttgcatttaaaaaaataaccttgatctaagcctcacatctatacagagattaacttgaaatgagtcatagatgtaaatgtaaaacatagagctataaaatttttagaagaaaacagaaaaatcttcatgatctggagttagaaataacaccaaaagcacaatctataacagagaaaaactaaaaaaattggacttcatcaaaattaaaaccttttattttgccaagcacagttaagaaaattaagagacaagctgctgagtgggagaaagtatttgcaaaacacgtatttgataaaagacttatatctcaattatataaagaactcttaaaactcaataataagaactctcaaaaccaaagcatctcaatttaaaaatgggcaaaggatttgaacagacacttcactaaagaatatataaagatggcaaataagtacatgagaagatattcaacatcattagccatttgggaaatgcaaatttaaaccacaattacataccactatacacatactagaattgctaaaacaaaaaatgtgacatcaccaagtgctggcaattagaactctcatttattggtggtgggaatgcagaatggtaccaccactctgaaaaatcgttcagcagtttcctatgaagttatacatacactaaccatgtgacccagctgtctctctaccttagtgaaatgaaaatttatgttcgctcaaaaatctatatatgaacttacatagcagttttattcatgatagcccaaacctggaaacaacacaaatgtccttcaaaagatgaatgaataaattgggatacattcatacaatggaatagtactcaacagagaaaagaaatgatacacaacttggatgaaactcagacattatgcagagtgagacaagccagtatcaaaaggttgtgtactgtatgattccttttatttgacattcttgaaaaggtaaaactatagtgatgtgaaacaaatcagtggctatcaggggttatgcatgagatgagagtttgtatgagtagtcccagggaacttttggggttggttgaactgtaatgtgtcttctttgtggtggtggttacacaaatctgtacactaaaagaaaaaaattgttttaccctatgataattttaaaaagttattttttaaatttcaaagttcattctgttttctaaaactttgtatgtgaacttgttttgttttgcattttgtttggttttggttttctcctctctccctctgctttggggtaggccagtttcatccattgttctctacatttggtgggcccttttggaaactgatattccccagttctgaagggttttttattttcatttttgttgtcgttgattatttcctcccccctgccctcacccccatttttttctcattctcccttactgatattcagacattggacttcttagcttagttctctaattttctcatattttctcttctgttttctttcttttctcttcctacattttcttctttatttttgtctatttctggaaacttaattatatattctaaatcttctgttgtttaataaccaataattttttgttctctgtttatttttgacggtatcctattcttgtttcattgttgtgatcttttttttaattatactttaagttctgggaaacatgtgcagaactcgttgtgatctttttttatggtcatttttctttcttcttcctgaatagtttgtgtttgttgtgttgtgttgtatgtgctttatcttagatgctttcctttgatatctgatggcccttctttgctcatatttaaaaggaagatgaaaacactgattagaagttcattgtacgttgtaaggcttgtcaactctgagcttcactgtctggcaatttggctcggctgtatagttggggaacccccaaagggagtatgattagctctttcctcttggtctggttggagtgtccagagtggagactgttttggtcacctacatggagggatagagttggttcagtggagcaagagggctgtaggtctcagcattccaggatattcattcactctccctatttctggcccagtatcttgtcctcaactgtgcttgtttcttgctaatccagatgctctctgttgtaccttttcaagaaataaaccttcagcattctgccctggtggcaggaatgatctggggatctaattgcttctgaaacagattttcagccaacacttattttagccaactcccatctccccttatgtactcccactttaataggtatctggtgttgccaatttgagtctttcaggaattctcctacgtaaaatcaagttggttcttatttttcttcatgttagcctgggactcagctttctttacttgatctgtatgagtggaaaagttctaagtctagtgaacagaagtctgaagaatcattgaaacagaactatagtcatagcccctcaattaattcccaggctaagccagtttatagatccagaacctcttgaatgatgaaggggcatctatgtctccttaaggaaggaccccactgtgcagccaaaaatttacactgcaaatctttctcctagcctttcctaagggggaccctgctgccatttaccagggtgactgtgcattagaggaagggaaataattagacttttggggaattaccagacactggctctgaactcacactaattccaggagatgcaaagtgtcactgtggcccatcagagttggggcttagggagatcaggtgatcaatggagttttagcttatgttcgtctcacagtggacccagtggactcccaaactcaccctatggttatttccctagctctggaatggcatgcttggaatagacatactcagcagctggcagaattcccacatttattttcctggatttcctaagtcatttaccattcaccagtttgccactcagctttcaaattttattgctatcatcttgtcccttttgttttccctgtcttgtgggtccgtgactttgaaaagttgctgtattgttttagtggtgctccaggagggagagagtgtggtacccctggtcagtcttccatctttacctgaaacctctatctatactgttttgctagatgatgttatatggtctcatggctttgaagaccatccataaactaatgaaacctaatttatgtctcaagccctacttctcctttcctctgtgctctagacttgcatatataacttcttactcaatgttttctccttagatatccaatacacatctcagataattaattgccaaccctctccttgaaatactcatttcttatctaatcttctcattctcaatatcactaccagccagctactttcttcatacaaaaatcccaggagtcatcctcagatttttcttctctcctacatcaactttatcagcaagtcctaccagttctagattcaagatttatctagaattcatccacttctcttcatcttcatggcttctaccctgacggaagccattttcatttctcacctgggtccctgcagtaacctcccagttgctcccctgcttccactctcatcctgctataatctactgtctacacagtagccagagtgaaaattttgaattttaagttgggtcatgttccttccctgattagaaacactcaatgccaggccgggtgcagtggcccacgcctgtaatcccagcactttgggaggccgaggtgggcagatcacgaggtcaggagatcgagaccatcctggctaacgtggtgaaaccccgtttctactaaaaatacagaaaattagccgggcgtggtggcgggcgcctgtagtcccagctacttgggaggctgaggcaggagaatggcgtgaacctgggaggcggagcttgcagtgagccgagatcgcgccattgcactccagcctgggcgacagagtgagactctgtctcagaaaaaaaaaaaaaaagaaagaaagaaaccctcaatgccatccccgctacatttccatactatttcctctgcccacaaggccctgtacgatctggctccttgcttaaatctctgacttcatttcctgccaatgtcttccttgttccatctactctggtcacacaggctttttgttcatcaaattcaccaaactcactcgctcctcagggcctttgcagttgcccttttgtctctgtgaatatccttccccccatatcttcatatggctcactcctcatttcattcaagtctttgctcaagtattgctaactctgagaagccttcccagggcactctctctcctttctcccatatccccctctgttactctctattatgttatcttatttccttctggaagtatcttgttcattaactttattatctttctcaagtcatttgaatataagccctattgctctgatctggcatattctttgctgataccatcacagctacagcattacctcacctgtaggagatagaaaccaagagacttccggctgggtggctaggagagcatgtgaataaatacttgtgaagttgtatactgactattagtatgctgattcttctgaatctcacaattcagcctttctacaggattctttcccaccttgactgattctacttgaatacctttatgtgtcccctctcttcctgccaaaaaaatccgttttaggcccgaaagtttgaattcccaaagagcagattgctcagcctcttttctgcctttcacccagatgttgtaccttacaccatatgttgtgcagaaacttggatgagactttggtggaggggcaactagcgtacctttttggccctcagacctaactgagtatggtgcgggattacgagccagagattgcaactagaaatttaagtcctgttggctcactgctcagtattgggagtctgtttttgctttctgctttctcctagtcttttaatttttaatgactctgtctaccagctactgatcttgtcaaaacaggctaaaactagggcagggtggtagaggggagtaggtcagtttcatttcatcacgttcagaaaggagttgagagattacaaattgtgaagccccttttgtctggtcaccagcattaaatctgatacctcccagtcctcctgttcttgagttatacagcacttgtatttgtgggtccagttataagtttccttttaaatctgatgaagtagggatgaattcaagaaatgacccctttgcttttttgtttttcttgtgttttgtacaactcaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttctcttgcacttcacttgtatgttttactgtggtggaaaaaatacttcaactgattatcacacttgaaatgctaattatcagtggaatttgtctcctattcttaagtacttctgcaaggtattagatgctgctccttaccaaaaatcagtcttctagcaaataaaaataacttagagcattatttatttaaagaatttatgttttctataaaaccttataaccaagaaccttcaggatgcttgtaaccaagtactttcaggatgctttttgtatgtatatcacatagagtaggttggtttcctgagtaattgggattccaactagatagtcattggtgtgaccataataaaaacaaaagctaaaataaaagcatcagatttagactggcgctgtgccctctaccactatatgccaaaaattgcttctctagtgccattttgatattatatctagctataaataatacatgactatcgttttctattgaatgtcaaagacttactgggtctttacacctctgtaaagtggaggttttggcaatgagctgtttaacttggccaagctaggctgtcaacccagacaactcagtcctttcatgtaaatttttgggcaagagaagtctgctttgactgccttgcctgaccaaattaaataaatagttgccagatctctacttttatcctgcatgggataatatatctgtaaatgcatgagtttggaaaccacccatcaaatatgaaaggctgatgagactgttaggattgataaacatttgttgtttgaacccagctatccaaactggggaagaaggggaaatggttgttaccaacaatctctagtagttattttaatctttattttaacctggattgcaaatgtatggggtatgaggagataatgaaagaaaagtggtcctcatgctggatatgtgactgttttgttctctgtaaagtgtattcttgggaagtgattggtttatatcagattcagaggagcccaattaactccagtgtaggtaatgtaaaacagtaagctcaaattgcagaagccagtatcctacagaaatttaagtagctactgcttctcctgaaagcccaagttgaaaatgggaccacaggggcacagggctactgaccctcacagggcatgccagcgttaacaccactttgagagaccaatggcaagaaatgctgtctcttgtgcattttactaatttccccattcttagggtagcagggtgggggtgtatagggtctttttgaagcagttttggataggtttgcaatatgtgggattcagcctttgatttcaatagagctgagagcttttagaacaagcaggcatttatttaatgtttccttagtccattggcaagctttatcaatagcttaatggcagaggataaaggctcaaacagatgatgttttttccacagaaaaacaaattgttgaatctattccgtgcatatttaaggattttgaattgattttgaaaatcatgaaacttgaactatttttctattccctttttttcttccccatttgctgccttttttgtttttgtgggggaagggttgggagtaagtttaaactcttccgaagattatgaatgggtcagcacaaatttttaggcaactgctttttccatgttctgagatctacgggctacaacaaattttatcagcagtgttttttgtttttttgagatggagacttgctctgtcgcccaggctggagcgcagtggcgcaatctcggctcactgcaacctccacctcctgggttcaagcaattcttgtgcctcagcctcccgagtagctgggattacaggcacccaccaccacgctcagctaatttttgtatttttagtagagatgggattttgtcatgttggctaggctagtctcgaattcctgacctcaagtgatccacccgccttggcctctcgaagtgctgggattacaggcgtgagccacccgcccggctatcagcactgttctgattgcagacgtttcacagcatgtttggcttttggtaaattcaatccaggaaagactagcatgtgcactttatctcataatcttccagtacatatgctctcagttgggatagcagttcatttccattaggcagacgtataaactaaggaatgttagtctgcagtattcattttaaaaatattgacatgcttttcccctcccctccatgaagtcagtgccagagtgagccagattgggaggttggggttttgtttggttggcttggttttcattaagggaaaaaacttgcattggacaatcaaattcccctgagtttcataatctcatcaatattttaagataggcgagcacacactaataatatctatgcctaccttcttgggtggactcaactgtaaccacagtttattagttgcttagaagtggatttttaaaaaacagttaaatgtgtgtgcataacacacaagtaatgacacactactattattattacctaagtagtgctcatcctctctttctgtgttttcttaggatgtgcactttaatttaggattgtaacgcctaataatatttctgtgagcctttaatgtgatttataagatggccgaattactgaaatcaccattatacctcttccataaaacgactccaaagttagacctgcctgttggggagaattctatagacagaaggtcaatgttgtccccatccataggggttgaattaccttgctgttaagtggtcttcccccattgggatcctacagtcccacagatgaaagcacagtagtagctgacagctggcttatttggtccctcggcatctctcgtatgtggcatattgcttttgccactttcctatccagcagacatcaaagcaaaactaaaaggtagatatctggaatgaatgtatatgttgtaattgaggcagatatttgccttaattggaaggatctaactgctttacaaatattaaacaagtgcttgggcatgattgggagaggaggcagcttagctggaagctgtgcccatcttactgtcactggagaataggatgtcagagctgggcaggactggtacccatcatttgcagtttgcatgtggggaaaccaaagccctaagaaacaacagttcctggcccaaaaaatccatagaaagaggtaactagtggcagatttggggcgccaacctgattttatggattttgagttagattctctaccctctatcaatactaaaaatagattaggagggtttttttttctgtttatcatgttgaatttcattgacttaattagtctttaaatttgaaaacatgttttagggagtttagttctagaaatttctcttagattgaagtgacagaatctgaaagaaaagaatatgattgagctatttgttttcctgaacacctcaccttttatgatgcaataagttactctgagtttcttggcagagtttttgacagctgttgctttcaatggattccattcctgtattccttatgggaggttgtttttaaaatagactactgcgattgaaatgaactcaatatgtagttaagttatagttttcttcaatgtatttttagttacttgggtcacaaatgttcaatttcagcatattttagggtgagtaatcaaaaatgtgaatttgcctttgatttcctaccactgtctgagctatcataaagcattctctttagttgtgatttgattctatagtctgtttctaaatgacatttgtctgtttcttaaatgatctcacagccatggtaataatagatgtgtactcagaagatcaataaggtaatattggaattcatgtgttttttgcaattaaggcaggcatttgccaatgtcttcttttaagcagtagttggaaacatctcaattacagtgtaacaccttagagctaaaaacatttgttcaacacaaactagaatcacaccttctcactagatatcaccaagggaatgtggttttaaaaataaaaagaaaacaatataacgtatcatggcaaccagagcttcccatattattgacaagtagggatcattaggttctggtttgaacattctgaatgtgaacaaaatgaaatagtagttaagaggtgttttcccactgtgtttaaagagaacactagtaattctggtttttctttctaactgctttactgtttcaagggtattcttttaaaactctgatttcaaaggatcagttgaatttatactttagttatgggtgttttgttactttttttttttttgtatcatgactcagtatggttcaatttcctagtaagaagtggggatttgtgtttttggagtcctcagctcacatgtcttgttcctccttcagcacaagctaggggagatcctaccaacactgataggtcagtcattgatggcaatttgaatgtgggtattactctgtgagccaccctgcttcgcttgtttgtaaggagaaatgcatctggttatgtgaatttcccgagagcagcagacatggagggccagactttaaaagcaacgcaagcagattcgaagagctgttgccctcttctaaaaaaggcttttggaggctgtgttacatgcatgccctaaagcagtcagtctgttagtatgagcaagacatctgaagtacacagttgcttttaggcttgtatagttattttctacacatgccaacacacatgatgataaaggaaccttttctaggaggcattgcagggtttcaatacacaggacatgttctagttacagaagccttgctctgctgtcaacaattgggaaatgctcattttttcatgttttgtgaatactctggtcttgctgtaagctaatgtcatggctgtgggatattagagaagtgggtttatgactctgaagaccagcagacaccagactttaaaagtgcttaaattggaatttggaaactacagtaaagaaaccttcagataccagttccatcctgaagccctctgttgaacaacagggccagatcctaaagctctttcagggagctcttctctggggctggaacagttgattatgcaaccccattgtgtggagattggatcaactgagttgtgttatttttgttttaagtcaccttgtgcgagaacctcaaccgcacctatcttgggaaccgggtatacccttttctttagcactgctatcctttttgtcttcagcacaaataagatgttcaagtgagccagaagcaagaagagccattttagtcttcatagctattggctaagagagataatgagctgatggtctattttaaccttgaaagtaaaaatgtatattttttcactacaagtacattgaacagtaaaaagtgtaacagcaaagtatatatttgatgccttctgtcttttcatgataatgtgctaacaagttgtgttaatattttactcagccagagtctcattcatttgctaagcattgggaacattatgtatattgaccttaaacataggtgtcctatatttggattgtgacttgtagactcaagctaaccttactgcctctttttcacacttgttgaaaagtctgtgaagaacatagttaaagatctccaactttggaaaatatacatgatgtgaaactggggtgctatgttaaaaataaatgtatgataactaa

SEQ ID NO: 62 - DNA, 353507 bp, Homo sapiens
atgaggacaagcatgaaaaaagtagggatgcatcatttgagttcttcaggaggaagctactacctaagtaagagacattagtatgattaagtgtgatgtcattaatattcccccaaactgcctttatcctatttgtactgtaggtaatttttgtgactggggaacatccccagttgtattttcattttaatgagaaatgatgacagtgttgcctcattgctcttaaaaaatacaaaaattaaaacacacacacacacacacacacacacagaactgacataggacctcagtacatttttacctttaccttgctgctgctgcttttctcctccttctcctcctcctccttctcttcttcttgttctcctcctccttctcttcttcttcttctcctccttcttcttctccttcaccttctcctccttctccttcttcttcttctcctcctcctcctcctcctcttcctcatcctcctcctcctcctcctcctcctccttcttcttcttcttcttcttcttcttcttcttcttcttcttcttcttcttcttcttcttcttcttcctcttcttcttcctcttcttctccttctccttctccttcttctccttctccttcttctccttctcctctttctcctccttattcttcttctttcttcttcttcctttgtttgacagagtctcactctgccgcccaggctggaggctggagtgcagtggtgcaatctcggttcactacaacctccgcctcccgggttcaagcgattcttctgcctcaaactcctgagtactttgtactacaggcatgtgccaccatgcccggctaatttttgtatttttagtaaagatgaggttttgccatgttggccagactgatctcaaactcctgggctcaagtgatctgcccgccttggcctgccaaagtcctgtgattacaggtgtgagccactgtgcccaccctaccttgcttcttcttaaaaaacaaagcaaaacaaaaccataaacaaaatgctgaggtttcttctagcactggtctttattgctcactagtcaaagctcctcattttttgcaattttggtaagaatacttaccatgagacctttctttttaaacacattttaagtgcattctactgtattgataactataggcaaaatgtcgtataactataggcaaaatgttaaacagatctctagaacttaatcatctttcataactgaaactttataccagtcgaatgctgaacactatcccattgtacgtctacaccaagttttctgtattcattcatttatcaatgggcattttggttgtttccatatcttggctgttgtgaataatactataatgaacatgtgaatccaaatatcttttcaagatcctgattttaattcttttgtgtaaatactcaaaaatggtattgctagatcatatggtagttctatttttaattttctaaggaacctcaatactgatttccatagcagctgccccattttacgttcctaccaacagtgtatataggttccaatttctcagcattctcactaacacctggtagtttttgttttgttttgatagtagccatcctaacaggtatgggatgatctctcactgtggtcttgatttacatttccccagaaataaactcatatatatatatatatataagatcaacttatctttgataagggtgccaagaatacacaatggggaaagaatagcctcttctatgaatggtgctggaaatactggatagccacatgcaaaagaataaaattagaccccgtctcccaccacttgcaaaaatcaactacaaaaagagtcttaaatgtaaaatatgaaactgtaaaactcccagaagataacatggggaaaatgcctcttgacattgatcttggcaatgatttcttagatattacactaaaagtacaggctacaaaagcagaaataaacaagtgggattgcatcgaagtaaaaagcatctgtacagcaaaggaaataatagagtgaaaaggcaacgtacagaatgagagaaaatatttgcaaactatatatctgatacgaggttaatatccaaaatatgtagagaactcctacaactgaatagcaaaaaacaaatattgccatttaaaaattggtaaattgcttaaatagacatttctccaaagaaaaagacatacgaatggccaacaggcatatgaaaagatgttcaccatcactaatcaacagggaaaggcaaatcaaatcccattttagagatggagaaattgagggtcaaagaagaatgttatttgcccaaagactctaaactatctggtggcagagcctggatgagaaccttggccttctgattccttgggcgtacttttcccactccagtttgtgctgatgactgctctgccactaaatcatgtgtattaaagtttctcttctaccagtctgtgagggcatggattctatcatatttagctgaaatgattatttcttcagcctttcttgtgcaacttcctctatgaatccctgagtctgcatgcagaaatgcgttactgaaatgcagaagccgttttcccccactagtaataatctgttcctcattcaaatacacaccttctgagctggggttttgtcctcttttgttttctttaacatagatgtgtcctgactatgtggagggactggaaaaggaaaataacgtttcacaggagaagggctgagaatattgttaaagcacagacaatggtggagcttgaaatcagagaaaaaaaatacagtataatggctccctgtcccttgtagcattccatctttcagctctcaccatattccaagcacaactacgtcccttaacaaaatcatatccctgaatcctgatgatacccaacaactcagataaatttcccagacctgttcccaacctctctctggtcacacctgcattcctgaccttaacgaccttctcccaaccttgattatatccttcaaccataaaaagccacttgagctgaggccattctaccacattaatcatgtcctccgctgttagttatacttctatcctcatgctcgctaaagtggccacacagcaatagtatttaacacaccctttctgactcttcttccaagccttgtcaaactgcttggctctgatcagatgtccagtgtgatccttgattctgaacaccaactggtgactgattctgggagccagattaaggcaggcggtaagagcaaaggaattggatgaaccaagagatatgtgggagagagagagaaataagatgtgagaaaaagggtaaggggactgagtatgagaagggcttcatggcatggccaccaagtctagaattaaatgtcttttgcttgtgggtgggtattgagaatgagtttaataaggtaggctggttcccaatttttacctctctgtgaactgtggtccaaatgggctgggctgttggactgtatcacctgagcctgatggagcaggctgattgagcattttctggaacgctgtgtgggtgaatgatgatgtacagaatatgtcctatccatcctcatttcttcccattcactcctagcatgttggtatatacctgacatatcatggttgctcaaaataggatcatttcttcagaataattcttgcattccttagtatggcatatagagccctgattctcaactgcctcatttctcatcaggataaccctcctcccttgtgttcgcatgtgtgtgtgtgtgtgtgtgtgtgtgtgtgtgtgtgtgtaagcacacaattttgttccagctgtgtttatccaacggggccaagttctttcacatcctgttgccattgtacctgttgtttctctacctagagtacccttttcctctattttttgctcagtcttccagtcttatcacaagcactactttgtccaaaaagcttttcttattggccctagaatctcctcagatgtcccttttctgtgttctcatagcattccactcttaaggcatcattgccataagaatgaaataaacaaaacttgacagttttgtttctgatttcatcccatattgaaccatgagcttgtagagggcagggactgcatcttatttgtatttttctactcctagtgcttaacccaaggccttgtacatattaggatttcaatgtatgtttcctaatatgtgaatggaaaccttcctcctatttatcttctctgttctatttgacttttttgttcactttcatttttttgtctgtaaactgaatacatacattaagaagtcaccaaaatgaatgggcatctacaagcaaaccctattcattcttatcatccagaaaacaacctgtatttctcctaaacacaaatttcttctatgctttccttgccattaatgcaaaaaaaaaaaaaaaaaaaaaaccacacttctggaagcatccatagtgatgacgatcattactattctctgtattctctgaagattattagaatttatcaagcagctgtttcatgggaagagtgttagcaattgtattgcattttgtagctaattgcaggaacaaagtgtcaactaatgcaaaatttggtttttaaaagaaaacattctctccctaatcaagtcctcatggtaaagacaacatgaaattattattgatcatcactcatgagccaggagagagatgaagtagtatattctttttgatttctacttaagaatttgaaaggtaggatgctacatgtttcaaggagatttgcagaatccagtaatacaaattctgaagactgaaaatcaggtaaggtttggctcggggattaaaaggaatgggtaaaaagtgcttctgaacattagagaagcccagactgatagagatggacagacttttcagaatatctattttggtgatcctcaatttctctttttgcttatatcccctctaaaaggaaaaaaaacattttgaaaaactacataactgttcatacatctttatattgagatatatgtatatacattttaatcatgagtttaaatggttatgaaggaaataactttcagcatattgcatattgattatacattttaagtacatttttatcacagccttggcattactcaattaactcattcagtttatgggaaatgtctgccatgtaacctcaatagtgaaaccagtcctcattgtcaaaccagcctgccaactcagactggctttctgtttgaaagagtctgatttcattatattcccctgtgacaagcatctcgctactgaattctaacataaagataggtagctaaggtacagagccttgccatggtttgtcacttggatgagataaaggcactgcctcatcaatatttcttacccaaacactctgctttgctctccagggactctttttcaggagtctctgtgtccttgaatcccttctttgttgtttggtaccccagaggatcttgccctctggtacaatgctccatactaaaattcaggatgagaagtatgtctgtctctcttttgtcaaatgggaaaaaggtcattgtggaaattgaaatggaaaaaaaaaggaatatacaaatggtaggaagatataccaggctactcactctttggaaagtcagataaccaaatttgcctgcacattgtttacatgtaccctaaaacttaaagtataataataatataaaaaaaaaaagaaaatctctgatcttatctactcctcccttattttgttgttgggccaactgatacctcgaaaaaagaatggactaatcccaggtaccaatgcttgttaaccagtggcaaagccagtactggaatataggtattttcatttcccaactaatgtgcttcctgcctcatggtgtctccttaatctgtcctatattcaaacgattgtaatttctttatccagtcacagtggggtttttctcatagaagaggtctgacctttacatttctttacagggaggtgtgtgtacatagagaatgccaagatggtagttgtttgtttgtatgttctcttacattacttgcagttgaagcaggtaaggtgactacttaacaagtcttcattcaaaaacctgtaatttgagaagcttgctccatattagtggaaaatgcacttttcatcatggggcctaaatctcttgatgcttatcattttttttggaatagtttactatttacttaattttgctatttttgtagatttagttgtaaggtctcaaagtacataactctgttttttactccattatctcaaaatcctgtaaaacattcagtaatttggtcaaactgcctcagttcagatattgatctgccacctgctagcagtatgactttggaggcagtgttaacctcttgttacttcagtttccccctctgtaaaatgagttgtgatgattgaatatattatataaatctaatgctttgaagtacctggtacaaacataataagtcttcagtaaatgttaactattgttatcatcattgttgattgaaaccatcaagtaatctaacattaagaacaccaggggccgggcgcggtggctcgcgcctgtaatcccagcactttgggaggccgcggcgggcggatcacgaggtcaggagatcgagaccatcttggctaacacggtgaaaccccgtctctactaaaaatacaaaaaattagccaggcgtggtggagggcgcctgtgatcccagctactcgggaggctgaggcaggagaatggcgtgaacccgggaggtggagcttgcagtgagccgagatcgcgccactgcactccagcctgggcgacagagcgagactccatctcaaaaaaaaaaaaaaccagggcagctagcccatagagattaaacaggttggaaagtagattaaatttacacagaggcaagttatgaggcagagagaacagacctgcagaaggaagtggcctggcagtgttatggacggtccatcaagtcatgtctgaaataatggtttagaacaatgctgtccactggagctttctacaatgatagaaatgttctacatccacactttctgctatgatagctgctatttgatatgatagccagttgtcacatatggctcttgagcacttgaaatccggctaatctgaataaaaaatggagtttttcatcgtatttgatattaattaatgtacagttaaatttatatgacgacatatagttagtggctaacattttggccagcacagatccaagacttcagctttgcttttgtcaattaccttaaatctttgaatagtaaaccagcttaaataattcatgagaacagtgacggtaagactgtctcttccagctctgtccatctctttgttactccttcatctctttttctctagctctgctcccatttctcacacttcatctgtggtatcctccttcattactccatgtttctttaaagccaggctcctcagccaaatatattttgatacctgtgcatgtataggtatgttcttaccaattaaggtcagatattcatgagcaagtatatgaagacacttatggtgcaaaggccaatttcttaggaatggaatgtgattgtgaggaagttgcaagctgtggcaaaaagaaaccttttcccacattattttcatgtgaggaattactgtccatcaagttagtattgattccactcacctattaagtagtagatcataggcaagatcatttaagattttgtagactgatggcaaaagctcccactatttaccagagctatataaagatgacatttcaatgccttcctcatgttataacacactatattttgaaagcttaaatagtcctttaagggaaagagaaacacttaatatacgtcaagaaaacgaattgcatttaatgtgaagaagtaccggccagaccacatgaagtgagcatcactcatgttgctatccaggcactgctttgggccagtgttcatcatgtgaacaaagtttctggaccttccaaaactacccttctctacattcctaatattcagattcaaagagttcattgttagtattttgattatcttaaatgtgcactgagtcatagttaatatcttaaatgacttgaacatttgctattctaacagaggctagtttatagagcactgtaaaacctctttttatttatggaatgcatccatattaaaattataacttcagcagctttctgtggagaaaatggtgactctgaccttttattccatctgaccactgagaaaaggactataatttcaacaatcaaatctcaaatgtgttattgtgcctattttctttttgtaaaatgtcattccatctatcatgctaacagctcaccttaatccattttcaatgggcttttttgcagaaaatttgcacaaatattttaaaatttctctatttcaatagcttttggggtacaaatggtttttggttacatgggtgaattttatagtggtgaagtctgaaactttagtgcccccatcacctgagtagtgtacattgtacccaatatatcattttttatctcttgtcccccttttaccatcccccttctgagtctttatagctcattatattgctctgtatgcctttgtatgctcataacttagttttaacttataagcaagaacatatggtatttggttttccattcctgagttacttcacttagaataatggcctccagctccatccaagttgctgccaaagacattattctgttccttttttatggctgagtagtattccatggtgtatatatactacattttctttatccactcattggttgatggacacgtaggtttgttgtatgtctttgcaattcacaatttttaaaaaatattctttaaaatagagctgttgaaagctctcacatgtttccagcgtaaacgtatttattaacaatgatttatttgaaaggtcagaggaatgtgagccttgtttccggtggtcacaaggggccaggagcattcccgagtccagcgcataacaaaagtaatgcagtgtcagaagaccagactgaaaacagcagttgtcaatgaatggacactaatgcaattcagatttttaatttgtttttctattaagagaaagtgagaagtgtccaatgaacagtggctcaaaatctaatacgcttggtcttaggcaactccctcaagctccatttcctatataggccaaactgccaccttcccagtatattcacattgctgccagcttaggcttcctaaaacacaacatagtgaccttgaactctgataatctcaaaccttccatattcatcaaagtccttcacaatttgctcttaccctcattctcaacattgcttttattttgttcccctgcagccccagtgaactgctctcagtcctgatgtcattccccacacttttttgccatcttttgctcacaccattcttcctccaaggccctttctttcctctggatctgtgacaaaagaactacccattcttctaattgaagttcaaatcctatctactccaaggaaccttcttagagcccccagtaatactgaaggcctttcttcttcttttttttttttattatactttaagttctagggtacatgtgcacaacgtgcaggtttgttacatatgtatacatgttccaaatgtccatcaatgatagactggattaaggcctttcttctttacagttctctggttctctaacactctggtgtagtagaagagctgggaatcagaaatcctgagtttggattccagttctgccattttctatgtacatgatcttggacaagatagtcaacctcactttctgagcctgtgccatcaactggaaaatggagataataatgcctttcctgcacatgtcacaggcttgctgtgaaactcaaaggagataatgcatgtgaaagctttctatatacagtgaagtgccatgcacatggggagtattattgctttcattattgtttttccattgaaaaatcagccaaggctgcttgaagcaatttgcttgaatggcacagaaggatgaagtttgtcagtcagtccctgagcacaaccatcaaagtgtcccagaaacttcagtatttcagcctccaaactttactctccagactgcctctggcaccacaaaagaaattgaaatcctcagtctcactatgtgttctgatttagggtttaaaaattagggtgcctgtaattacagcacttgattgcactagatatgagtttcatgaaaacaggtaccgcatatgattcatctctgtgtcttctccattgcttagcaccatgctgatgccaatccatagaatatgctaattctcacagtctcctttactgagctgtgatgaatgtaagtatctacggatgtaatatatgtaactgaaatcctagttgttagattacaaaacacgtattgtgcccatttgatatgctgttagactttttctctttcctttcttttcctatggagttgaattctcctaactttctttaaatattcaagaatagaagacttagaaccagaaagaggagataatgattcagtgaaaaggctgttgaaaggtaacaatcaggtcacatagtagctacttggctgaactgtagagatgagtcttctgcagggtggcagtcttgcctgagcccttgtttccagggtcaggggatccttgtaggctgtattataaaatgaataaaatcacaccagccagagagctccactatatttcctgcttatatccttttaatcaactcctcatgtaccaagcacccaatagtgaagagtcacaggtaacccagttctgttaacattatagtttccttagtttcctttattttccccaaatttgctctgttccttattatccaattctgcattcacctgactcctggcctctgaccccttgtcttattttgttttctgctgctataacagaatgctgcagactgggtaatttataaacaatagcaatatatttattagagttttctgtgctgggaagtccaagggcatggttatgtcatttggtaagggcctttttggtgtatcacaacatggcagaggacattacatgttgagaggtcaagagtgcttcaactcagatctctcttcttcttataaagctaccagtcatatcatgggggctccaccctgatgaccttatctaatcctaattgcctcccaactatatactgcctacaagagactcaagttcgcctgtaagaacatgcgtagactgaaagtaaaggaaggagaaaagatattttttgcaaatagaaaacaaaatagaacatgagtagctaaactcatatgatacaagataaactttaagtcaaaaactgtgaaaagagaccaggaaggcaattatataatgataaaggggaatacagaaagaagatacaataattgcaaatatacatgcacccaacatcagagcatcaaactgtatcaagcaaaaattaatagacctaaaagggaagatagactgcaatataatagtaagggacttaaacacctcactttcagcgatggatagatcatctagacagaaaatcaacaaacaaacattagagttaaaccacattccagattaaatggacctaacagacatttacagaacattctatttaacagcaccagaatatacattcttaacagcacagggaacattctccaggataggtcatatattaggctgccaagcaagttttaaaaatattttaaaaaaccaaaatcatattaactatattttctgaccacaatggaatgaaattagaaatcaataacaggagaagctctggaaattgtacaaatacatagaaattaaacaacatattcctgaacaaccaatgagtcaatgaagaaatttaaatatttcttgagacaaatgaaaatggaaacacaacatacaaaagcctatggaatacagcaaaggcagctccaagagagaattttatagcaataaatgcttgcattaaaaagtagaaatatttgaagtaaacagcctaacattacacctcaaggagctagagaaacaaaagcaaactaaacccaaaatgagtagaagaaaagaaatactaaatatcaaagcaaaactaacaaaaaggtcctaaataaattataaagctcaacaaaattaagagctttttgaaaaactaaacaaaactgacaaggcttctacctagaaaaaaaaaataatgaagtaaattattcaggatctataagaaactcaactcaatagcaaaaataaaacttgatttaaaaagtggacaaaagatctaaatagactttctcaaaagaagacatacaagtggctagcaggcatttaaaaaaatgctcgatatcgctaatcatcacgtaaatgcaaatcaaaactacaatgaaatatcatctcacgcccattaaaatggctattatgaaaaagacaaaaaataaaaaatgatggtgagggcccggcacggtggctcacacctgtaatcccagcactttgggaggctgaggcaggtggattgcgaggtcaggagatcgagaccatcctggctaacatggtgaaaccccgtgtgtactaaaaatacgaaaaaattagccgggcatggtggccggcgcctgtagtcccagctactcggaaggctgaggcaggagaatggcgtgaacccgggaggcagagcttgtagtgagccgaggtcgcgccactgcactccagcctgggcgacaaagcaagactctgattcaaaaaaaaaaaaaaaaaattctggtgaagatgtgtagaaagggaaatccttataaactattggtcgtaatgtaaattagtataagtcaacagtatggaaacttctcaaaaaaaaaaaaatagaactaccatatgatccaacaatcccatgactaggtatatatccaaaggaattgaaataagcacgttgaagagatatctgcactcccatgttcattgcagcactattcacaatagacaagatatggaatccacttaaatgtccatcaatggatgaatagagaaaaatgtgatatacacacacacacacacacacacaatagaatactagtgagccataaaaagataaaattctgtcatttatgacatggatgaacctagaggacattatgttaagtgaaataagccaggcgcagaagggcaaatatgatgtgatctcacttacatgtggaatctaaaaaaattgatctcatagaagtagagagtacaacagtggttaccaagacttgggtaaccactactggggagaggttgatcgatgggtatgaagttacagttagaagtaataaaatgtttgtgttctattgcgcagcagagtgctcagtgaacaataatgtattgtatacttcaaaatagcggattttgagttcataccacaaagaaatcacctgtttgaggtgatgaacatactattgaccctgatttgacttttacacaatatatatgtatgtatcaaagcatcacactgtacccaatacacatgtacaattattatatgacaaataaaaagaaaatataccttaaaaataaaacaaaagtaaaaagaaatcccacacaatgaaaaaagtatatttgtttaccatatgtctgacaagggacttatgaaaaactattacaactcaattaaaaaagacaaccaaatttttaaattggagaatctgtagacagttttacataaatatgtgcaattattatttgtccgttaaaaacaaaataaaactgaaaaacaaaaaccctagcaattattagcacttactatgtacatgatactgagttaactgctttacatgtaacattatatttaattctaacagtattcctttgaggtagatactgttcccatttaacagaggaaactgagatctagaaaggatagttaacttgccaaaagccatacagctaataggtagaggagccaggaattcaatctatttttgactccaggcccctggcaataccctgtcctatttctcaccagggaacccttggtgttgtgggccactttggtcagtgctccccagatttgcatatattctttttcataacttagaaacactcaacttctgaagtttaggaaatacagttcatcatgaacccacttaatctttgttaactgcggagaccaggtttttgaattttactcttaactcaagttgccaatgagtttgctgaaagattaaaagactaagtgctaccgttgtgtggttatttgaattaagcatcgaagtgtaacatttatctataaattctcaactctagtgcctaaaatcattttatttcttgtcatattcgaaaataggatttggttgctgaaaaaagtatggagaataagtgggaatttaggagaatctgcaaggcttgttggaaactcaagcagacgaagaccagtttggaagtgatgtattaactcctaaatgcattttttgttagtcactagcaaatatcgtgggtccccctggtgctttgtgagaagataaatttctcctgtaggtgaattaggtataattggaaacaattggactagaagcatcctgacgcgctctgggtcaaaagcttttcagcaaggctgtttttaggagcgtctgaattgatactgtttctgtagcctaccaatctccaaacagagtgacatattgtttttcttctttctccccctcctatgtcattgtggagaacaatatggcagtgcagacatagcatagagtctgagaacaaagtgcatatcagtcccagctatgtcccttagtagctgcgtgactcactgtaaaataggtcttgatgcccgccctcctcttcctccgcttaattatttttaaaaatacttattgagtgccaaccatgtgccagacattgtgttaggcactgtagctgcaatggcgaataaaacagacatcattcatgcactcctgaaactaaaaatttaatagattatatctgccttctgatcagtaagcctaccatgaggaataaataggcgtggtggatgtaaagtgcccaaaacatatttactgtgttcacaaagtgtgaatttcctttccttttcttcattttggcattataacgttagctgtagatggcatgtacatgcagcatagcatccggggtgtgtacatgcacacacacagacacgcacactcaattctctatagcttcacttattttagtctaagattgttgccattttcatgcacagctattatggtaggtgagtcagccaatcaaaaacagatttgattgatttgctttgagctacttgcctgccaacaaacgacaatggctgtatggatatagtcattgagtcaggtggctttatggatttccattggtgttagacttttaaatttagtttcttgctgcctgttatacacgggaggcaatgacaagctctcaactctctaatttgctgtagtggtgtgctaattaaaacacattcctaatacattccgttttggattcagagccagtgttcttataaaactataacactagtaagaaaaatgcaccatactatcttatgagaaatttcataaatgtgacaccccacaaccttattttatttttcagacattatacaagctatattgcaattttatgtcctattcgattcttctccacaaactgctttgccctgtgtattccaaatttttgtaagtgataccaccagataaatccaaaacctagaaaccagcctagatgtttcattctctgtcacccatctctctagatatgtcctatcccaaagttcccttgagtttgctccataaatgtatccccatccccactgccactacctcagttcatgctccagttatctcaaggttacagcaataacttaacagaattccttacctccaatcaatccctctcctccatctttcctactacctatactacagaataagtcttctgacacacagttgactgtgtcacttttctgtttttcgagtttttcagtcactctccattgtctgtgcagaataaagcccaaactcctgtgcgtgacatacaaaggtcagcctaatttgcccctctccctccagtttcaactctcatcaactgtatttattttctagtaatccaaaatatgtatagctccagaataaggcatttactcattcagtggatatttatgtgccaggtacttgtttagatactgggtatattgctgtgagcaatacagacaaaaggccctttcttcatagactttacattctgtgagagaaacaaactaaatggatacattatttctacaacttttttgtctttacatatgccatttcctctgcctgaagtaattttctcactccccatttctctaaaaattgcctagtcctctttcagaaaatcagcttgcaagtatgacatctaagagagatttcagcctgctttcatcttttctctgtatcttttcagagtttcactatagcttctgctttgctgttgtttctcattatttgcatgtcagaaccctccctcgtggcattctctatttaacaggactatatcttttctactctgtcttcacagtacttggcactgttgtagcacttagtcaggaaacagaaaagatgtttgagtccatgaaagcctggaaggcagggaagaagaaaggaggaagacagaaaaaaggaaataaaaaggagagagggatggggagaagaagggagaaagtgagggagggagaaaagtcaatttagtttcatttctccttggtttggaaaaggtataactagttttgtattatgacccagtaggattgcatagtcaagaaagtgccactaaattttgcaacttatatttccttaaaagtatgggagaaatgaatatttccctttgcggtttggtttattaatcattatcctacaagttaatattaaactaacaaattaaatgaaatctccatcacacacaggtgaattaatctttgccttcatatcttcttgctatgtaataattgtcagaacttgcaagaggtatatttttatgttattttaatcatgttcctgaggggcatcaaggtgaaatagaaagagcagagttaggagatatgaagtcgagtttgggttctgcaacctagtagctggccgaattaggggaagcattttcactgtggggagctttagttttgtcgtctggaaaaggaaggaaccagaatgactgctcactgtactgtttccagtttgcctcttctcattttagtttcctgcttgcaggaaactttacaaacatactaattgagtgatgatcagttatagactgccttagtttccatttcatctcctccacaaggtacagccttgtattctcctgtggctataaataaatcccatcatagccttatattctgtttactgtattttgtcttgacctttaccaagggatagattctgaaggcattatgcagttggatcaaatggcttgtattcaaaattgtggcttgagtctctccacccagatgtcatggatgttgatttccctggtgtcttaatccaccctccccgcaggactttccatcttctttaggcctctttccctttatccactgcctttctttgctgtagcctccttgtccagttttactttacttccctaaggtttctgtaacattggaagacctgccacctgtgacttctgtgtcacaaaacattgttttttcttaatggctctcctttttagaagatgagaaatttacgtttaaattgtgtgcattgagcttagtgtgcaatgattttttgtaagccaagaaaatcaggaagaaccgcaaagggtaagggatggagtcttcaacaaatggtattcgttaattttctgcccattaagggacataatctaattaaattcttatcctacaacatagacaaagtgaattcctgctgtattaaagagttaaatataaaagaaaatgaaatagtaaatatcagaataatgtggaatatttaacaattttggggggcagggagcaattttggggggttgtattagtctgttctcaggctgctataaggacatacccaagactggataatttataaagaaaagaggtttaattgactcacagttccacgtgcctggggagacctcaggaaacttaaaatcatggtggaaggcacctcttcacagggcaacaggagagagaatgatgactgctgagcaaagggggaagccccttataaaaatgtcagatctcatgagaacttggctatcacaagagtagtatgggggaaaccaccccccatgattcagttatctccactttgtccctcccttgacagaagaagattattacaattcaaggtgagatttgggtgggagcacagagccaaaccatatcatttcacccctggccactcccagatctcatgtcctcacatttcaaaacacaatcatgcccttccaacagtcccccagagtcgtaatccattctagcattaaccaaaactccaagtccaaagtcttatctgagacaaggcaagtcctttctgcctatgagcctgtaaaatcaaaagcaagttacttacttccagttacaatgggcatacaggcattgggtaaatacaccccttccaaatgggagaaattggccaaaacaaagggcctacaggctccacacaagttcgaaatccagtggggcagtcaaatcttaaagctctgaaatgatctccttagtctctcatctcacatccaggttatgctgatacaagaggtgggctcctacatccttgggcagctctgtccctgtggctttgcagggtacagccccctgccctggctgctttcacagctggcattgagtgtctgtggcttttccacgtgcacagtacaagctgtctgtggatctaccattctggggtctgaaggacagtagccctcttctcacagctcccctaggcaataccccagtgggaactctgtgggggtggggggaggctccgaccccacatttcccttctgcactgccctagaagagattctccatgagtgggtctgcttctcccagtccactcactcaaatgttaatctcctttagcaacaccctcatggacacacccaggaacaatactttgcatcctttaatccaatgaagttgacactcagtattaacgatcacaggggcatttaaagccaaagcagaaatcacaaagaaaatgactgatagatttgatatatcaaaatgtaaaacaaaaataaaaaccaaagctttcattcatcaaaacatcaaaaataaaaacattttctttaccactccctttcatgggctatagatatcaaagggacttctggattttattcagggccagcatcatgggtgtttggcctgtgtagtcgcacaggccaccacacatggaaggatcctgtgattggttcaatgctctgttgtatccatcttgacattcataattttggaacaagggacatttcatttttttattttgtactgggccccacaaattgtgtagccagtcctgagtctcttgaatcattctggaacctccctgctcatagtgaaatttttaatgacaggcccatttgaatgatgcttggtgaaagaatgcaagaaaccacttgctcaataacattggacttaaatgagaatatagacgggcacctggatgttcattaccttgtcagtgtaccagataccctgatatccattcacttattccttcattaatttagcaaacatttttcaagtccatcctttgtgtcaagcactgtgctaagcattggggatacagtggtgcacaagatggattcagtcagtgctctaaaggaggcaaggttgtaggtgaatagatggcaataccacatgatagaaagtgtaggagcccagagcaggggcccctaacacagcctgagagatgagtaagggagttgacatctaaacgaactgaaggggtaaaggaagtggaggtgagaggcatatcctggggaggccatttaggccaaggaaacagcatgtcctccttttgttctttcatcattctttcatcagcagggcaaggatcttaacctgccctgggaattcatcaggttaagggtcaggtgtgtatggaacagctggctggcctcttctcgggaagtttatgcccattccaagctacctattgtacttgtctcctggaataggtggtgatgtagtttggatgtttgttccctccaaatctcatgttgaaatgtgatcctcagtgttggaggcgaggcctggtgggacatgtttgggccatgggagtggatctctcatgaatggctttgtggtaccccccagccccataaattagtgagttctcactctattagctacctgcaagagctggttgttgaaaggagcctggcacccctcccgtctctctggctccctctcttaccatgtgatacaccagcttcccttcaccttccaccatgagtggaaacttcctgcagtccttgccagaatcagatgctggcactacgcttcttgtacagctgcagaactgtgagccaaataaacctattttctttacaaattacccagctttgggtattcctttatagcagcacaagtcgactaagacagctggaattacatactgtttgatgtctgaaatgtcctatggaagaagaaaggataaatatccactgtgccccttatctctaagacacctgatcaccccctctggatattttaaaaatcctagatttcaaatagacttttactctaccaaaatttctgtgatccctggaagacctagccactatttttagcttgcaggacatagaaaaatagtggggggtcagatttgtaccataagccattgtttgctgatttctgatttagaattaagttgcctcaggccacagatcctttatttgcattggctttccctctgcttggaaaactctccctcaacctgtttctgttgtaggcctcttctctcagtgaatccttctttctctacagacttgcctaaactgatttttctgctgctgtatgtctctgtagtatccttgggactttcttatcaactcctacattgtttgcttaatgtttaagtctctttatacactgaagacttaatggaagaaaaatttacagttgcctattatttgaacagttcaagtcagtctcctagcccactgcctggctgagtgtagctgctcaacaagtatttgttaagtgtacatatgagtgcagtattactgtccccatttttcagatgatgaaactgaggcatagctagctgattgggaccacactaaaagctattagatagtagaatagaaataattttccagttaactacactgcttttttaaacattcaaataggatgcttagaaataggacaaagaagacaaattaaataggactttcagtaagcaaaacactaaccatgaagattatattttgctactcagtaggctgaggcggaagtacttcttgagcccaggaattcaagactagcctgggcaacatagtgagactgtctaaaaccgaaaaagattgtgtttggtttatgttctccttgctctcatggcatatgcaatataataggggaggtcagataactgcatagcaaataagtctgacagcccaagttagtaggtggcaagtaccaagaaggtttatgtggggcatgtgttgctgtggcaaggtggggtcaaagagaaagtcagaggcaagtcctaagccaagccaggggagtcacataggccacatcccttcaggattcacttctgtggacattggctagtcaatgcaaagcaaacagtaacctctagagcaggtgtgaagggacactcatgaactttttcccaggtgatatgttcctcaaactgctgcaactgcagaatgctgagagctgtccacctgtgggaatggtcagagggtcttgccaggagtggcgttctaacagatgctcaagaagttagataagggtttttctgactcatgagaaaagactctaggaacctgaaagagtttaattttcctaccagtgggtgatttgggacagtctcctaatccatcagcaagtgtttcttgaggtccttactatgtaccaagaaagtcaaatggggattctatttctgatggctgcacttttttttttcttttttgttttttattatactttaagttcttgggtacatgtgcacaacgtgcaggtttgttacgtatgtatacatgtgccatgttggtgtgctgcacccattaactcatcatttacactaggtatttctcctaatgctatccctccccgtcccacaaccccatcacaggccccggtgtgtgatgttccccaccctgtgtccaagtgttctcattgttcaattcccacctatgagtgaaaacatggcggtgtttggttttctgtccttgagatagtttgctcagaatgatggtttccagcttcatccatgtccctacaaatgacatgaactcatccgtttttatggctgcatagtattccttggtgtatatgtgccacattttcttaatccagtctatcattgttggacatttggcttggttccaagtctttgctattgtgaatagtgctgcagtaaacatatgtgtgcatgtgtctttatgatagcatgatttataatcctttggatatatacccagtaatgggatggctgggtcaaatggtgtttctagttctagatccttgaggaatcgccacactgattcccacaatggttgaaccagtttacagttccaccaacagtgtaaaagtgttcctatttctccacatcctctccagcacctgttgtttcctgactttttaatgatcaccattctaactggtgtaagctggtatctcactgtagttttgatttgcatttctctgaggaccagtgatgatgagcattttttcatgtgtctgttggctgcataaatgtcttcttttgagaagagtctgttcatatccttcgcccactttttgatggggttgtttgttttattcttgtaaatttgtttaagttctttgtagattctgcatattaaccctttttcaaatgggtagattgcaaacattttctcccattctgttggttgcctattcactctgatggtagtttcttttgctgtgcagaagctctttagtttaattagatcccatttgtcaattttggcttgtgttgccattgcttttggtgttttagacatgaagtccttgcccatgcctatgtcctgaatggtaatgcctaggttttcttctagggtttttatggtttttaggtctgacatttaagtctttaatccatcttgaattaatttttgtataaggtgtaaggaagggatccagtttcagctttctacctgtggctagccagttttcccagaaccatttattaaatagggaatcatttccccatttcttgtttttgtcaggtttttcaaggatcagatgtttgtagacgtgtggtattatttctgagggctctgttctgttccattggtctatatctctgttttggtaccagtaccatgctgttttgcttactgtagccttgtagtatatggcagggcatagctgaacaaaaggcggcagaaacttctgcagactttaacgtccctgtctgacagctttgaagagagcagtggttctccaagcacagagtttgagatcagagaagagacagactgcctcctcaagtgggtccttgacccccgagtagcctaactgagagacacctcccagtaggtgcccctcagagacaaagctaccagaggaaggatcgtgttctgcagtatttgctgttctgcagcctccgctggtgatacctaggcaaacagggtctggagtggacctccagcaaactccaacagacctacagctgagggtcctgactgttagaaggaaaactaacaaacagaaaggaatagcattaacatcaacaaaaagtacatccacaccaaaaccccatctgtaggtcaccatcatcaaagaccaaaggtagataaaaccacagagatggggagaaaccagagcagaaaagctgaaaattctaaaaaccgagcacctcttctcatccaaaggattgcagctcctcaccagcaatggaacagagctgcacggagaatgaccttgacgagttgacagaagtaggcttcagaagatcggtaataacaaacttctccgagctaaaggaggatgttcgaactcatcgccaggaagctaaaaaccttgaaaaaaggttagacaaatggctaactagaataaacagcatagagaagaccttaaatgacctgatggagttgaaaactatggcacgagaactatttgatgcatgcacaagcttcagtagctgattcgattaagtggaagaaagggtatcagtgattgaagatcaaatgaatgaaatgaagtgagaagagaagtttagagaaaaaagagtaaaacgaaacaaacaaagcctccaagaaatatgggactatcgaaaataccaaatctacgtttgattggtgtacctgaaagtgacggggagaatggaacgaagttggaaaacactcttcaggatattatccaagagaacttccccaacctagcaaggcaggccaacattcaaattcaggaaatacaaagatactcttcaagaagagcaaccccaagacacataactgtcagcttcaccaaggttgaaatgaaggaaaaaatgttaagggcagccagagagaaaggttgggttacccacaaagggaagcccatcagactaacagcgggtctctcagcagaaactctcaagacagaagagagtgggggccaatattcaacattcttaaagaaaagaattttcaacccagaatttcatatccagccaaactaagtttcataagtgatggagaaataaaatcctttacagacaagcaaatgctgagagattttgtcaccaccaggcctgccttacaagagctcctgaaggaagcactaaacatggaaaggaacaaccagtaccagccactgcaaaaacatgccgaattgtaaagaccattgaagctaggaagaaactgcatcaactaacgagcaaaataagcagctaacatcaaaatgacaggatcaaattcacacataacaatattaaccttaaatgtaaatgggctaaatgccccaattaaaagacacagactggcaaattggataaagaatcaagactcatcagtgtgctgtattcaggagacccatttcatgtgcagagacacacataggctcaaaataaaaggatggaggaagatctaccaagcaaatggaaaacaaaaaaaagcaggggttgcaattctagtctctgataaaacagactttaaaccaacaaagatcaaaagagacaaagaaggccattacataatagtaaagggatcaattcaacaagaagagctaactatcctaaatatatatgcacccaatataggagcacccagattcataaagcaagtccttagagacttacaaagagacttagactcccacacaataataatgggagactttaacaccccactgtcaacattagacacatcacagagacagaagattaacaagaatatccaggacgtgaactcagctctgcaccaaccagacctaatagacagctatagaactctccaccccaaatcaacagaatatacattgttctcagcaccacatcacatttattccaaaattgaccacatagttagaagtaaagcactcctcagcaaatgtaaaagaacacaaataataacaaactgtctctcagatcctagtgcaatcaaattagaactcagaattaagaaactcactcaaaaccgcacaactacgtggaatctgaacaacctgctcctgaatgactcctgggtacataacgaaatgaaggcagaaataaagatgtgcttcgaaccagtgagaacaaggacacaacatgccagaatctctgggacacatttaaaacagtgtgtagagggaaatttagagcactaaatgcccacaagagaaagcaggaaagatctaaaatcgacaccctaacatcacaattaaaagagctagagaagcaagagcaaacacatttaaaagctagcagaaggcaagaaattactaagatcagagcagaactgaaggagatagagacacaaaaatcctttcaaaaaatcagtgaatccaggagctgggtttttgaaaagatcaacaaaacggatagatcactagcaagactaataaagaggaaaagagagaagaatcaaatagtcgcaataaaaaatgataaaggggatatcaccaccgatcccacagaaatacaaactaccatcagagaatactataaacacctctacacaaataaactagaaaatctagaagaaatggataaattcctggacacatacaccctcccaagactaaaccaggaagaagttgaatccttgaatagaccaataacaggctctgaaattgaggcactaattaatagcctaccaactaaaaaaagtccaggaccagacggattcacagctgaattctaccagaggtacatggaggagctgataccattccttctgaaactattccaatcaatagaaaaagaaggaatcctccctaactctttttatgaggccagcataatcctgataccaaagcctggcagagacacaacaaagagaatttaaaccaatatccctgatgaacatcgatgcaaaaatcctcaataaaatcctggcaaactgaatccagcagcacatcaaaaagctcatccaccacaatcaagttggcttcatccctgggatgcaaggctggttcaacatacccaaatcaataaacgtagtccatcatataaacagaaccaaagacaaaaaccacatgattatctcaatcgatgcagaaaaggcctttgacaaaattcaacagcccttcctgctaaaaactctcaataaactaggtatcaatgggacgtatctcaaaataataagagctatttatgacaaacccacagccaatatcatactgaatgggcaaaaactggaagcattccctttgaaaactggcacaaggcagggaggccttctctcaccactcctattcaacatagtgttggaagttctggccagggcaatcaggcaggagaaagaaataaagcatattcagttaggaaaagaggaagtcaaattgtccctgtttgcagatgacatgattggatatttagaaaaccccatcgtctcagcacaaaatctccttaagctgataagcaacttcagcaaagtctcagaatacaaaatcaatgtgcaaacatcacaagcattcttatacacacacaagcattcttataacagacagagagccaaatcatgagtgaactcctattcacaattgcttcaaagagaataaaatacctaggaatcctatttacaagggatgtgaaggacctcttcaaggagaactacaaacccctgctcaatgaaataaaagaagacacaaacaaatggaagaacattccatgctcatggataggaagaatcaatatcgtgaaaatggccatactgcccaaggtaatttatagattcaatgccatccccatcaagctaccaatgactttcttcacagaattggaaaaaactaaagttcgtatggaaccaaaaaagagcctgcattgccaagacaatcctaagccaaaagaacaaagctggaggcatcacgctacctggcttctgatgtctgaacttttaactcccatctgctttcttcatcttgatttgcacatatgtctgatttggagatgaaaagtaaatatattcctgtgtctcttcattcttcatccatcttttcacaaaatgcacccagcagctgtgccaagcttctctgaataccatgaaatcatttatatgttttgatactgtgtcatggatatattaattgtttcttctcactacaacatggtctaattagcttggacaatacttccagtctcctgtttgaagagactgtgtgtggcttttgatgatttctctaattctgatttgataggttagatgtgggctgatctttctctcgctcttttttccttttcctttcttctcttctttccccgtaggcatatactaatgtcctaacgtgtactgaatcttgattacagtgtaattgatttagagcatatggggacttttgaaatcccttttaggagggatcattgactcttgataatctgacgaaagctatgaacacttcttccagaaatgtgtacttttacatatataatttatcatccagttacaggagtctcaagggtttagccaagtcttggatgcatgtccatagtatgtgaagaccacagaatttcagtgcttggacaaccctacagatcatcgaattcactggtttttgaaaactattttaaccagagaatccctggttgaaaagggtgggtaaaaagaagggagagactgagtcatgcacacccctacgtcgctcagagtggttcctgaggaggttctgaggaacacagtttgaaagctcatgatctaggtctaattcctgtatttctttatatgagaaaattgatccaaaaagagcagagttgactaactcaaggccatgcatccagtcagtgcacagctgagactggaacccatgcccttgatccctaggacagagtctcagccaaccctcacttctcttctaattgtaaacctcctacattcataccacagtaacttctcaaagatcctggacaaatgtaatttaaacccacaattataaataatcacccccatttgagcaacaggcaaaggaaatacagctgatttgtgttttgtcactccgtcaaggccttccttctttctgtcttatttctgctggttctcgtgtctttgtgaactgtttccattttacaacatgtattttattcaaatatacatcatagtcaaaagcatcctctttttcctcgacaaagtgccatcctgttggcctcccacagacacactctctgcccctaattcttaaagaagcagtatctggtgctcgccctggtatggtgcttgtttggcttcaggccactggcaaaacgacctaagctattattgggcttgtctccatcccagtcttccaaccttctttgtaattgtcaagaaacccaactgagcctcagctgaagtatctacctgttattgacctgactatgggcgagccaagcctagtctttcctggtctctctttcttgtgtattggtgcaggatgaggacattgcttcagagtaccaaagtggagaggaagaaacaaaccaacaaactcaagaaagtagaaaggcagtgcacagacccctttcttagggttagaggcaaggtggtctttagacttcctgagttgaagactgatgtttctttgggtggaatttctctgtgctacctcagaaacaaagatagttcatctgacaaaccagagacctacttagagataacttcagcctatccagggaactaaaaactaattaaaaattgccaggccagagtttcaaaccaggagagtggtgtggtgttgtggttaagagcacacactttgtatcctgtcggacatgaatttgaatcatggctctgccacttactacctgtgtaaccttggtcgagttaacttattcttgttgggcctccatgctttcatcaatcaaattggagaaaataatacccacattaggagagtcttttgaggactaaaagagagactaccaaacgtttgctattttgcctatcttcatcaggaccccacagaagactctgtattctgaatgttgtattcaccaccaattatctgtatccctgttgaacggagggaacacaggaaacatggcagggaatgggttaaggagcattggtttagccgataactgttgtgtgaaacatgatttagttccctcccgtctctatggactaattttccccactaggcaatgaagagtttgtgcttgagcacgtgttctttatgctgactcaggacctgagtgtgtcaaaattatcttaaaagttattttttaagtgtagatgtgcagttgcaattcccagacagtctgattgaggagatctaggggatagtcacaggatctatactatatgtccagtcgcccaggtgattctgatcagcagtcaagtgtgggaaccactgatgcagggagttgtaaagattctccctttcctccctgctttcagtcttggaacttcttatagtttgaaagtgtctttccattaatgaggcctatgacttcctacatcattcaaacatggtgattttcacacagagaaaataagaaaacgttgctagtggtcctcaaagacggtatttttccccacagaaaattcattttgttttgctttagtggcttgatatcagatccacaaggcatgtaatacagaatagggtgaacgttgagggatctgcttttaattagtttccccagctgatctctcagatcattttaaaaaatgcattctctctattttatgattgaattctaagtaatgaagtttagcaatatatgtaataaagtagaattatctcacaatagatcacaataatagatactgagtaacttctcagtgtcagttgctacctatatttccataatccttatgacaatatttgaaacaggcattaatattttccctaattttaaaacaaagaagataaaacttaaagagataaagtgacttacctaaggccacacaactggtaagggatttttttagtgttgaacagggatgaaaatggtatttaaaaaatgcaacttgaatcactttctgtcttaaaaattttcagtgacttattcattatgcttaaaaaattatctaaacaactttgtgtgggcagtaatacttgtccgttttggtcagtgctgtatcctcagcaataagaacagcgtttgtcatacaacagagactcagtaaataaatattcatggaataaattaagtgatgaagcctggattcaacccaagtctgtttgattttaaagcttgctcttcagtaatttgtatgctctctcctctctctctctctctctctctctctcgttaaatttacatactatgaaatgcaccaatatttggtgtaaaattttatgaactttgacaaatgtttataactgtataacacacatcacatccctaacaagataaagatatttccttcatcctagaaagtttctctttgtttctttaagtcaactgcctcaccctttccagagacaaaggcttttctatgtttatttattttttttttaccacatgttggttagttttgtcttttttagaatttcatataagtggaattatatactatgaactcctttgtatctagctgtttttcattcagatggtgatttaagatctgtccatagtgttatgtgtatcagtggtttctttttattgctaagtagtgttgcaatgtatgaatatatcataatttgcttatcattctactgttgatgggcatgtgaattgttttcagtttttggctattatatataaagttgccgtggttgtttgttttcaggtatttttgcagacagatgttttctttttttattattattatactttaagttttagggtacatgtgcacaacgtgcaggattgttacatatgtatacatgtgccagtggtatgctgcacccatcaactcgtcatttaacattaggtatatctcctaatgctatccctcccccctccacccaccccaccacaggccccggggtgtgatgttccctgccctgtgtccaagtgttctcattgttcaattcccacctatgggtcagaacaggcggtgtttggttttctgtccttgcgatagtttgctcagaatgatgatttccagcttcatccatgtccctgcacaggacatgaactcatccctttttatggctgcatagtattccatggtgtctatgtgccacattttcttaatccagtctatcattgttggacatttgggttggttccaagtctttgctattgtgaatagtgccgcaataaacatacgtgtgcatgtgtctttatagcagcatgatttataatcctttgggtatataccccgtaatgggattgctgagtcaaatggtatttctagttctagatccctgaggaatcaccacaatgacttccacaatggttgaactagttgacagtcccaccaatagtgtaaaagtgttcctatttctccacgtcctctccagcacctgttgtttcctgactttttaatgatcaccattctaactggtgtgaggtggtatctcattgtggttttgatttgcatttctctgatggccagtgatgatgagcattttttcatgtgtcttttggctgcataaatgtcttcttttgagaagtgtctgttcatatccttcgcccacttgttgatggggttgtttgtttttttcttgtaaatttgtttatgttcaatgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttgtgttgccattgcttttggtgttttagacatgaagtccttgcccatgcctatgtcctgaatggtattgcctaggttttcttctagagtttttatagtttcaggtctaacatttaagtctttaatccatcttgaattaatttttgtataaggtgtaaggaagggatccagtttcagctttctatatatgctagccagttttcccagcaccatttattaaatagggaatcatttccccatttcttgtttttgtcaggtttgtcaaagatcagatggttgtagatatgtggcattatttctgagggctctgttctgctccgttggtgtatatctctgttttggtaccagtaccatgctgttttggttgctgtagccctgtagtatagtttgaagtcaggtagcatgatgcctctagctttgttcttttggcttaggattgacttggcaatgcgggctcttttttggttccatatggactttaaagtagttttttccaattctgtgaagaaagtcattggtagcttgatgggggttgcattgaatctataaattaccttgggcagtatggccattttcacaatattgattcttcctacctatgagcatggaatgttcttccatttgtttgtatcctcttttatttcattgagcagtggtttgtcatttctcttgtttatttacctagatgtggatttcctgggtgataatggaaaaagtatgtttaccatttcaaggaactacaaagcatatttctaaacaggctatacctaacagggtactagcaatatatgagagttgtgtatgcaccacatctttgccagccttgatatatgtagttttttaaattttagccattctagcgggtatgttgctgtattattgtggttttaatgtgtatttcctgatatttccatggtaagtattgtttcatgtcctattggccactcatatatcttgctttgtgaagcatctgttcaagtcttttacctattttttaaattgggttgtttgtattcttattgtatcataggagttatgaatataagttctttgtctggtatattttttttgaatattttttcctgactgtggcttacttaatctttttctgttcttttgatgtacagaatatttcaattttgatgatgcctaatttatcaatgttttattgtttatactatatcctgtctaagaaatatttgccaactccaaggtcatgaagatattcttctttgttttcttcgagagcctacattttaacgactacagcatgcatctggctttgccttacttgttatagaggatgcattagtccatgagataattgttatcagagtaagctgatgggaggcggagtactatagaattcaacaagacagctttgaagttcaacagatctttgttcaatttctgactccagtcccagcagcgtgaccttaggcaagtcacttgatctttctgtgtatcaattctctcatttgtgtaaaggagataataacaccaacttatgtcacaggatcattattaaataagcaagtatatgatcacttcttaacacagggcatagcacatagtaagccctcaacgagtggtgtctgttgtacttacaatacttttcattcatattataccagtttcaccaagagtttttagtgccagaagcaaatataggaagggttaccttttcttcccctactagacttcaaacagaaccattgaaatagagatgacccattaagaaggggtaggctatagttacaaacagttctttctgtatgtctaaaatcgcatctttattattttgagtaatactaataactgaatctccaagcacagacatgacagatatgattataaaactccctggcataaaggacaattttatcattgaaaactgaaattatatgaaggaatacatgtaatgcttttccagaaacacaatgtgctcattaaatgtgggtaaatgcagatgttgaagaggtttttaagtcagtgtacagtgaaaagagcagggactttgacataaaacaaacatagaacttgaatacaaggacatatgacttgattgctgtgaggctcactcctatcatctatcgaaagaggtttacataaatattggagaatatgagtgcttcaaagaatatgaacgcactagctaacatcataggcactcaaaatggtacttattggttaacctcatatttgtaatgacatatatgtaatagtaaactaaagtgagatatccaatttcaaatgagttacatccttaaaaaggtgaaagatagttttgtgggtttattttttgatagatttctcttctgtgttcaggaatggtactcacagaatatatctgtttgatatgtgaggtcattttgcagctcactcattgattcaatgcatttctgaatcatagaggaggatccctggctatttgtcatgtctgaatgatggaaacacatatttgaatgattctagtaatagagaagaatgtggaacttgctccatacatttccatttttaacatccttctgttgtaggggatggggagggagaggattgtgtatgtaagttgttttctgctaatgctaccactgctgttttcagagtcaatacatggacagaagcacaaaaaactgagtattccttttgccttatgcatcaaagtctctaaccaagtgtttagaactacatctactggtgttctcccaatgcaaattattctaggccctttgtgctctggtctcaacctgattatatacccttacctcttttcttgccacagcaaaccatttactatttttcaaataattccaatgttttactgtttctgcctctttattcatgctgttccatttattctgttatcttgagaagcctttcctcccatatctgtctgctaaacatatatccatctttactgagttgaagtgattccccctaaattcacatccgcttggaacaccagcatgtgatcttatttggaaatagggtctttgcagatgtaattagttaacatgagaacatactgtattagaatgggctgtaatccaatgactggattatataagacttataagaagtcacgtgaaataacagagacacgggcacacaggtgagaaggccatgtagtgatggaggcagagattgaagtgatgcagcaacaagccaagaacaccaaggattgttggcaaccaccagaagctaagaagaggcaaggaaggattcttctctagagccttcagaggaagaatggccaaaacaacagcttgattttaaatgtctagcctactgtactgtaagagaacaaatttctgttgttttatgttacccagtttctggtaatttgttatggcagccttaggaatgttttttacatccttcttcaaggtcaagctcaaatataatgtcttttccagatttcttcaactagatgtaatttctcttcttcacctctgtagcaatgctgtagcagaaaaaaagatcacaaactttggtgccagagaatttttggctgtaatcctggcccagctactgactggatttcttcacctgtacaatggaaataataatacctacctaatagagttgttgtgtcaataaatatgactgttccttacctctctaattcacccattctgcctcagattgcaataattttgtaataagacaatatagttctgtttttttccagttcagaggctggagggagcatagataggtaagcaatcagctttgtacacaataaaacaaaatgtgctatctaacaagggtagagacaagtattgttcacattgacagtctcaggaattcagttgtctacactaggagttccaactataagctaggaaactgatttataaaattgaaatggagaagcctccttttagtccctgaattccagaattgtaatatccaaggtagattttgtcttaatgcctaaaaatggagcaaaaattctggaaatgttagagccctctactgatttcacagctcctgtatatgacactggaacatgcttatacttggctgcacattttgataaagccaaaagttcaccacatggcattctggtctctcttcctctagggcatcttcccaaaggcctcagctctagaggaaatctgttttttcactcttgcagcctacactgcctggccaaaagtagggatttagcatgtgctctttatccttcctgagttttctttgtctgaatccccaggctctatgcccaccaatctttttaaaaaaggtcaacaagtaacatcatccccttatgttcatcatcttcttttccaggcatatcatcagaatcatctgagaccctttttatcaaagcatactggagggtttataggtgttgacctctaccctggataacgtggggaaggtagtaagcacaacacacctgccccttctgtgtgggtaagcccttgtattagtttgcatgggctgacataacaaaaatacaacagactggatggctgaaacaacagaaatatattacctcacagttcttgatgctagaaatctgagatcaagttgttggcagagttggcttctttttgaggcccctttccttggcttgtagatggccggcttgacttcttcctttgtcttcacatggtctttcctctgtgcacatatttatctgtttccaaatttcttcttttaaggacaggagtgagaatggattagggccccacccacatatggcctcattttactgaaattactgtaatttaaaggcctatctccaaatacagtcaccctccgaggtactggggtttagaacttgaacataagaactttgggtagtgacagttcagccccgtagttttgtgattaggatcaaattattttgcaatcacttggtgatggatttgtttgttatttggtcttgggctctgatagctgagacgttagcctcgtagtatacacagagaaattaactcaagcacaattcacaggtcttcctcatgacaggagaggcaaaagaatcatggaagtcaccacttggtaaacacctaccatgtgacaggcatggtaataggattttttattttttcttcacaatcagttagcaaaaataaatatttacacccccattttcatatgagaaaattaagattcagaggggctaaagtgatttgctcaaaggcataaaactagtaagtattggagttaagaattgaatataaatctgtctgactataaattcatgccctttcctcatgcatcctttatctggaattgaaaaaaaagtttttttttgctcattttaagctgtgacattaaaatgaaaaaacaattatatgaaagagtttctagatgttcacagtcatcgtttattcatatgtccatttatcatatactcatactggactagcattgcttcactttgtttttgagcttgccatggaaacttaaacaactgaagaatcaggaaatgatgacagcaaagtgattaattatacattgaaaaaacaatttgggggatgatggtgcagagagcccttttagccacactggcgtaatgaagtagtttagatttgtcctgtggcctctgcaatcgacctcttgtttgttttgttacaacaaattgctttacagtactgaaatggtctatttatgttcattgtttcttttgcagttttgttcccaaactttggaagttgttggagactgacagaagagccaggaacatcccagttttctgaacattttctatgattgtgacacattttaggatgctctttctacctagtgaatggtgcagtttgtaaggatagattatttgctgagaaagtgggtattgggtcctgtgacagaggaaatatatttcagagtattggagggccatttaaaaatgatgatggtgttgataatagcaatgcttcctgctgttgcatcatttagagtttacatggatcttctatatctcacttgattttcacaaaaacatattgaagtgatcagtcagggattgttatatccactttccatatgcaataattgagattcaaagaggttaaatggaggcaggacaaactcccacatctttgatcaccaacaactcccttgctaaattattctttgtaagtccagtacactgagttcattcactttaaattggtgcacattttgtcctcctggaaaaacattatgtcgaattgggaccattaataattgcttactagtttcaaatgtccagtgggatgtcaattgagatccagcggctcttttctccccagcctctttaagagaacacacagtgaattcaatgcgcagtgctttcctcctgctgcttgtacttcctaacaaagagcccccatttattggaaatcaatcatgtgctagatactggctatgtgttatttctaattgtcacaattgataactctgcaagagaggtattatcatacctaccttacaaatagggaaactgaggcttggagctgttaggtaactttcttaacatcacagagatggtgagtggcagagccagaacttcagcttatccagtctggcttcagaccattgctttaaaccaccataactctttaaattcagtacattgactttttaactgagttatttggaagttacagcttggaggaatccattccttaggaaataggttgacaaaaaaaatcataaagttaaaaaaatgcaaaaaactaaaaaaactaaattgttaatttatctatatcatctaatttggtaatagttttctacagttgattggaaagcttgtggtataagacaagcttctctgagggtaacctacagtcactgtaagtgcacagaggatgccttctttgctcatttctaatacaaaactatttctgttctcctatgtctctaatccactgaatcgtttttccatgtacctattctttttagttcatgcatagtcacttaattgaacacatactcaccaagataattaacaattattggctacttccctgacaaagggttaattcgttctgttggcaacccctgttaatactaaaaagccctggggcagtagatcctttcttctaggaatgacccccccactgttcattggagcaggcaggagtgccgaactaaccagtcctgctatctgtttcatctgtcgagtagacatttgactacctttttttgttgctgcctgtgactcaccctcattactcaagattgtggaggacagcaactgtgcttgaggagtagaggagcagtcctaagataaatcatcttaatgatttcccatgcgtttaggacttagaactttgcaccacaaggggataaatgcatgtcgcacgtagtcttcatagcaatgaagaataccattttggtttataaagatgtaggaaacaaaaattcaagccctccattatactacatgtctatcatgggatcctgcagattctaattatagtatctaccttttactaggctgctccttgtagttgcactttgacctcctcctagtgtagactgcttttatatgctcgacacctcacctcactccttctaccaccaagaagaacagagtccttagagcaatggtgaccaacagcttttgtggaaggtcaaactggtaaaaagaaaactgtatgagacaaatagtggacactcaatacataagtttagagagaaggaaggaaggatgggtagcttattattcaaattttatatcatcttttttctaaatagaaaaataccagtgagagaattgccacttctgtttagcaactaaaaaaaatttaatatctagtcatatttgagaaatggcaatacagaacctgctttttaatctttcagcctgaaattagcctgcctggttgtaagatgcatcctatgatctattggctgctcaagagtgctttagaggattttcgaacttgaggggcccttagaaatgatctagtctagtgattccaaaagttttcattatctaaggcatctttaattaattttcccctgcatactgtgttttgaaatatcaggcctactaaacaaattacctttatcacataataattccttctctcattttttttttctttttttttgctcagagccattaatgatctctcagtagagaatctggtcagcatgaaataaccagtgtaaccacaataagatgatataattccttcccaaagtgaaggcagtagatggttgagttggtctagggtcagcttgatcttagcaatctttacaaaccatctcccttaggcttattgaaatgttaaaaatagctcatggattcccatgatgaccttcttataatctttgtggacagccatttatcttatccttctgtagggaagaatggaggggaatcagatttaaaaagcaaagtgattggcccaaggtcacacagcaccttaatggcaaggaggaccagaatttgtgtttcctgagtctcaatcttctttctctacacacccaattttcatgtgccttaggtctaagagcttaatattgtataggcattccataaatctttgctcgatgagttggtagaacaggggcactaatacttaagtataggagatacaaaaaaaatccatgatgaattcattaaacaaccagtaaaatagtacaaatatccagttcccagttctgaattcgtacccagcctcctttgctttccttttcatgaatgatttcagacatctccctatagcgtatttcagctgctgttgctcttgaaaaggtttactcaggaagtcaaatagtgtccacttatcctgttataccctgtctccgagaggtgaaaatagcatggaattattctcagcagtgaaattcaccctcctcttttgctttcatcccctttacagtggtgatccttgctaaaatgatgagaatttgaatacctctactccaggatagttcattctcagtccttctagatgaagatccacttagctattcaatttttcttcctttctattactgttcaaatgtcctataattatccatgtggggcacattttagtgaatgacatttagtgaatgacatttttgacagacaggatacctacttccaagtaggtcagatattagagcttcagcagtgcatgctttatgtgattttcataggaattcatatttgggagctcctagctagctcatattctctcagtgaaatgttgaaatatgggctcaattgcagggctttagttgccgtgtactgtcctacatgcagggtgcacttcacatcaaccagaatgagttctgcatagcctgcaagactaaatgttgagttactacacattggacactggatctcacaaggggcctctgcaaaccctcatcacagaccatgggcagtgggagtgagccagtgatattctcaggcacagccctggggcccacccactgtgatgcccaggagaggaacagattgcccagtccctgatcaacagtccccttccatatttcccatggtacaaaaaagtatatatatatgcacagtatttcattctgatgaagagtttatagtcaatgtgagacaacaggtgggtttttggggggattttagtggagttgatataaattacatgagcaaagtagaatcttggatagtctaatgctttcagaaactatttgtcaggcccaaataaaatttttcggtcttgtaaatggcctagagcaatctctaagatgagaagttatgtgttaaatggcaaaacaaacaaacaaacaaaaaaaacaacaagatacttgaagaacacagtatacaaggagtcggcataatgagaatttccccagttgtatttttcttgtaatattgacgttgtttttccccctgttgtgaactaaagagatagaaaatacctttgtgtctagttgaaaatggattcttaattaactgtccagagatttgttgttagaggtaaaattctgggaagggttctttgtatggacaggaagaattagctctgtagcaagcataaaaagggcccatttcttcctaatggcttttccaaggaagtggggaaggagagaaaaaccgaaaaggacattctcttattgctcaaatgaccagatttcttggacccagaactgtagctcatacacagctaacctagggtcaaggtttgtaggctgcctctaaggcatccctttctttgccaaattgttatgcagatgtgatgtgttaaaaacacactccagccctggttgtttggagggcatctttcctaatggaggtgatacaatgtgcttattgagtcagcaggcactttgttccagagtagacagtaatgcaggagtaggaacataagatatggaggctaagttctgtcatttattatgtatatgacctggggcaaatggttcaccctcagcctctgtttgcttacctaagacatggggagaataataataccaacttccaaggcttgttgtatggatcaaatgagataatccatggaaaacccatctccccatgcgagacatatccttacatagtggctcaataaaagatagatgagcacgacagcattttgtaggacaaggaaaggctgggactatagactctgtttatttgaaaataatgccaatgagaggtctttttctcttgggccagtaagtctcactcagggaagaattctgacacaagtacatagactgcacatttaagctctatctggtgctcttccagattatggccttggttttgaggaactccaggaataaggggacttgatcatagacacactagtggagagggagcatcaggtgcctgtagatcagcagaaatgctacttttttttcagaggaatgagatgccatacatacaacctaatctggcttcaaatttcagaagcagggactttccacttaaatatcatcccatgaggtttgaggactttctttctgtgtaagactgaggattttgaaaggaatagccttgaatctgcaaattgcttagaacagtgtggccattttaataatattgattcttcctatccatgagcatggaatgttttccatttgtttgtgtcatctctgatttcttttagcagtgttttgtaattctggtagaaatctttcacctccctggctagctgcattcctgggtattttgttctttttgtggcaattgtgaatgagattgcattggctctcagcttggacatcgttggtgtataggaatgctactgatttttgtgcattgattttgcatcctgaaagtttgctaaagttgtttatcagatcaaggtgcttttaggcagaaactgtggggttttataggtatagaatcatattgtctgcaaacaggaatagtctgacttcctctcttcctatttggatgtcttttatttctttctcttccctgattgctctggccggaacttctagtactatgttgaataggagtggtgagagagtgcatcctttcttgtctggttttcaagaggaatgcttccagcttttgcccattcagtgggatgtgggctgtgggtttgtcatagatggttctcattatttggaggtatgttccttcaatgcctagtttattgagggtttttaacatgaagagatgttaaattttattgaaggccttctctgcatgcgttgagataaaacaatgacattattcacaattacaactcctttaaaattcataggaaatcaaaaaagtgcccaaatagtcatggcaatcctgagcaaaaaggacaaagctggaggcatgacgttacccgactttatactacaaggctacagtaagcaaaccaacatgatactggtacaaaaacagacacatagaccaatggaacagaatagagggcccagaaataataccacaaagctataatcatctgatcttcaacaaagccaacaaaaacaagcaataaggaaaggactccctgttcaataaatggtgctgggataactggctagccacagggagaagattgaaacttgaccccttccttacaccatatacaaaaatcatctcaagatggattaaagacttaaatgtaaaacctaaaactataaaaaccctggaggaaaacctaggaaataccattcaggacatagacacaggcaaagatttcatgacgaacaccccaaaagcaattgcaacaaaaacaaaaactgacaaatgagacatcattaaactaaagagcttctgcacagcaaaagaaactatcaacaaagtaaacagacaatcaacagagtgggagaaattatttgcaaactatgcatctgacaaaggtttaatatccagaatctataagtaacttaaacaaatttacaagaaaaacaaaatgaccccattagaaactaggcagaggacatgaacagttttgaaaaggacacttttcaaaagaagacataaatgtggccaataaggatataaaaaaaagctcaccatcactaatcattagagaaatgcaaatcaaaaccacaataacgtagcatctcacactagtaagaatggccattattaaaaagtaaaaaaataacagatcctggtgaggttgcagagaaaagggaatgcttatacaattctggtaggagtgtaaattagttcagctgttgtggaaagcagtatggcgatgtctcaaagaacttaaaacagaattaccatttgacccagcaattccattgttgggtatatacccaaaagaatataatttgttttaccataaagacacacgcatgtgtatgtttattgcatcagtattcacaagagcaaagacatggaatcaacctaaatgcccatcagtggtagactggataaagaaaatgtggtagatatacaccacagaatactatgtagtcataaaaaagaatgaggtcatgttctttgcagcaacatggatgaagctagagaccattatccttagcagactaatgcaggaacagaaaaataataacgtatgttctcacttataagtgggagctaaacaatgagagcacatggacacagacaggggaataacagtcaccggagcctacctgagggtgggggttgggaggagggagaggataaaaaaatacctatcaggtacttgcttattacctggatgactaaataatttgtacaccaaaccctcccgacacacagtttacctgtataatgatcctgcagatgtacactcctaaacctaaaataaaagttaaaataaataaactctaacatatgaaaattaaatttaaaaagctgaggatttgcaattcatggaatatgaagcaatatttgtgttgtcttagttttagcttatgaatacagggagaaatcatttgacttagggcttgttctgggtcagttgatctttggccttgtttccataaataaacccttactagcagctttggcaatgccagcaggaggccagactatgcctggtttcactatgtcctggcactatctcaaccaagagtgaaaatcttgggacaaatcaagtttcagattttgttgttgttgttttaggaaatggctttaaataccaatttctattctccaagtactttaaaagcaaagtaaaattaacattacatttaaagccaaccacctcaacatggcaaatgcctctcaacgcctaatggactctttccttgggctaaatggacaagttccttagcagagcttgtctaacccttgccttgcattgcaccccagtcccgcacaagaagctgagtagaaaaaactgcattgtgctctgcatgagaaacgtacctaagcatctaggtttagggcctagtttgtaattagacagtttcttggaagtacatcaagctcagcctcaaatcagaacatctcttggggagcaatctgtatttagatgtttcatttaaaaattcatcattgaataacaaaatattttgttgcaactcctacttgatgcattccaaattctctctgtcttttaattacaattatgttattaataatggatggaatgggtgggggcatgggtgagactatgccaggggctaagtagcaaacagagggtagcataagcagttaagtcatagttctttggggcggcagaatcccgtgaatcccaggccaagagctcgccactctggcttccttttatatatgcctgttatctacatcctacaactgctctgatttggccaggagaaatgttttttcaagtagtaggcaaggaatgaagttctaaaggtatttggcaggcagactaagtttcccccaaaagctggaagaaggacttactctttgtgtctatactgacagcctctacttttcccattatcttttcatgctatttcagccatccctccattgagactgctcttgtcaagatcaccagtgaactcctgtgtcacccaatcagtcttctcttttcacatccgtttggtctcctagcaccatccatctgttgactgctgttgggtgtggtgtagtccagggcaggaggagaagagggagaaaatgttatcacaaattctattctgaactacactatgtttagtaatatgcctatgttgtcaccctcatcctcatttatgttctccttgttcttcttcctcaatggccactccttctcagtctctttaattggcttcttcccacttaccattctctaaatggtagtttccttaagatttgcctctgggctttcttgccttcatctacatcctgctccagtgagattatctactccccatgctttaatctttatgcagttgacgtctatatttctatctccaatcctaatccttttagccacatgtattgtgctaaatcttctctctaaagcagaatactaaagggcagtcaactgattaatagccttctctttttctttttggccttcgattttttgtttctaaattgttcacctagagttactctttccacaaatattaaaagataatctatactgtgtcagacacagtgctagctgcagtatagactggggattaggaagttacaggtactgggatataggattccatgtgatactagaaaaatgtgtatacattcatgcagtcatacgtacatagctacatacaaatattcattcagcaaatgctaatggagaatgccaatgtactgggtgctatgccacacactagaaataccatgaggacaagggcatagctcctgcttacatgcagctagtggtttagttaaagtcagaaggcaatcaaaaggcagcaggaagtgtcatatagagataatttgggtgcagaaatgagtacagatgagggttcatatctagcctgtgtgtatttctgtgtgtgttattataagttgtattgaaaatattgatatttgctacatccttgccatctcgccccatgatatacacaaaggaacactctctgggtctttcgttctcaacatactgtgtaactctagccctagtgagctgaatttgacttgtaagaccagaagggctcattttgtctaaactcagtctctctgggtttctactaagctctataaaggagggggtagagatggactggagagaaaagaggaaacttcttctcaagaagaaagggggtccgggcctgcttttgtcatactagctatctaagagcaccacttgagagagatggcctggcactgcagggagatattctcacaaacagatataaaagaaaaaagccaaagtcacactcatcctcatttttgtgccacatatgcccagacctttaatcccttttctcaatgaagtataatctttaccctataacattctgaccgctcccctcactgtggccttgcggtccccagtgtggagggatgagggagaatggggaaacattaatgctttccctggagaccacaatatgtaagttttcacagaaattttcccacagaaggtgtgcttccgtagaaaggaatgcataataggtgctcaattagtatttattgaatgagttaatgaattatagagtgagcaggagttagccagaacttattctggtcagccattatgatggatgtttggggtacacaggtgaatgacatcaggtccctgctgtcaaggaactcagctcccagtctgatgcaagaaactgatatgctaacaagtaattaccatttggtgttatacttattataacaatagctaatgcttagtgagcccttactatgtctaggtaatgcttcatgtgcattatctcattttatccttacaattactctacttgatatattttgttattttctactctccagatagtcacaatgaagttaaataattttctcggagtcatccaaagtgcttttgatgttggcttgggtctgggctgaagcttgggggagttttgacagccatcagtaagattactaagggagagctctttttgtggagaaagaagcatccgagggatagaggtttaggaagaagcagtagaacattgtaggctctttggtctgtgggagcacaaccagtgtagactgtggggccttcgccccaagagatgattgagccttatcaagaattttgagataattcccctttgctcaagtacaactttgggaccttggaatcacccaatatgccttgtctttgtctctgatactaaggatgcctaagtgaccctgaagaagcaatggagagatgaagtttttacaagaacttcctgatcccacagcccagccaggctgtacatttaaccactggcatttggaagcagcagggcttgtaagtgtgcctcatgcacatcaaaataaaacacataccacatagattccattttcacatttttacgacattcttgaaaagacccaactataatgatggagaacaaagcagtggttgtcagaatatagaagagggtttgtgtgacttaaaaagtatagcatgagggactttgtgggagtgattgattgcaatggaggttccacagatctacacatgtgttaaaactcatagaactatacaccaagaaaagtcaagtttactgtatgtcaattttaaaagtccaaatataaaagaaataaagcacacatcatctcgtgtgctctatttttcacctctcaggctgtacaaaatgtgagcattcaaagcctttaatgatttggcagagttggaagaagggtaataagtggggagattacttgaacttggcacctgattcttttcaagtcatgagaagctaatttatcctcccttgtaccatctctgttgttaagctactgagtgcccttatttgagaaatgccctgtgggcaaaataggatggtgcatgatcacagtccgctctccaggaaactagtgtgaagctgtgtgaaagagcattttttttttcattttttccccaaactgtggcccgcaatcctcaaacgctcagcgtcccagctttctcacagtatttgacatgactgtagttcttgtttgtacttgcagcacagagcaagcagaccttgacttccagaggccctgacccattgaaggggccgcccaacaaagtttcctgcaaagagtaaagactctgaaacttcgattctgatgctataggacaggaggaccactcatctttaccaaatcagggaggtgtccatctcccctttcactcttttcctcctcctgaaatctttggggtgccctcctgagggcagggggagaagagggagaaaattttatcacaaattctattctcactagattatgtttagtaatatgcatagtattttttttttttccaaactcctctccttactggatgtgggacctttggccagacatttaaaacttttagattcttttcacatcctggatatatggctaatgactactgccttgcttaactcccagaaggactgagtcaaatgtcaaaatgctgggtacatttgtatgaggatgaggatcaattgaataggatttatgatggactggcttgggcccctacgatttattcccattagagcatatgttttgatttccaacctactaagcaaccaaatcacagatgcagttttgcaacctacagcacatttcatctcgtttattttcaaagctgtaagcagagagccatcctccatgagcagcacacatttgaaataaaatacaagttcccatcaagatattctgacatgttagacaagatgccaaattgttactgtgcttcagacttattaggcaggattgaaaagcagtttttagcatgatggcaggtcatttctgcttgcccatgaaatggccaaaccaagcactttttagatgtgatcatatggggaagaatgttcctcctccttatcttgatcagctttttaaggagaaggcatcctcatcttcctcttggttatgggtccgcttcctccactgaactcctatggcattttgctaggaccacttttacagctgttgccacattttgcctcatggtataattgttcctctacttgccacatatctgagtagtgtaggagcccctccacagcagccaagtcttgctcagagaactttgcagagttctttgtggattgctggaatctgggatttagctcttgaaagttaaagcaaaagaggttacaccgaaattctaagtaacctatttttttcatttagaaaagtaaaattgtatctgttgattatagaagattttgaaatattggttagtaagacatagaaaattaaaatcatctgtagttttcaacttaggatactgggttcataacttaatccagtttaatgtatacagttactatggctggttctgcaaatcgaaagatgactatgacatggtcaatgccctcagtaacctcacagactggtagggaagacagatacgtgaacttagtcctgcaggcaatggggagccagtacaagttttgagctggacattgacatgatgaaaatatttctggaatttttatctaaaggcagcatggtgtggagaaagctgggcctgaagcataaagaccaattcgcataaagaccaattcggaagccaatgctaaaaggccacacattttactgtttggccttaaggtaaacacaatgttattcaaccagagtgacctccttctcaagttagttacccttgggacttccaaaagtgaaacttagagattagctttgccctcatcacatttactgagcaacaaggcactttgacagcctctcactgtttgtgtttagagtgggggacacaactttttctctctccatctgattggctgagctcccagtctacactacagaacctgagtcttaggagacagatatttaaccccaagtcatgccactgggtgtccatgttaagaaatatcttagggaatcttccacaagtctgttgctgttctcctccaaatatttttggttttcttaaaaaattagtatgcccttggtcagaaaggtatagaaccaaagatgtttgcttctgcaaacctaaggatgactatgacatggtcaatgccctcagtaacctcacagactggtagggaagacaaatacatgaacttagtcctgcaggcagtggggagccagtacaagttttgagctggacattgacatgatgaaaatatttctgaaatttttatctaaaggcagcatggtgtaaagaaagccggtgacctctcttttacagacagaacagctagtctcctggttatacttgccctaggtctcacatattaagtggcagaggtgggcctaaaatttagcgttagacaactaacactggtcctccatgaaacacaaattgcttctaggctggaggagatataggtgtctctataagccagggcctgtagagcaggggcactagccataaagaccagacaacagcccaggatggctactgatcctagcagacacagttctataatgtaaaaacaaccaagaagcaaaccaacttaaaagttaacagacacacacacacacacacacacacacacacacacacacactacactcctgacatgtttttcccctttctattttcagttggggttatctttcagtttagttctgggaaggggtttctttttttgtcgttgtggttgagacggagtccctctccggtctctgtcgcccaagctggagcgcaatggtgcgatctcagctcactgcaacctctgcacacccccaccccccgccctcccgcgccgggttcaagcgactctgccacctcagcctccagagtagctgggattacaggcgtgtgccaccaggcccggctaatttttgtatttttagtagacacgggttttcaccatgttgggcaggctggtcttaagctcctgacctcatgatccacccgcctcggcctcccaaagtgttgggattacaggcgtgagccattgcactcggctggggtttcgttttaatggctcagtaaactgtgatctggtacaaaaggatgggattaatgggctcttttgctgcaaatggtactaagctcttccagctttatactctgcaccttttatcttcgtggcgatatttaagcttttaaggacgttgctgggagtgacgactccattggatccaatctcaggaacagtaaatggccttcaactctttttaaaaaagatgcattgcaggagtgaactgctgcaaactgctgcaaactccatggaggagtgacctttaaaatggggggtggggggatagtttgctgctggcttttcattccctgtagccacctaagctgttggggaatggacatgggaaacacactagctaaagggcccatttgttacaaactgagttttggtcattttttcttatttatatacttatttgtttttatctgagcacataaatctatatttgaatgctgcaaatcaccctttgttacactcttcttagtagacacatatgtatttagggtacagctgagtacagtacatttgaggttttgcaaatgataaattctgccatctccatattcttggataaaactagaaatacacaggcttttgtatacgaacagcagaagctgatgactctattcacatatagctatgttggatatgttggaggcctggagcaatttggccacagagagttgtttttaggattggaagaacactcagcccccaaactagataatgtgacatgttctatttttaatgagtttattttcttgtttcagcttggaggtgttagttcatcgttttgattcttgacaaaaggattctgcttagactctcagctccctggtgggttggagtttcacaaaaacatctgcgctaaagcaaaggggattcatactatcctagacagtgttcacttgaaggtttcccagaagcatctgtagctggaagagtccctgtcagtctctactccctagctgtagatgggcccacagccctgctgcctagggaaaagttgacagttattaaaaaaaaaaaacagcccttttctgtcatattcacttcagtaaaggaccaagtctgctattgcaaatgggctgtatccagtgcacaggtattctggtatctcctacagcacatagtcactattgctaaacattttgggtagttagagtcagtagtcccaaagattggccataagggccaaataagattggaattctgattatggtagaaaatcctttttaatgtattataattcataagaaatagacttcagaagagaattgatttcagagctgtattcctgctcatttcttccatcctttctgttcatttttcatttcctacagacaatcaattagtaaatgtaggatacgtgtgtacctcagtgacccaagttgctagggatacatcaagtgcttcagcccatagcagccaagggaggtttggggtgtctctacagctcttgacttttcaacttcaattataaatccatttggtcaagttgtggtttgaactgtgtgtgtcccctgtgatgcacttttggtaaacagctgcagtacagaagcagctgggcttatttgttaccatctctactaagccgccatataactgcatggggacggtgatacagcaagtgaaaacgggtagagttttacagcatagggtcttagattcatgatgagaaatgacactgaacaaatgactatttttgactttaaatagaagagattaaaagactttcagatctgttctcctaggtttttgttcatacatcttcatttttgcgatttctccggatttggagtctgttttgaaggggaaagttggcccatccagaaagcaccggatcatattttccattctgtatgcattttgctatctgccttgtttatgtgaacattaaaataaataaaaccttacaatctaaactttgcttttactaaataaatgaacacagcagttattaattgaattcagtcagctttcaaatagaatcattactttattacagtataaacacagtggaaagaaatcagacaccctagcacagtgcatgttttgctaggaatttaacaaatatgttggcctcaatgtgaacaagttatatatttttttcagacttgaggcttgttaactctttcaggccacttgctgctaggcaaccaataccctgctggcttgagtccatggttttaaaaattatcagtttcctgccagactgacttgaggacttttgaaaaagtaaattttgaatgcatgctgcgctttttaggcaaatctttattaaatgtcttctctggcaaagatagtactagaaatatactgagaagtgggagaaagggtggccccttccttccaagattttataatcttttgatatcaagcacacacacacacacacacacacacacacacacacacacacacacacagctaaggcagttcacaacaatggaccagggtgaatgctgtggactgcagttgctctagagtaatacagggaaaggatgtcttatctgtggactcatgcagccaacaaaggagctgtggaaaaaatagaggagtttgaactggactaagtagaaatgggggtatattttaggcacaagggacagggattcaggatgctgtcaaagtgaggcaaatagttgttgagggcctcttatttgctaagtgctagggacagagtgaggaatgagccaggcatcatctggcctttaatggagctttttagtatgaacacaattattttcattcttttttactggctaacttatgtgcaaatttctgtaagtaagttgagaacccatttgaactgctcaaataaaaaaaggagattatattggaagagtccatgattacagcctgcccctagatcttgtggtaggattcaacaactgaaagtttgagaacccaagattacttgtttcatcatcttgggtcatataaacttttgttgctgcttcaaagaccacttcaagcttatctcttctccacactaaacacacacacacagagagacacacacacacacacacacacacacacacagagttttcctcttctgctttcacacacttgtagtcacatcagcttccactttaaaactacttcctagtttgaggatccaacagagattgacttgaattcctgtgtcctgatgccaaagtcacccagctttggtcagttgtccattcttatccaatcagtgatgcctatttgggcaagttgtatgactttgagaagagaacaagagaaataaatgattgtcatttcaagtacagtcagtcattgttgagagaaagagcaaatcccaagcaggggcttaatatctgacctgaacacatgtgtttggtaaacagtagtgagacttgtatcactgaaaaccaggctttccatggaggggcatggtgagaatgaaaactggaaagatatggtgggtctatattttaggacgtcattttaagtgtggaaaagggaagtcttcatgtctcattgatattgaggcacattctgactggctaagttgcagagaaactgtagacaaaattcttgtcatcagtgaggaggtgtgggactggagtgagcattttctaagattgtttcccagcctatagttatttggtttgaggctcctgcagattcctttctgagaggaactttgtttattactcttttgctgtagggattatgctgccctctggggattgggagattcctgggatgtgagggcacccctgggtggggtctttttctttctgagagcaccgcgataacatcttcctgcaagaggagtgtgtccctcaaaggccgaaatggaaaagattcaaaaatctctaactctcacctctctagatataatgcaatacacatatagaatatacatgccctttttcttggagaaaatttccaaaaataagatatatatttttgtgtaatgcctattgcttactttaaaatatttaaattatttaattttaaaatttataaattatgtatttattaaaatttaatatataaattaaaatatttgctcagtctggaggattcaggaaagcacacaaatttggcatattacaaagtacatgtaaccctaaacatccaaagaagatcaaattggtattttattgtattctttttcaatgttttatgcatgtatgttatacaaaataaaatgattacaatactatacatacagttttgtatccattttgtcttagtgaacatttctccatgtcattaaatattcctggtagctatatagttttactgtaatatattttaatatttactaatttaggggaatttaattgtcctaaataattattccgataaatagctttatatgtaaatatttgatcacatctttatttctttagtccagctttcaaggcttgaaattattagggaaaatgatgtgaaattttaaggtcttgttatatagttccaatttatatagacccccagtctatggtagcggctgactacctcatccttgctggtactaagtaatagcatggcttgtagtttatatcagcttggtaggtggaacgcttctccatggtaaagaccatggcattttctcctttaatggtgttcagcacatatcaggcacactatgcaagtttgttaaataaatcatagtcaaaggagaaggtggtaagatctattacgaagacatgtttttttgttctaagtctgtggggaattcaagaagaaattagtttaagcttgtgtaggaggatgcagtagagaggtgggattgagaagcgaagggccagtgaacaatgatactgttaaatgcattgaaacttcaaataagcaaatggggccaaggagagaaacttgttaaaaatgaagtgtggtctatttcatggagcacagcataggtgactgcagagtagatcatggattgtttcaatgtaaaaaccagtgggttgaaccctagagcccagttggatgggtctatggatgggtctatggagcacagttggatgggcctccgactaagtgtgaactgtgcagggagattaggttgtaacaataaaagttacagttctacattcatttattcattctttcattcatccatttaacacattgtttttgaatttggcctgtttctgtagtgacgatggagctatgaagatagtactagagctttcatttgggtggtttgttcaaatgcgttaggtcggttggtgcaaggtttgtactctggccctaaataaatcatcttggctttctaagaggtgactgaataagactcacttactctgctctggccatataggcttagttgttgtatttttgtttttgtttttctttcttgagactgagtcttgctttgtcgcccaggctggagtgcagtggcgtgatctcagctcactacaacctctgcctcccggattcaagcaattctttctgcctcagcctcccaagtagctgggattacaggagcccgccacaccacaccctactaatttttgtattttcagtagaagtggggttttgccacgttggccaggttggtcttgaactcctgatctcaagggatgtgcccacctcggcctcccaaagtgctgggattacaggtgtgagccaccgtgcccagccccttgttttaaaaatatactaggcatgctcctacattagagcctttgcactggttgtttgttcaacatggaatgggcttttcttagatgtctattggaccaaatccttcatctcattcaagtctttgcttatcgctcacaatgtcaatgaggcccacattgatcatcctatttaataccacaacctacctcccactctggcactccttgttctccttattctgctcacatttttcttttttcatcaaattataccatacttttaattatgctacataatttacttatatgttatgctgattgcatactgtctgttttctcccacttcatgaaagcaagaatctttgtttgggtcatgctgtgtcactgaaccctaaaggagtgtcttaaacacagtagtgcattattatatttttgtggaatgaataactcatcatgtgcttggcaggcaacattaaagaggatcttcagatttttcagaagagcaagggagaactcccctcacctgctgagctgttggctgtggactccagatcaaagtctgaggaaccactcacctccatttcttggcagtggagagtgagatcaacaagagagataggagaaaatcatggggagactttgagtttagagggtcctgggcagctctctcacaataacagtaaggtagggaagcatctcagagctctttatgcaaaggccctcatccaaaaatcgagaccagatttccatgaccattgctgttgctgttcttactacatctgagctcttccatgccctcttttccctttgatcagtggtgtcagaaagcagatgcatactaacatttaccaattgtaggacatgtcccacaacgaagctcattctgccttcaacaccagagcaagagggaattatgggaagaatattcaccagggtagacttttggggaagtgatgctgaagcctcagtattaaaaacttggagcagtgggggatgtggatgggctttctgaaaaagttttgaatttattagtgaacctgttactcatcccttttggggtgtgggtaatggagtggagggagagccacagctgctttgtgctgagtcatacgcttgtgtttgtactttgccttgcatagaggaatccaaggttgcttcacaatgacttggttaaaattagcactgtcagagagctccgtaaagagtcttgtgaaaagtcttccaaaataaatcaaccttcctgttggggttgagtcatccccttctttcttcaactggaaatgattttaatgggaaggtaagccagtaagatctttttggttgccgattttgaaggtatcattgtgataacacagggtggtaaggcagaaagtgtcagacagtggtagggggtcaaatgttggctgtggcgtaacttgctgtgtgaccttgcatgagtatcataacttttcagagtttcaagtgtcccaaaagtaaaaagtggggctaccaacatctgctttgccgagagacaatagatgtgtaattaagtggagcaatgtatatgaagcatacttcttggcacataaagtccctcaacaaatgggaacagaaatgatattgatcactgctttccacatattcttcaaactaacatgtctcaaagcaagcttatcactctctgccctgctgttttcattgagacctgctgctacttgaattcattgtagctctcaggaaaccatcattcacccaggcatattgatatattgatggctgatcacttctcaattaccactaccaggactttaattctgcccttcaccacttcatacatagaatattttaccaggtttttttttttttttttaactttccccctacctcaaacacctgggagttcacctactagggtggtcccttggttaggatgtcccttacggtttccttcctattctgcttactgtgtggcagttgagtgagcatagcatactactgtatgtcattcagggttatggactcagttactcaattctgcaccccaaccccttgacacagggaagcacagtataggtgctctataaagactggctagaattgaagtatatgggaagctgtgaccaagacgtcctaaaggcatattaaatagtggttgtcaccatctaaaattaccttatttatttcattatttgcatatctatatgtccttgctgccttcattattgtccattttactcctgtatcatgtcacaagaggtagatgtccagacagctcatcattcctcaagtcatacctctaagagagcaggaactgtatctttcctattcatggttatgtctccagaccagagcctggtgcttctagtggccatcttttccaactgtgggaaaaacctgtctgacaatagagccaacacagagaaaagcaaagctgagagatggagaaaaaaggcagagtgctgctgatattgttcaaaccataagatcctggcatgcctgaagtgaacatacccccttggacatcccatatgtgagccaataaattcccatcattgctaaagctaatttgagtggggtttctgccatttgcaataaaaagcaaactgactaatacatcctctcctcagtacctcataaagcttcatgaaaatcaaaaggaactttccatttgcaacaagttattcattctagtatcaaagtttcaacatggttatcctttcctgccttactcaattcaggaatgcaccaataatgatgccactagagagagatttccttggtaatgggctgaagagcacctgatgtggtggtaagggttgctcctttaaataaaggaataagcatttgagctaacacatggatgatgagaagcagccatacatatgcttatctagaggaaaagcattctaagtagaggaaacagcaagcacagaggcccagagacaggaaagaagaagctgattgttggtttaagaactccacagaaggttcatgtggctggatctttgtgaaagaggaggagacatataggaatggagaagaagccaagggccatgtgcacttttcaggagaatgcatgaattcaagattgtctgacttgggacaggagtcaaatgggcggcaacaagggcagcaaagaaggcctgcattcattcagtgaaaatgcagggtggcttgcctggcactgtttcacgcagtgtagctgtacaagatggtgtctgcagggttgtaccagcaaatcaattgctgtactaccaacctagaaaagtcagtgaatcatccttatattttgatcatatagttaaatatattccgtttgatcctttagtaagttagtggagctgaaaataaatggattaggttggagaaataagttaacctctcacattcatcagagcttaatttagtgattgcctccttattgccctagatgggccagtagtatgacccatctcactgtgagtaccttactctgagaattttgctcagtttccaaaaggcagcaccatagatatgaacacacaatgttaataagctggtattatgaagcacatcatactgcaaaaattctgatggtttcatagaatgtgaatatagtagatagaaatgtatttttatttcaaagtcctgggacattatgcttgcaaaataccttgaaatcgtgtttattctctagcattcatagcatccctaaatcattaatatgcacatgttccaaataaggaaactgtctgtcatataggaatattttgtaatgcaatttaattcatctcatttcaacaaatatatatggactgtttgatgtggatttatggtgttgaaagtagactgctttttgtaaggagaatgaatggatgcaggctagagatgaagcggggcatcttacaaagaaatgtttctagtaccatgggttaagtgaaattctaccatgaactacgaaagtgacagtggaaatgaggaataggcaaatacagatatttaaaagcaaaaccatcagggcttggtgacagattagaggtgaagaaatagagaaggacaggaatcaagtatatgtctatgaagtcaactggaaatattgtggtgttcttgatagaagtgggaattcttgaggaactctagtttgggaagatgatgtctagtggacaattggaaggcaggcctagagctgagcagcaaattaagtcctgaagatggacatttttagatcacccccctaaagatgatgactaaagctatggaaatggataagctcatccagtaggtcaatgtagagagagactccccacagattgaggcgtgcagagccctatgcaggccaccttgacataactcaccatacctttccccatgagtgtgattggcacccttggggccattttgatttcggatataagccttgtgctatagaataggaaaatttatgaagacattcaaattctgccattgaaagccagtgtggtatctggataatggacatgttattttgagaaaaaacattgcttacactcaggatattagttagaaatccccaatttagtttcattttttttgtgtgagaaaatatggcagtggaaacattttcagaaatgggaagtcatttcttagagagatttatttggagcatagccagtagcaaaatcagctattgacaccttaagctacagacttaagatgaaaaacaatgatagagaggtcgttttttttgttgttgttgttttgttgtttttttttttttttttgagttccataaggagaacatgattagcctattcttctgattgttttatgtttgcgagttctgtctcctcagttaattttcatcttttctgaagcatgggttctacctcataatttttggatctccctgcagtgcctagcacagtgcagaactagtgtatcacacactcagatatctcttgtggaaaaaaatacatcacaacaagtagaattacaaggttagattcaaaggtccttgaaatgcagtcaagtctgttctcacgcctctgtgcaggatagcaatcaagctgccccataatattgactgtcttcttgtaaatcacaagatatgtttcttaggctgaggcaaaaaggacaagtagagaaaccatagtttcatgggctctttacagctggaagtcagaaataccacgaaagttggaagtaatagtgacaggaaagggtacatgtaggactcacactaaggaacttggtagcatttcttataatacctattcaatcaacattgtcagtaacacggtcagggctacattggagtaagaattaatactattaaaagaaataataaatatgcaaataacctgaaaaatatccgtagtatttaccacctgaattcacacagtgaaatgaagcctttacacactttggagttcacattgcacaacttctgcatggtggtagtgatgagtgcatgaatgttctaacccaattcgttttctatgacctcttaattccctctaggaacttttgtgaaaaaaatgtcatgctcagtagagattgcttttgatgtaagtaatacttagtggtttggtaggtaaatattagctaatttttgagtgctaactatgtacctggcaccagactgagacttttacatagattattttatttaatgctgataatggccctctgaagtaggttttatcatttgtatttttatagataagaaagtaaaggcttagagaggccatgtaatttgtctgagggtatacatgaagtaagtggcagagctagtggtcagctaaacctaaaatccatgctcttaagagaactaggctaaactgcttacataatatattaactacattaaaattgataccagttcttttgtgcatagttggccgagttcatagagacttgccaagaactgttgaaacctttatctacagagataaggtagacagtagagaagaccaggagcacttggaccatatttcccagcagttactctcacctcgctcgtccagtcctttctctatcattacaacattgaacactagtaatacaactctgtggcagagttgatagcacatcagttatccccatttaccttctgtgtgatagcatttcatggtattatatgaaattatctaaaggatgatatgatttgatgttgctaaagtgaagaaaaccaccaaaggtagacttgttctcatttaagaaaaagcctccataggttaacttgaataatcttcagcttgtcttgtgggaccatgtcaaattaatttcagctgatgctgtataggaaggaacaacctttatcatcatcattatcataaattcataccagtcattattccattcatagtatatgccaggtgagttatgttcattattttaatcaatcttacgaaaaaaactctctaaaaacagggatttttatgctgacttcataaaagaggaaatagatactctgagagattgacagtcccatgatcatatagctaattagtgacagtcatatgatttaaatgagttatgcttgacttcaaacctgttttttctattactattattatttaactatgatcacaaaataatttaaacatacagtgttggtgcagaaatattacctactctcacttgcctgctgacaagataaacaaatgtcatttggcctactttgcctcaaatctactctcccctcttcttaatttttaaaaaatttttattttgaaataactataaattcacagaagattgcaaacaaatacacagaaaagtcctatacaacattccccagcctcctccagtattagcatataacataattatagtacaatatcaaaaccattggtaaaatctttagagctttcccagatttcaccagttaaacatgagcccctttgtgtttttctgtgtgttgttttatgtaattttatcatatgtgttgtctcatgtaaccaccgtgacagttaacatactccactatacagaagactgttctgtgctactcctttacagccatattcatctcctctctcttctccctaatccctggcaactaagttgtcctacatatctacaattattatttcacaagtactagataaaagaaattatatagtatgtaaccttttgaaattgacctttttaactcagcaacaatttccttcagatgtatccaagttgttgcatgcagttgtgtcggtttacccattgaaagacgtttgaataatttacaatttacaaaatttatttatttttctaggataaatgcccaagagtgcagttgttgagtcgtatgataagttcatatttagttttgaaaggcactgccaaactatttttctgagtttttgtaccatcttcctcttattaatttacactttcgagattatatgtgataaagtcattagagctttctcttccttgaaatttccatttatataatttgcccgtctttttctaatgagatttttggcctctttcttgctgatttgttagagttcttttttaaattattagcactaatcctcgttaaatataccacaaatgttgtcctgtctgtgacctgttagtttgtacgtggtgtattttttcatgcatacattttaaattttaatgtagcaatgtttatcagtcatttcctttatggtttgtggtttttgtgatcttacataataaattcctttgcatttttttccataggtaagcccctagggaccaaacagcctctttgctcttaattgatacacagtattaatacttctgctgatctaatttggaagcacctcataagttagaattacactggaaggcataagggaaattctacagacagatactctgatggcaacaaatgatgatttttcaggccatctcaattaattctactttcttccagttggtcatctacttttggtcatccttcagtgctcaaatattaactcctctgcgaagcctttcattacattcctcaagacttgttttgagctcctgctttatgtttaatcatcatcttgtgctaccctccttattgtacttctcacactgcagtgtagctgtatgtttactcacctgtgtcccccaaccaactgtagattgcatgagagaagagactgtgacttgtttaatagttgtatccctcagtgcagtgtctgatggatagtaagtgatcagtgaccctttatcaaatgtggggatgaaagagatgcattcaaaataagcagacctaagacctcacagagcaaagcagccttagtgtgcttagttcaaaggcaaattcccttatagtccatgggtccattcctcatgagagaagcaggactggccagagctctgtagtctgacctgcttagaacagtgaataagggtctgggggccacaggatgcagtgtgggggatttgtgctcaaggcagtgaagaccttggtaataaaaggggttgtttaatcatgacagagtgaaggaaaaccaaagtccaattcccagagtatgtacgaataacaaggctcagtgtcaaaagccaagagctgcattaaaataatactgaagcacaagaaaacaggaaatcctatttttttttttgtcttctgtttaaagaagcagagaattgtgtcaattgttttggaaaggttttagtccaaaatggttaaactatctgttggtatgattcgtctccccatcataggcacagacacatgttctttccaagggagatggatcagactctataaaattcctagtacctccttatgtcagatgaagtaataatggacattcctttcagattcatcataactcaggaagattgttctgatggtaagtgagggaaaatagaacctcctttcgagtcaattcctgctgcttctggactttgccattatgaagcaaaaagtctgtttttaattagagacctgaaagcctaattttatgccatggtaacctgtgggatctgaaatacacacccccagatgttgcctgtagcaaaatatgttcatagcaaaggcaacttaaaagtaaaaaaaggaaaaataaagcataactccaaggaagcagaagatataaagaacacactttgataatctttagtgaacttgaagcaattgtccaaaagtgagctatcatttagaatttattgtaaatgataggaaaataaaataccttgagtgggacttgctgctcaaaaagtaaagtgaagtgtgggtgtcttagttagctggggctactgtaacaaaataccacagactgagtggattaaagaataggcatttatctcccacatttctggaggctgaaagtccaaggtcagggtgccagaattgttgagttctggtgagggctgccttcttggttgcagatcgctaccttcttgctgtaccttcacatggtgaatagaggatagtctggtatctcttcctcttcttgtgagaacagtaattataggggcttttcctcacaaacccatttaaccttaattacctctcaaaggactcagctcctagtatcatcacattgcaggttagggcttcaacatatgaatttgggagggatacagacattcagtccataacagtgcaggaggcaaaaactaaacgtgcattttcctaagtgttaggccacttagtaattcaatataatgctgctctctttttctttatttctcattttttttgcataattaatagtattatatgaacccacttacatagttatagtcagggtcagctttaaaacaaaactttcacgtcttctactatcttgctgttccctctctttccctcttttcccttcactcgtgctccctccatccatttggttttgtttgggtaatttagggataatctgatttagtaaaaacagctttggtccagaagccgggacaccttgactgtgccactaactcactatgtgaacttgggcacatttctttttctttgtagaaatcagtgttctaatctgtaccaagagtaggttggataacttggtctctaaagtttcatttgcttctgctcatattggtctcactgaaatatgatcagtactcagttgaatattgatgtgatacctgaatagcatgtagaatgtgatcagtctcttaggcgaagcagctttttttagagaatttaatttgttataaagcagttaacttgctctgccagtttcatattaatatttcactgaatgatatctttgtcaacatcagaaatagataatgagtttataatcaatatgatgtcttgaaagctggcctttttctgattcattgctgtccctgtctgatggtggtctatcaaaatgcagaccctttctttgcatcataatcagacatacctgtaagctttcccacattaaatgaagactgtttcttctttgatctagtttaaacagatcagggattgcaaatgagctcatttcacttgtcaactccaatcaattgtggaaatataacaggagtccgtatttagaagtattgtgaaaagtgttttgggcactgtgcactaagaattgtcagagtgtcccatatgtcaggagtttgctatcctagacttggagagtgagattttcaagtcatctcctgctgtcttgcaatcgactcactgcgaattatggaacagatgttgctctgtgatcaacaggtctcccaaagctctggaggcacctttatgcaacaccagcaggaccaattgaaaaagaaattacccaaacattacagagctgcttgctgttcatatcttgcagcttctaatgacccaaaacaaagatgtatttatataatttatttgctatggaatgggtaagaattaaatgtgatcagtgaaggtactaggaccagaagaacttagagaagccaacagagttcaccatttaaatttacctaccatttgttcaataaatactataagccaggcatttttaaagacactttagttcacatctaatccttcaaaaattctgtgatggaaatggagaggtttaagtagttttccaaagttcatatctcaagaaatgagcatttttacatctctgaagagggggtataaaaattggtgacaatgatgaagagaagaccatggacccgtcagcctgaactcttgaagatttgggattactcatctgtagatcccatctgacaacagatgttgataagacacaaatacctgttgaagctttagtggatcaataaataacaccccttcattccccatttgagtcttgaaaaaatgagggaaagtgtgaggtagataaaggtgaaaatatcacctcaatttttggtaaagctgcttgtagaacatagattaggtcggtggccaagcaaacaagaatgcatgctccttcaagcaagcagttagcaagaatgagaaaggaactcaatcgaatatgtccaatttcttcttccaagtttattggatctgataatgaggataagtgtcttaagtcagcttcttcctaaagtaggccctgagacaggatctgagttccagtggtttctttgggaggtgatttccagagcaccagtaatggagtagggaaatgaaacagggaagaaaggaatttatttaagccaatataaagtatattaatgagcaactggagctcagtcatcctgggaaccctaggaattgtgcagaacatgcctctgagttgaaaaaactggagtagccattcactaactgctatcagtcatggctaagggctcctcctaggaatgtcaactccctggaaattactaactctctagcttactctatgcccaggctgatcaagcttctggggccagagaatgcactctggcaggcagaaattgcaaataattgccataaagaattgtccatgtgcacaggagcaggcagtgccaagtggttaccagtggagtatagatggtgatacatttgtcatgggacctgaaacaacccagtggattttctaagataaactaaaactaactaaactaaacttggagcagttttcctactacttccttttctctgcaaggaattctcagcagggcctttccaacataagcatgggaggtctttttgtacaaataaaaaagattatttttccttatttcttatatttttctgtttgtaaggcaaaaaaaaaaaaaaaaaagtccaacacaagcttcgaaactagtgaggtcttggctgtacaaaacctttggaaaccattggtggttttggaagctgccaatgtgctgtcaggcagattgaatctaaagaaaaacgcagagatgaatgtttcccatgccatgaataccccaaccctgctgtctggggaatctgagaaggaaggcagcatgaagggctagactttcactttttgcaaatggtttcagaaagagcaggctgagaccacaaagttggagtaacatacagtgtgggatagctgcaaaataatggtaggagaaggattcatgaaaatgggatggggccagaaggattgtaatggtatttgtgtgaaaggcaatggcagctcggggggcacaagtaggaggaaccatcccatctagtatcctgttgcctggatctcaatactttattggccatgagctacttgctgtccaggggagtggtaagaggtgaggataaggtgctctctcagtaggagccttgagcgtaggatctctgagaagactgatgattgatttgtaattagtgaatggattttgtcaaagtcttatgaaaattttccatgatgttttgcattttctttatttttaaggcccggaaggggaggaattatctcagtggtggccttgccctcattaatgaggcattagctcacctggttcaagcacagtacaaagaatactaacagaataacagtgagagccttccctgagggttggtctggatgtaatcctggggtggagacatgttgtttctattaagttatttcatcctggagtcttatctttgcaccagaaacccaaaacaaaaaattcttctaatcataaggattggaaaaaacagtcaagtcatattattatgttctaagattgatgttaaaatactccttgttcgccctgatagttttctttccttccttccttccttccttccttccttccttccttccttccttccttccttccttccttccttcctccatccctccttccctccctccctctctctctctttttcttctcttctcttctcttttcttttctttccccttcctgacttgtttattgctgtgattctgagtaatctaattcaccaagttttcacaagtctaacagtaacccaactacaattgggacttctaaatagtagatgtggccgggtgcggtggctcacgcctgtaatccagcactttgggaggccgaggcaggcagatcacaaggtcaggagtttgaggccggcctggccagtatggtgaaaccccgtctctactaaaaatacaaaaattagccaggtgtagtggcacacgcctgtagtcccagctactcgggaggctgaggcagaagaattgcttgaactcgggaggcggaggttgcagtgagccaagatcaacagagtgagactccatctcaaaaaaaaaaaaaaaaaaaaaaaaaagtagatgctttttctttccaggtgcaagagaagaaaatcataacaaggtccttcccttaaaagtaaaatgatgctgtctggttacaaatgggtttgagatgtagtgaaattttgtttacagtttattgctgtggaatgatatcttgggtttaaatgagctgtctttgctaggggtttgttttcttttcataccaggacaacacaagagtgaaaacctggctttgaggaaatgtcagggccaaacactgcgtgcaaatagaggaagggtcaggatgctctcttccagagacttgttcaggactctttaaaggggttcattttccctggatgcagactgaaaactatccacatcattccccaacccccactgccattttgaatggcaacttcatggcaaagcagaacagaatctgggagtgagagttcgaatcctacatctttgcagttacataaatccatgatgttaatcatagctgcccaacagaatctcttgggagcctactaaaatgcaaataactgggtagttttgccaagctattgattcagtgggttttgggtagggcttggaatctgtgttctttaatctgctcgttaggccacccaattttgatcaacttccatcaatcttttactctaagttgattaaatagtgatatatttatagaagtttctaactctaattcagtagcatttttctttatttcctttgtatggacaactggcttgttaatatgccttcagagcccaagtctctgaagtcagtgttctcttctcagcactgcctctgatttgaaggatgacctttaacatctcaatggttgagtctttccctgtttcctatgtggacctaaccactcttttttagcatgctgaatgccgacagaaaacgattgtgaaaagttcaaaatgtaaattgccatggaaacattatagcactggtaaaacatgtattctcagtagataaaggggaagacagattggggtgaatgaagctatccattcatcaaccttggattaatcaatctctgcttgtcatcttaaacagaaggattttaaaggaattatggatttcaggtcagaatttgtctggtttagtattttttatttcaactccaaacatttttataaaatgtgccatgctacttctgggatatataaaaataccagtctccaagatagtaggaaagctgtttgctcagagaccaagggtgttactcccttttacttcaaaccaggaagctggaaggagctattctgttacgatatgtattggacatttccatatgcatttaagtcaaggaattattcctgagtatcttctgagacagggtgttattctgggtgtttcggaacatatagatgtgaggaatatgcagtctccactttgacaagtttacagatggttgcaaagttttgggtaaaggtaaattattagctgcctgtgatacaagataaaatatttgccatggagattcagagcagtgaaggcccttgcatgttgggagaacgagcaaatacttccaagtgggaaattagatttgagatagactgtttttttttaacttttattttaatttcaggggtacatgtgcaggtttgttatataggtaaacttgtgttgtgggagtttgttgtacgtattatttcatcactcaggtattaagcctagtatccattaattatttttcctaatcttctccctgcctccccccaccactctctggtaggccccagtgtgtgttgcccccctctgtgtgtccatgtgtcctcatcgtttagctcccacttataagtgagaacatgtggtatttagttttctgttcctgcattagtttgctagggatgatggcctccagctccatccatgtccctgcaaaggacatgatgagatagactttgaaaaacacacaggatttgaccagacacaggcattctcactacagaaaaaagctggaacaatggcctggaggtgcgctcaggcaaagtatgtatgaaattgtcttcaaaatctactgcaagactttcagatttccctggaaatgagataattgctcctttattgacataagttggggttcattttactatttagtcacctgaggatatgttagttatcccagcatcccagcacctcctttgcttgaaaaaaatccttagtgctggggcctttgagctgtgggagtgaatgaataggcatgggaccaaattgtaggacactggtaagtatcctgcactgggatactgacatagaggccaataggtttaggaaagccaaacaacctgcttacctcacagtataaatgaaaaagcctgggctttggaaatcagatcagcctggatttcaatcctggttcttgctattaatgttttcctaggcacattatttaatcattaaatataatgtctgtcatgtagctgatacagttggtatattataaattttcaataaattaattacctgggtcctgtgtgtagagaccatgtttcaaggagggatggtagatgctcacctgggtttccatagagccaaagtatatttctcttgctgttttatagcatactctgtctccttcaaatctcagctttttgcttggctctagccaagattggaatgttcccttaaatatttctgatctagcagaaagaccagcctttcagaacttgcagtggcttcctttgttgacattagattcatttgggacttctttaagttgatgctgccatcttcctatgctttggcctctactttgaactttctaatcttgctggttttgccctatctgcttgggaatttgaccacaacagtaccaaggtaccaatgtcacctctaggctaaactaatgtcttcttgtaacttggtcttttcatatggcacatcttgccaatcttatgggttgctctttgtgatcaaaaatgaccaacctgatcatgacggagggtattgggcaccagtctggggccagtgtgagtatttcttgagcttgaggtggactccttaaccttgaagactcctaacatgatgtccttatgtcctttagccaaatgcaggaagacctgtggtacatagcttgatcttgtctctttatactctaaacaagctggtgggctagattaacttcttcaggccatcctgactctctggcttttctttgaactgtctctggggcttttgagcagcctctggactccatgatggaatgggaagtttgtgatataagagctatgatacactaacttaatttttttttgctcctgtgtttcccagactcattagattatggcacactcctgctcatgtgcatgccaattcacatatatacccaccaaatgcctgctaacatattcagataatgtttttctctcactttggaaaaatgtcctagtttaatcctcataaacatgctgtgaaatggatttattatctcccttttatggatgcagaaatggagtttaaagaacttacaggatttgtccaacatcacctaactgtaagttgcagagttgtacacactaattagtaatcccgctgctctttgaccacactcactgtgcctgcatgcattagccctgctattggcccttgtgataaaaatgtcatgctagcacaaagttgggaaacaatacccttccatagggtggccatgccaatcagaagccaatgttacctctcttaatcttaaagcatgaatgggctctacttcaggtctaattgaactgagaccataaaaccaaattgagaaggctccatgggtgtgtcatttagtctcacatccaggagctttccattgggtctgctgccacatttacctctctctgggttttgggacattctcacatggaaggagccgagatcgtggcataattaccacctgctccatttgggtactctgtcggcttctacatctaccctcaagtctcccactccgggtgagagcaatggtagaggcttttgtagtgctgatcattatctccatccccgggaaacaggaaaacagcacaatagcaaaatccttttggctataagatttcctgtccctaagtcacagaggaaaaccacataaagacaactagaagctcagtaacccccagcaaacctagctatgcacatttagcatgtctaagcagccttaggttcaaattctggtacattgctgtgtttctctgagcctcagtttcagcattcataaaatggggataataatacttgtttccatttcatagtgtgattcaaggagataattgatgtactatgttctgtgtatgtctgatggacactctaaggcagaatttgaaataaagacattgcttcagctgaaggcagatgttaggaatagtttgttgttaatcccaccctttggcaacaaagacatttcaacatccagtatcaggctgactgtgactcacaaatgaattcagaataatagcaatacctgtgagctctcagactggcagtcagaaccctgctgaaaggattagcgcccgcagcacatggcaactctggtaatggtgacttgaagaagtagtaatgtctcagctctttaaattgtgtgtttttttaactaatataatttttaaaaacttcattagcagcacagaatgttagaactgaaggatcttccttatccctgcctctccttttacagatgggaaaactaaggaccctcaaaagggactgtacctggcttcaaagtgacagaagtaatagatgacaaaaatgagattctaacttgatctcttgtataatgtcaatattctgattttacatgctcattagataaaattgaaaaaaaaaaaaaagaaaatgatggccaggcacggtggctcacgcctgtaatcccagcactttgggagccaaggtgggcggatcatgaggtcaggagatcgagaccatcctggctaacacggtgaaaccccgtttctactaaaaatacaaaaaaaaaaaaatttagccgggcgcagtggcgggtgcctgttgtcccagttactcgggaggctgaggcaggagaatggcatgaaccttggaggcagagcttgcagtgagccgagatagcgccactgcagtccaacctgggtgaaagaacgagtctccgtctcaaaaaaaaaaaaaaaaagaaaatgattaagaagaaaaagatcaccaataatcctactctacagacatatacatcattaacattttggtgtatttgatgcaccaaatagcaaatacctctctttctgtcttctctgtgtgttcattttctttcacctgttcagaaacattaaaactcaggtcttctgacttcacgctcagtgctttctcttagcatatcaggctgcctttctaatcagcattcttatttgatatttagtaaccaagagttaggttttaaattctcaaaaccaagtaaagctgccagtgaaaccccatgtgtatatggctcattaagaaaacaggtgtaataatgaaatcatgaataaatagatcaccaaaatggcctagatcagagagccaagcatgatgctagacagaggtgtctcaaaaagcacagccacatccctgccctcaaggagcatgctcagtggcatgacctctatctgaaacaagggctgtctgcctgtgctcatcccagctcagaaatgaagcagaaaatgaaaaggccacatgggatgcttcctacagtcctgttaatgtcaggagtgcaatgcctaggccctaggcattttgactcagcttcagttctctctcccaaggctgaattactagaactccagctgcagcctgaactttaactccctgttctcttcccaacccacaatcttgttatcagtctgattctgatctgttagggagaggggagggggagctagcagagatgtgactaagggcaattgagataggtcagaatggccttgcagtatattctgtcttagtgaaggttttgctaaaccattgctgcactggggagagagtaggagaacccctgcctccttgtccgcattcccttagttaagctgagctaagatgatccctccaagcttttcctaacagggaatctacattctctgtgtcttgctggctggccacaattccttggggaggcaggagctaactctaccgtcctagccaacttgaataataggaaataaatgggatggagagccaggcagcctctttgttacacagcacgttagtgaagcagctatctatttttagaagagggggaaaaagtagtagcttactcttttgggatcagcaggtggaataatgatctgccaaattttaacattcaagattttttagctgggctacaaatgagacagacttttgtgcctgcctcagtgcaatgctgtcagtgtaatcgcacatccctgggcaactaaaacatgaacgctggggaaaggagatataggactccatgtcacagaactgaaggctgagggtgcatgctataccaatagcctgattgatttaattagaaaaaaaataggtggcctagtcaccaggagtattgaaacctcagatctctgctcaaatgttacactcagtgaggttttccttggcattctattaaaagtaacgcttgccgatgacgcttcttttagcctgcattattgttctttcctgtacgtatcgctacctgacattgctttttatctgtttattaatttttctattttctgtctcagccactggaatgtagggctcaaaaagacagaggcttgcctttgttcactgctatgtccccacggcctagaactatgcccagcacatgataggtgctcaggaaatatatgttgaatgaattaatgaatgaacatgtgaatgaataaacttagtatccaatagacaatgagtatgccaataaaaatgacaagagcaattaataattattgcatgctgcacattaactcacttaatcctcacagtaactctgcatggtacatactgtccttattttcattttacatttaaggaaaattagacttgggggttaagtgacttgcctccgtggcctttgggtcacagcatgaataaataatacagccagggtttgatcatcagcctggggacaatgattccagacatatcagactgagcattcacttaatagtattttgcattggttttttggaatttccttccatgattcttacctggccctgtaaaactctttcgataaaatgaccatatgagatggatgtttcatttccatctgcttaacctatagcatccatggacttgtcattataaactccaaccagaagagcaggatatgcctcattgttctgtgacaaaaagaacccattgaacattttttggcttagctgtggttcattggtgaagctagatcagatagagaatggtggtttcttccttaaaggtttaagaataaggattaatggctattctgacatgctctaatgtggactttctcccactggatccacgacctaaacaaccacgtttcccaacttaaagtgttttgcaaagccagagcatgtcagggcttcctggtcatgtttttagtcactttcattcacaaaagtgaaatttgtttgtactcccttctccccaaataaaatgcaacaaaaatacatcagaccacaaaatcacacctagtaaaagctgcccactgagctctctagggcagtgcatattcatttatacgtgcatccaaaagttgtcaaggtccccttagagtcttattgccttctggggtctcccatgcactgtcaaccacgtggcttagggagtatatggagtctcatttttatcctgagcatagtttatccacatggcaatatctggtatattccattgtcagagtagtcacattatcttgtgcttataaaaattaaagtctctattatgtgtttgtattataattacctaattaaatagttttattattccttttagaggagacctacatttgagtgagaggctctgttttcatgcaaaattcaaggggtcactgctctgttttcaaagaacaggcaagctctaggaccgtctactccatgggttctgtgctcagtaaggtccctgtcccaagaatcccagattttaggggaattctacgccactcaacccaatctggacatagagtccatctcagtgtacagaccactgccagatttcttaagtcattcttctttctttccgtcaggtttggtcataattgtacttacgtttactgtgagttaactgagatttcaaaatccttttcaatatttcatattgatttgcaggtaacgactaaatctctaatagaaagagtcctgacacttagattcctgtcacattagagaaaaatctattttttaccaagtttcactttcaacatattctactagttcaagtcataaattgtcaaggaagaaaaaaggcccatgtgatttgttctcttggagcgcgcatgtcccttttcccaactaactcagaggttctcatcctggctgcatatgaaactcatttgagagggcttctaaaaattaccagtgtccagcctccaggttctaccacaggccaagcaacttagaatgtctcagggtaaggcctaggaggatttaaatgtgcacccaagagtgagaaccactgaattacagaatttctaatgctgtccaccaccagagtttatttgtgcagccagtgcaagttgagcaccacttatctagaatggaagtgtcttaagggaaggccctatattttatctgttttcccagtgcctagcaaagggcttggaccctggtaggtgctcagcctcatatgtggaagataacagctattcgaagcaattcaatttgtgtcaaacaccttatgtcattgccagaaacatcaacacagttccaactacatttcatttaaaagatactgcccccctcgcccaccccacacaaccacgatacacacacaaattctaaatgtcatcctgggagttgcaaagtgcttctttgaaatcttatttgtgctgcttctgtgtatccatacttaaagtatcttgacacgagccactgtctttttgtgcttgaaattgtctttaacatattttactttgacattagtatttactaggtttttgttcatatatctcttttctaaagctctgggagaaagagaggcagaacaatcatatctgccaaatggaaagaagactttaaaatatatatatagctagaaactttcacctagagaatcaatctctatccatttatacatagtcaatcataactgccactgtggccttcctttgtttccccttcctacctaccatgcatatacacctgctcacagaagcattgttgggccagtatttgagacttgaggtgcccagaattgtatcattctgctattgagcagcatagaatactctattttgggggagaaagaatatgtgaaataaacagagcaaatatgcaaggtaatttagtttaaaataaatgctacagtagtcataagaggcaagaattttctcaagttttaatagagggagcagataccttgactctactataatagaactaagatgggcatagaggcctgggaaggcatcttggataagtggaaagcaagatcatgggtgtggagctagaaatgaggtggatatttgggaaaagtttgtctcaaatataatggtagttgtgtccgtttaatctacttgttggggtttggagacttcttatttggaaggagcagtgatcatgatgcagcctaaggtccacttgaaccactcctttctgttttgagaaacaaagataccaaccaccagtgaaaataagatgctttgaatactcaagagaaactcattctcagcctgacctgcaatgtggtagagatgcttggggagagtgctgggttatgccctgttaaacagttgtagacatctcgacgccataagaaatcattttcctggaccagattgattgctttcagctgatagagtatagttttattggttcctactcattttgccattttatatttttatagacttgtcagttttcttgtcttcctttctacaataacatttatccagtagtatatcaaccttaaaatttgattgttggcatattcagtaatgggaatttagaaatccactttttattgatgtcctagaagtttgtatgcaaggaagaatcattaagcttgtcctttgatgatggacaaaatctagtaattagtatttttttttcatttttaattgtcaactggcttttaaactttagatctttttttctccttgttcttttcactatgctctaaaacaatagctaatctcagcttctatgaaattgatctttatttaaaactaagaatgtttagtcaaatgtggtaatgggttccttaaaggcacttatacatgattttgtggttttacttaggcatttaggtgatgctgcatataatttgtattaaagagaggccattagcaaacatatatagacttccttcatagatttcaaaaaaccattacccaaataaatgtatttttggtatttaaatattcctaccaagagttttctttgcagagttttaatcaatatgattttgtattcctcctcttttatcctttctacttgttgttatcacagtgatagaaaaaaaatgaggaagtaaaactccaatttagattttgttcctacccccaaaatagctaaaaagttgatggagagaatgttaaaattattagttaaaatgagactgtgagagtatctgtggaaaggaaaacgttaaggggtgatcaaactgttagaaaaggagggatggtttccttcagagaacaagaagatcatatgagaacaagattgaattactcaaataagtgaaatataccctcactttgttttcaagcttataggccacattaagaacatttctgtattatacaaaatgggtgcaacatttatcccttgctataaccatcaaaataacctgtgttgagtgctttgctctagcagtctaacagaaatatctgacatccttaaatctgcaactcaacaggctaaaagaccggaaaatagatttctgcattaccagtcaaacactcagaaccataatcaaactttccctttctgttattttactggtttttcttaaaatgtcaggaagtatgattagcttcacaaatcttaaactattcagtttctctactctcctcccaatacttgtaaggaacttagagtgttttaactttgatctcccaattactacataccaaattattgtctgtcagtatttagttctaccttacttccacaattcctccattagccattatttcttttaatatttacagttagtgtttatttaaattcactagcaacttctttgcttgccgtttttttcttacatcctactccatgccttttgtttaaactacagtgtatccttttagtgaagtttttataagcaatgaactctctcagttttatttttttctgagattgaaatttcactttcactggtttaatgatgggttagctggatggagatatctcagtccccaccaacaacctcagtactttaaaaatactactccatttggtgctgatgagaagtctattaatacaagtttgccagggggataaatcatggaagagagaaaggaaacactttatatccaaaggctcagagattcaagagagtctaggtgcctggggacgaccatatcaatagctcctgtcaagtggaatgctataaacatcaaaggaataggtaatcctctgccctggcctcttgcacaggcacttgtgccctcaacacactgagctccccactttcccatgcaagtttcctgatgattacaaagagatgcaggacctatgggcttagggtctgtgacagaactaccaggcttgggtaaagttccagcaaacagccccaccgtgcgcttcatcatttcataaatgcgtatcagtccagatgctaaattctgaaactggagaggaaagaggaataaccaacttaaaaaaacaaaagcagttctagcatgccttttagcacatacttactgattatgtgccagaaaatatgctgaggatacagcagtgcacagaccacatccctattcatgtgtatcttatgtgccaaagtgaggagacagaataaatgtggaagccaatatacacctaatgtctaaaagtcatcaatgttctaaagaaacacagcaaggtgagtggacagggaataattggagagcacttctttacttaaggtggggtcgagttggtattaagaatgagacccaaatgataagaaggggctagcctcatcaaggaaagaggttaatgagtgatccaggccaagggcagaggaattgcaaagcctctatggcagggacatgttgattatgttcaaagggcagaaaaaaagcagtgaactaggggaagagtcagaggagataaggccagggaagtggccaggggtaatgtcatataaagccttgtaggccatgccaaggggtttgggttttcttctgcatgacatgggaagccattggacagttttaagtgagaggcaacacaatcagatttcagtttttaaaggcttgctctgatgattatatgaataattgagtagaaggggctgaaaatgcagaaggggagatatattgggaagctattagaatctagcagaggagtagtggcatcttggactagggttgtggctgtgaggatgatgagagtgatcagatttgggacctgtttttgacatagagctcatgggaactgctggtggattggaattgagggtgtgtgggaaggagagatacccagattctctactgtgttcctggatagtaccttttattgagatggagaagattaagagaaggaacagaggtggaaggatgagtataaagagttgcagttttgagggatggagggatgagaatggagatactgtgtaagaatggtttgttgaggagtttggacatgatcctgtctggatccctgagttagtggagttttagacattagtaagtgacatggtcagcttatggtatgtaaatgcagctgagagtccagtgggagcctcaaaatattgactggtgctcttgaatcacattacattttcaattagtaaaaagaacctgactgacttaccaggcctggtaggacatctcatcatttttagctttaattctccttccttttctcttctcccattttttttatctccaaaaccgagctcctttcatgagaataaacccagggcatatgcacatatactcacacgcatagacacttacatattcatatacgtacataactgtgctatttctaattttctgaccaaaaatgagtgacctcacttagggaggtggactagctagttgtctgcttcatgcttctaattgcaggcaatttcttgagggcggtgggaactagttatccatttattaattaccttaagaaaagctaaaaatattctttttggggtaaatacactgcatagaaggttcttttttggagaaatccaagatggagggcatcctgagctggtatcattcagttcattcttgtcttggcccatcatgtacatagttttgaaacttctttctctaattctggcagcttcctggtttgagatccagaaagcttttctgggtatgtgtatcgtggaccaagtagcctcagtttctcatgaaatcttgcaagcatttcaagaatgtcaactttggcaagcattctccccaagaaatggagagaattgtgccgatatggctggctttttgtgctaaggaaagggatgataaagtgaccttacccagcacctggaaggatgccccatgggatatgagtgcagggtatagtctggacagggtgctatgctgcacatgacagggggattgtaattggcttaacaaccatgacattgaaatttgtatttaaatacaagcttccatttccccatgtttctcctactcatgcatatcaaccttagcctatagccagtaactgttgagtttctacatgttcttataacccaacccccccaaaaaacacaagctttttttctcatctgagtctttccaatatgcaagccaaagcagcaactgacttagccttgaataaaagactaaataaaagctagagaacctgagaaaacatgagagacacagcattgaatctggtttctaattccatggacttgacggctggaatcgtgatggagcagggaggggaggccagtcccaccagtgtgaaagtaaacaccagaaagatttttcctcagtaaaaggagatgttccaagcattttagtgtgacaacctccttctgagcctttgataggggcatagaagagagaataagagagaagagaagggaggcaacaataaatcaccaaagagcttttgtcaattatttctccctcaaactgccaattgcacaggaaaggcagatgacgcaaattctctcctttccatctataaaattgctctaatattttatgaagatgttaaaagaaatgattctcttttttatcctctccctctcacgaatctcccccttcccaacaaacttggggcatttaatcacctctcaatattatttaaaccttctatgaaaaaaaatctatgaatgcttcaaaatagtaaaaggacacagaggggaaaaaagggagtctggacacattgactgaaggtgaaataattctttgtgtttctttttcaaagaactgggacataaagtgggtgctgggcctttcatggtccttgcacttacatgtttgcctcagtgagtgagtagaaggaaatgagacaaaagcatccattgaatccacatataccaagcgtctacttagcacgtggtaaattgcctggcctggcccccactagatgttcaagaaatatttatgaaccaactacttttagctttgaccctgtactagtcactgatgacgcataagtaaataatataggtagtgcttgcactcaaacaactcatacattttaggtagttaaagggtgtgcaatggaatgctgttcataccccctccctttctcctgcttgtttgcagctctactaggaagtcataatttgtattgttgttgttaatgtcagaggatgcatttttaaatagaagagcaaatatgcctcttgtagcgggagaaagatcccatggcatttatttaggcaagtgggatttaacttcagaggcagctgatgttctgtctaagctttgtacatgtggtgtgatttgtcagcagtgctactgaaagcctgagagggtgttccctgatccatgaggtgtttgtgagagtcctatgaatatttgacctcatcaagataaaacaaaggtatgggcttttgggttcctttatcacagagataataattctgattcagatctgaatctggaccagtgcccaggctgtgaagtgcattcttatgacaaattgccatggctgatcatgcaagccctagatgtggtgtgagggctgagactcatcaacctcatagtagtttggtggtgtgaactctttggttctgtgcctgctgtgctcagcttaatcagcaagtgtgcccagcctcagacggacccttaaagtcttccagatccaacacgatggaaatagtgctggcccagcagacagagatatgacaagtgtgtagcatctgctgtggctggctctgcttccctgatgcttcactggtaggtttttcttctagattctcaacaactctacctgatgtcatgtggccttagaacttgctcacataattgttcatagcagttagtgatcaacagaatgtgaaccattccaagactgagatccatattcacttagccaagcaaggctgaatagagtcccaggcccttccaatatgcaagccaaaggagcaacagacttagccttgaataaagaaaaaaaaaactgaaaataagctgggcgtggtggctcacctctgtaatcccagcactttcgtaggccaaagcgggcagatcacttgagcccaggaattggagaccagcctgggcaacatggcgaaaccccatctctacaaaaaatacaaaaattagctgggcatggtagtgtgcacctgtagtcccagctactctggaggctgaggtggaagaatgtcttgagcctgggaggcggaggttgcagtgagccaagatcataccactgcaccccagcctaggtgacagagccagaccctgtctcaaggtgcattttctgtcttgcctctgaagtggccccaacatgtacatgctacacgtcccgtgttcccacccccggaactttagactggatccaggatttaggtgctcaccgtcatctgccatcatctacgtgatctcattacttttctgtcaaatatgccatagctactgcagtggtgtcctgagggataggtagggcacattcagacagagtggcacaggtaaggttgagggaggcattccaggaaggaggaatggcatgtaaaagtgtcagatgtcgaagggcaattattttcccatttaacaaacaaggacactgatgtttagagaagttagacatcctgcttaagttaacatagctaaaagcacagccaagattcaagctcaagtctgcctaactccaaagcctgtttatttgtacatatgctgtcttatgaaggatagggtgaggagtttggatatatcttataagaagtcgggagccattgaatggttagagaggagacttagatgatgaaatcaatgttttatgaagattaatttggcggccatgtgcaggatggattaggaaagtgagaggctagaatagagactggttggtgaaagaaaagtataggtgaaaatgatttatgactcattattgtgtactgagctattgatatttaattcccctatcatagtatttatctcaagtatattttttaacttttattttaaattgacaagtagtattggtacatatttatggggtacaatgtgacgttttgagatataaataaaaatatatatacacacacacacaaattgtggaatgattaatcaagctaattaacatatccatcatctcatatacttaccatttttatagtgagaatatttgaaatttactattagcaattgtgaaaagtacactacattattattatagtcagcatgctgtgcaataaatctcacaaatgtattcctcctaattgaaatgctgtaccctttaatctttgtaccctttgagcccaggagttcaagaccttcttccatccccaacctctgataattcttctctctatttctatgagttcaacattttaaaatttcacatgtatgtgatatcatgcagtatttgaccttgtgtgcctggcttatttcacttagcctaagtttttcaggttcatgaatgttgtagcatgtgataaaatttccttatattttgtggctgaatagtattccactgtgtatatatgtcacattttcttcatctattcatccattgatggacattcattgactccttatcttgcctattgtgaataaaactgcaatgaacttgggactgaagatatcttttcaacatactaattttatttcctttggatatatacccgtgtgaaattgctggatcatatggtagtactatttttagtttctcaggtacctccatactatttttcattatggctgtaccaatgtacattcccactaacactgtacaaatctcttatctatgtgataatgaccatcctaacagatgtgaggtgattacctcattatggttttgatttgttgaataccttttcatatacttattggccaattttatgtctcctttgggaaaatgtctatttgaatcctttgcccattttttaattagatgatttggggtttccttttttgtttgtatgaattccctatacattttagatattaacccatcagataaaagtgtcctcacccttcctcccaacacacacatacatggtaactgtggatggtgatggatgtgctgatttgattggtgtaataattacaccatgtatacatatatcacatcatcaagttgtacaccttgaatatatcctgtttcatttgtcaagtatacatcaataaagctggaaaaaataggttgtcaagtaagggagcccaagaaaagtatcaggtatatttacagagccaaatcaggtgtttcacattcccagtatggatgtgtagcatgtttatactctgggttacatttattgatttgcgtatgttgaacctgccttgtatccgagggaagaagcccactcgatcatggtggataagcatttgatgtgctgctggattcggtttgccagtattttattgaggatttttgcatcagtgttcatcagggatattggtctaaaattctctttttttgttgtgtctctgccaggctttggtatcaggatgttgctggcctcataaaatgagttagggaggattccctctttttctattgattggaatagtttcagaaggaatggtaccagctcctccttgtacctctggtagaattcggctgtgaatccatctggtcctggacttttttttttggttggtaggctattaattattgcttcagtttcagaacctgttattggtctattcagggattcaacttcttcctggtttagtcttgggatggtgtatgtgtccaggaatttatccatttcttctggattttctagtttatttgcatagagttgtttatagtattctctgatcatagtttgtatttctgtgggattggtggttatatcccctttatcattttttattgcatctattggatttttctctcttttcttctttattagtcttgctagcggtctatcaattttgttgatcttttcaaaaaaccagctccttgattcattgattttttttgaagggttttttgtgtctctatctccttcagttctgctctgatcttagttatttcttgccttctgctagcttttgaatgtgtttgctcttgcttctctagttctttccattgtgatggaaagagaagatactacaggtcctttagtctttcctccgaatcccccgagacccggggcattttgaaatagagaacacttttgtgtattagaatggtaaaaaagttggattaataaagacagtaagtttcctcctggcagttcagataaaattttgctgcccaataagtccattcggctcatataataccacagaaatatgtcttttctatgtagaactttttggagtttggaattactaataacctcgtaaggtatggtagacctgtattataccaataataatgaatgtaaacatcatgaatagaaaaatatgagctctctgcttggctcattcagatcatgactctgattagtgcattgaggagcattttgtggacaggctggagtcagcattacaattgtgagtctgtttacccataatagctcctatttttgagcaatatgtgggtgtctatgctgggcactatacaaggtggctcaccttacaggttgcacaagtaattcagacttatttcacgttatccacctagtgaagtgttaccaatataggcttcaggtgaagcttttctctaatacctgtttttttttccttacccttaagtgattgatgacatgaaatcattctcggacaaaaagctcaactccttgcaggaggcagcatagcagggtgaaggaagcatctgagtggtcatacctgacttgtcatttattaggtgactcttgggcaagtcatttcatctctctaggcatcagcttccctatctttaaaatgggggtggtaatcccttccgagcccacctgacaagagagctgtgaggattttgatagataataaataaacgtgagggcaccttgtaatctccgaggcaccacttcaacataaggtggaaaaattataagcgcaaggacaagcctcgtgtatcaatttgctatgaggcaaatggccaaaatggagtgagaaggatatctcaaaaagcaaaggatctgggtgtgggtacagggtgaagggaagatagatgtcaccagggaaagccagtcactcataccatctgaccttttcagccttctcagttacctccgaggtccttctcatatccctgggagtctcttaattgtcccctttctcttctaatccctgtgcttcaaatgttgcatggattttttgagctgcctcggtagctaccttttgtagtctgctttgtagcttcttacaacatcaccttcatcttcctctctctccctccctccctccctttctgcccacccccctttgcttcctccccacttgtatctatgtattcctgggtcttggtgggtagtcactaaatattggatgggtgcattcttagggcactttaaaccttagaggagacaaacattcatgtagctaagtatgtctaccacccatatatgctccccttgaattctcaactaggttctctagaacccactatatatgagcccccatctcctcttcctggcattcgagggctcatctaaatcagccaaacttataactagaggctccccactaagcaccagctattcttggcagcctgatccctggtcactcctttggaggcttctactcattcccactcccagacctctatattagctcaagttgtttccccatctgaaacactctgcctcctctgcttcacttattgttaagaatcctttagcccttacctcctgcaaaaaaccttcattgacacagtttatacagatcttgtctgtatattacttgtctctgctgaccttctgtagcactttaccctctgtaccactaattccctacttaatctttctctgcttcttgtgatatacatatatgtattgctagtatgaattgtttgctttgtgtcagacactgtacttaatattttacatcaataacacaacttaatccctaccattcagtgttatccatttgcccattttataaggttcagaggggttgagtaactttcccaaggacacatggtttgtaggtggtgaaactgaggtttaaactcagttattgtatgaattcagcactgtataactaccacatatttgggtaataatctctgccctaaaagtgcttgcactctagatgggaagataagacttggacatcaactcttatttccctgttatagactgtattagtcagggttctcttagagggacagaactagtaggagataatacacacacacacacacacacacacacacacatatgtatatatagagagagagacagagattggagtttaagtattaacttacacgatcacaagatctcacaataggccatctgcaagctggggagcaaggagagtcagtccgagtcccaaaactgaagaacttcgagttagatgtttgggggcaggaagcatccagcacggaagaaagagggaagctaggcctgtctctccttttcatgtttttctgcctgctttatattcgctggcagctgattagattgtgcataccagattaagggtggaactgccttccccagcccactgacttaaatgttaatctcttttggcaacaccctcacagacacacccaggatcaatactttgtatccttcaattcaatcaagttgacacgcagaattaaccatcacatggactgaatgtgtttctgacaaattcatacatttcatgcattgaggtcctaacctctaacgtgaaggtgttaggaggtggggcctttgggaggtaattaggcttagatgagttcatgaggggtgagccccagtgatgggattagtgttcttataagaagagaaaccagagcttcctctcttcacaacatgaggatacagaaataaggtggccatctgaaccaggaagtgagccctcaccagaagccgaacatgctgacaccctgactttggatattcagcctccagaactgtgaggaacaatttttttttctgttttttgagtcggagtcccactctgttgcccaggctggaatgcagtggcgcaatctcggctcactgcaagctccgcctcccgagttcacggcattctcctgcctcagcctccggagtagctggaactacaggtgcccgacaccacaaatttttttgtatttttagtagagacggggtttcaccgtgttagccaggatggtctcgatctcctgacctcgtgatctgctcacctcagcctcccaaagtgctgggattacaggcgtgagccaccgctcccggccacaaatgtttttttaagccactcagtctatggtattttattatagcagctccagctaagacatgcctctccattttgtatcaagttgcacacattaacagaaatgacaacagcaataataccaatcacagaaacatacatccattgaaggatctccccttaggaccttagaatggacctaggaacttgttttatgctcagtatttgtgagttgatcccaaagcccaattgattggttaataagtgaggggctgctgaaccttagtaaaggctagcatagtgtatcttagtttggcacatggtaagggtactgaaagcattcctgaaatggtgtatttcaacaccagactgagtgagtaagcaaaaagaatgctaaaacttcttcaagtggcttaagctctctgtactttaattatcagtaaaataagaataataatagtaccttcctcacaaggttattatggggaataagtgaattaatgtatgtacaatactcaatacctggcaaagagaaagacctatttttttttgtcattggtatcattgctgttgccattgctgttaatgtgtgcaacttggtacaaaatggagagggctagtgttaataatgacaccaatgattcatatatctcaaggaaagagaagcactatcactatcttatatgtaactcggcactgtacttgccacataacaggtactacaaaaatatttgtagaatgaaaaagtcatggaatgatgtcaaaccctcacagtgctcaagtatctacatagaaaaagttcaggccgggcgtggtggctcacacctgtaatcctagcactttgggaggctgaggcaggtggatcacctgaggtcaggagtttgagaccagcctcaccaacatggtgaaaccatatctctaccaaaaatacaaaaattagctgggtgtggtggcaggtgcctgtaatcccagctacttgggaggccgaggcaggagaatcgcttgaacccgggaggtggaggttgcagtgagccaagactgtaccactgaactccagcctgggcgatagagtaagactgcatctcaaaaaaaaaaaaaagttcaaaagggagaggttgggtaacatattcctctcatgttaaaatgaatgggtttccaatatacactaacatctagcctctctctccattctgagctccgaaagcccgatttctggctcagtagtgcttattgcttccttttcatggcagacttttctctgttctagccttgatatacagttctaaacaaggatgccaccgtaataactctttgctctggcatatgaatgagaatgatttttcatggagctctctccatgcctgctgcttagagttatttgtcatttcttttatgggccatttcaagagagccaggctatgggatgggttgtgaaagccacctgtgttgtcttctctaagacaccagggagatttgatgggttttcattttctaagattctaaggagatgtttttatcttggacagactgcctgttgttacccttggggtttgccatggtgacaccaaatcaaaggatttttatttgcttgaaaggaaaaacaatcaaatattcttgctgggaggtctttttagtacatctggtccaaattcccatctaagggtggggaccatgtttgccttatttccttttgtatctctagtgcacatcactgtgcttggcatagagttgttatgcaacagacatgtgttgattacataaatattttgcagagggaagaaatgctttgtgttactagcctatttggatttggccattctcttctgtagttcagcaaagaaggccttttctctccccctacaccccaaccctggattatcctgctctcttctgcaccaacagacatactttgtatccaccattagagcactcacgatactgtgatatttgttttcgcctgtctttctgttcccactcctattcctggggctctgtgtctgacagtgctgagcacatggacatggttggtgctcaaaaaatattagttgaatgaatgattctaatgcccatggaagacagcaaaaataattacagtgtcatgcatcatatttatattgcactaaggacttcttgtggacaaagatatcagaagaatgatggcattcatgagattgctgctaacagaatggttgacgatagagtttcttcatttggaacgtaggcatgataatactgaattgcaggaaggttgtagagattcagcaggaagatcttttaaagggtgctgctgactcatgacttttatggtagcaggtggaatttttttttttttctttttcttggtcctatgagcaggtagaaggaagaagaaggaaaaatggcagtaacttgggaagcaagcaaagacaacacctcttctctctcctcacctccatcccctccccgccacccttgataagccaaaaggagtgctaaatgtcagctgccaaccttagggagcctgagaatcaccatcacagataaagacctggtgagcatgggtcttagaagacccaacagtagagcactaagccaggttccatgctaagctatagatataggtggctgggggctcaaatcctagaagtagaagagatagtgagagtccaaagacaagaaagttagtctcttgggatcataatgaaacagatgggtgctcacaaagactgaggtggagttctggccttctcaatttcagtatctgagaatattttatagtgcatttttcctgataaataataggacttgcaaagtgatattcccaagagcattggaatggaatgatacaactcaatggcgtattattattgatgtaggttagcaaatggccaaggttaacaaatgtagattagcaaatggccaaggcacaaaaaatagagtggtgagcaaggtagacatgggccctgccctgacagtctttatagtctagtaggaagaatgaaacaaccatacaaatgtaacataattcaagttccatgaaggagatatgggaaaaactataacggcaggagaagctctgaggagagaaagggccttttgagctgagaactgatggatgaataggtattaaactagaagggagaagaaggaggagagaaatcatgagagacattctattaggcagaggaagccaacataaaaaggcagtcacatttaagtgggataaatgctagggaaggaaaagagaggttactacaggagccactgctcagtctttaaataaccttgacagggaggcagggtaactatcatcatccccttgaatgcataagttgggactcagacatattgatttatttaatttatttaatgagtcattgtcaagcccctactagtttcaaatcattgtgctggggctggatgaacacatttatatattgtctctcccctctaggagctttcattctagtggggaagtagcgggagtttatctgtgtcacaatgctggtaagtggtagggccaaaacttgaagtcttttgacttcaagtccagtgctcttttcatggtgtcacattgcagctcaacaaggaagaggcctggttagttacatccatgatgacttggccggatgaggtagcttagcttttgttctaatagctgataaggatttccatagtgctaacttagcacggtgggaacttgattctattaaagtaaaattgaaacaaaaacagaatttgggtatagctcatctgtgtgacaatcatagctagcccttctggagtttgctgtgagctagacattgtacacatttcatatatttatttaatcctaataacaatcctataagtgaggtaaatacttgtactgatttgcccactttccgaatgagaatgctgagactcagggagataattatgcagcattattaagcttgctcagttagtaatttagggttataggatgcaaactcattcaatctgatgccacaacccatgatcttaaccaccatgcaacattggatctacttgccagactagaacaaagtagatgacactatcccagagacaaaggagcagtctgggataaaggccaaagtttgctcttcctggcaggactcccagtcatagttgtttaacaggtacaaaagcacaggactggacttaaaagtgactattgaatccaggtttcctaccatcgtatccatagtactttgtggtcataatttacaaggactttatatctgcctagtgtggtggagtttttttttccaagtaattaaaactatgaaacacaacgcttatacttgctgaattttagaggcctactgagaggccagatttacctcaaaccatgtgtattattgtttacagagtactttcacatccatgatctcatgagatgctcacaacaaccctgaggagggttattcacattttatagctgagaaaacaaagctgagaaagcccaaggtcatgaaactactaaggttttggagccattgctgtgcacctttactatgggaaatgggtgaaatctaccagagcttgcaattctgtttttgtgtcccaattgaaatgaatcagttagtaaaacatttggcttttcaaaatactaggatttctttttcattccagattcaaaagactgactccgtaagtattgactttgttcataaaacactgtattataaataggaatacaaaagtagcatgcattattttctaggtttcaaaataaatagtacataatggatgtctttagttaataaaagctacttggatttctgttcagatgcagctcattggggtgggggtaggggctttggtcttttttagaatgtagaacgcaccttcattccatttgaatgtcatttttgcacttcgtaagtgaaagtacattctttcttatagtgccttgtccctcatgaccggcagaattggtagctttaagtattttcattctcaaaacaaacatgactcataacccatgtggatgcaatgactgtacttgatttggtgaacatttgaaaatacgaagtgggaataaacaataccattaccgtagttatttttttaaagggaaacgaatgcactggaagtggtgtagatgaagtacagggaaatatatgaacattggaattatattccagttagctcaagcttagggtagaagaaattaaaattaaggaaatatttattcatctatttaacacatatttaatgaacaaggcattgctctagacactggagatacattggtgaagaataataataaagatgaaaattcatgccctgttggagttaacattcaagaggggccgtaatgggtggtagtattggcggggggggttagagaagccctcatggagaagatgacatctgaataatgaactaaaggagttaagggaggatgtaacgcagatacatgctcacagagagctccaagcagagaccttgcaatgatgatatactccaatgtggctgaagtagagtgagcaagacagagaataatgggagatgaagtcaaagaagtggccaggagttggctgacccatggaaagaagtttacaaagtaactggtgatattcaactgtgtagtggacactgttgatcccctttaccaggcagaggtacctatcccttagctacttggagcgttgtttgctaaagcttatagtcacccccttctctatagcagaagcactgggggcagcccacagccaatgactggctcaaccccttggcctcaaggtgagaccaatcctatggttccattcatggtcctgagcttctcctggggtcagttagagctagactccaggtgagaccacagccttgcttttttagttccttcatttccccttccttcttaatcccattctaccccaaataatccatctcaggatctgcttctacctaaggaacctgacctaaaacaacaaactttcaacaacataattttagaagctaatatgctgtatttttctctgcaagtgtcaactttgagttatattttattaaactaggcaccctgatggtaaggcagatcattcttgccagtctaaaggagctaggaaagatatttttgaactagatggctaatggtgccattttcgacatctgtgaatgtctttctaattctgtcactcagtaaaggggagcattttaactagggtctcaatggcatggtgttgcagcgattgattcatttttacattgataagtgaatccacaggaaggtcccattagatgcctccttttagttatttgaaatcctagtcaataaatatcgacttccttcctgtcctcttgcaattgtgtgtgtgaatgtagtatttgtccttttctgagataccctagtgctttatgtcactttgtctttacgtcatttaattgatgatatttctcaataatagccaaccaggagccaagacaataaaaagatattccttgtatcaactttaagaaggggaaataagctgtggctggaaaatctgaactaatctcaataataccaagtaacaaatttgacttttctccacttctcactagtttgggcaaatggactttgttattggggacaaggtttagagaacaaatactttgggtaacaggtgtctgcttataagtatgaactttagcaagcagtgtgagaaaattccaacaggaggccctctcccttgcatgggctctgaatgagcaaatccaagattgggaaaagctgctccaactctttgaggttctccactacccatctttggcatgtgatttgaccatggtcctgaggacatttgattctccctttcacaaaaccacttctaaggtataagaccagggaaactcatattgtataatatactccttttgtctggctctctatttctccaacacctgtagtagtccaaatggtgtgaattgccctgtctcttgccttaattaatactatcctgtgaattaggaaatggagtcacaattttttccagtttgcagatgaagaaataaagactcagagatttaagtgacttacccaagatcacaaagctagcaagtggctaagtcagaaatagaccccacgtcttctaactgctatacccttctggagaaagtgtcagggaaagataatgacttattttttagcattttgcttgttaatatgatcattttacttcttctttgtgtggggatgccaatgaatttccatttattcaagccaaatctttgttttctccaaataatttgctgaggtagtgctcttctcattaaagccccctgaagattggctgtgattcccacagagtggttctgtgagctctgatattctggattgtggctgtattattcctggatctcattttacattgcttttcatcagatgtaagacacctatttctttgtctatctctgttatctgctagcatatttgccaccttctttttattgtcttggctcctggttgactattattgagacatatcatcaattaatcccatacaccattgtatgagattttcagtaaccatgactctatacctccgcttcgtggtggcatgccttccatccccttaaagtgattgatcttccctccattagcctgtgcttgctcttctaaattcaaacttggtatcccagtttggacatgagctcaccttatgacctgaagaaaagctttcttttatgaggtaggatcacatgtactcgtctctggtcctctacccaatatctaattcccatatgttggctaagatgctgctgtatacaattctggctgacagagatgaagttgggctttacctccaaatcagaggcgattacttctgcaatctcaggaatagagaggaaatgttcacactaggctgaatttatttgtttggtgcatggaaaagttgcagtgaaatgagtgctgacactgcagcagaaaacttctttgttgaagctgatgcaaggcttggacagctgatgccaaagatgacaacactgtaatttgcttgatccatgtgtctgtgcttcttctttacatcatatctacttctgtgcctgacagtattccataggccagtggtggctgccactatcctagaggcagagaggatagacaagttttggggggcaggtttctctatcttttctcctagcctcaaagcctgtgatctagggcagaggttttcaaacctctgggatgaagagggaggcttgagggagggaaggggaaggaggaaatctagcagggattcctctttaacccttcctcaaacaagtttatgtattgagtttccatgcaagagtttgtttgaacaaagggttcggctgttgaagaaagtttgggaatcactggtctactgcactaaacaggttaacttctgtactgaaaccagcccaactgagtcctacaaaatgagagctgaggctaacagctagtttaccctggatggcttgagtttcctgaggtgtaaaatgaaaccatgcttcccttgatgtaacagcttacatagtggggagctaaaggttttgttggttatcctgaataatttggggctcctttgaggatggatgatagaagaaagttaattattttgagaaagttatttgattccaacctgataatgccaaacttcttctcataaaatgactgttaaatagaatcacgctgtacatcaactagacctaacaggcatatatagaacactccatccaacaacagcagaataaacattttttctcaagtgcacatggaaagttatctaggatagaccatatgttaggttacaaaataagtctcagaagtttaaaaaagatctaagtcatccaaagtatcttctccaaccacaatagaatgaaactagaaatcaataatagaaggaaacctggaaaattcaggaattttgaacaaccaatagccaaaacagaaatcacaatagaaattagaaaatacattgagattaatgaaaacacagagccacataccaaaacttatgggatatagcaaagggactactcagagtgaaattaaaactgtaaatacctaaattaagaaagaataaagatatcaaatcaataacctaactttacaccttgagaaactatagaaagaagaactaactagacataaagcaagcagaggaaggaaataataaagattagagcagagatttttgaaatagagaatagagaaaaacaatatggagaatcaatgaaatcagaagttggtcgtttgaaaagatcagaacaattgagaaaactttgtttagattgacaaagaacagagaagatacaaataacaaaaatgagaatgtaagtggagacattactaccaaccttacagaaatataaatataaagaggataatataaacaactatatacaaacaaatcagataacctagacaaaatgttcaaacttttagaaacacacaatctgccaagactgaatgatgaagaaacagaatatctaaatagactgacaacaagtaaggagatggaatccgtaatttgaaactacccaataaagagtccaggaccagatgactctgctagtgaattctaccaaacatttaaagaagaattaacaatgatcctgctcaaacacttccataacatagaagagaagggaacacttcctaattcattcactgaggccaagattaccctgctacaaaattggagaggaagaataaaactgttttttttgcatgtgacataatactatgtacagaaaatcccaaggaatccacaagaaagctactagagataataaacaaatagagcaaaattgcagggtgcaaaaacaacatgtaaatttggttgtatctctaaacaccaataatgaaaaatccgaaaaggaaattaagacaacagttccatttattataacatctaaaagaataacgtacctaggaataaatttaacaaaggaggtaaaagacttgcacacactaaaaactataaaacattgctgaaagagattaataacctaaattagtggaaaggcatcctgtgttcatgaatagaaagacttaataatgttaagatgtcagtactactcaaagtgatctacagattcagtgcaatccctatcaaaattccaatagcattttttacagaaatgtaaaagctcatcctcaaaacaatatggaattacaagggcctcctatatagacccctatcatgaaaaagaagaacaaagttggaggactcacactaatagatttcaaaattttctataaagtacagtaatcaaaacagtatgatactggcataaggatatacatatagactaatagcgtagaattgaggtttcaaaaataagcctatacatctaagataaattgatttttgaaagagtgctaagtcaattcaatggagaaacagtttctttaacaggtgctgcggagtcgactggatttccacatgcaagttgaacccatatctcataccatatgcaaaaataaactcatctagtgtttggttttctgttcttgtgttagtttgctgagaatgatggtttccagcttcatccatgtccctgtaaaggacgtgaactcatccttgtttatggctgtatagtattccttagtgtatatgtgccatattttctttatccagtctatcattggtgggcatttgggttggttccaagtctttgctattgtaaatagtgccacagtaaacatacgtgtgcatgtgtccttatagcagcatgatttataatcctttgggtatatacccagtagtgggattgctgggtcaaatggtatttctgattctagatccttgaggaatggccacactgtcttccacaatggttgaactaatttacactcccatcaacagtgtaaaagcgttcctatttcttcacatcctctccagcttctgttgtttcctgactttttaacaatcgccattctaactggcatgagatggtatctcactgtggttttgatctgcatttctctaatgaccagtgatgatgagctttttttcatacgtttgttggtcacatgaatgtcttcttttaagaagtgtctgtttatatccttccaccactttttgatggggttgtttgtttttttcttgtaaatttgtttaagttatttgtgcattctggatattaaccctttgtcagatggatagactgcaaaaatgttttcccattccgtaggttgcctgttcactctgatgatagtttattttgctgtgcagaagctctttagtttaattagatcccatttgtcaatttgggctttgctgccattgcttttggtgttttagtcatgaagtctttgcccatgcctatgtgctgaatggcattgactaggtagtgggagttgaacaatgagaacacatggacacagggaagggaacatcacacactggggactgtcagggggtggggggctaggggagggatagcattaggagaaatgcctaatgtagatgacgggttgatgggtgcagcaaaccaccatggcacgtgtatacctatgtaacaaacctgcacattctgcacatgtacccccgaacttaataaaaaaattaactaacgttaaccaatatctaaatataagatctaaaaccataaaactcttagaaaacataagggtaactcttcatgaatttggatttggcagtgggttcttagatattacagcaaaagcatgagcaacggaagtaaaattggattatatcaaaattaaaaatcgttgtgtatcaaagaacattatcaagaaagtgaaaaagacaatttacacagtggatgaaaatatttgtgagttgtttatctgataaaggcttgatatatagaatatagaaagaactcctaacagtcaacaacaaaaagacaaaagaaaattgaatggacaaaggacttaaatagatatttctccaatgaagatatacaaatgtccaataagaacatgacaatatactcaatatcattaatcattagggcaaagcaaataaaaaacaaaatgagagaaaattttcgcaacctactcatgtgacaaagatgtccagaatctacaatgaactcaaacaaatgtacaagaaaaaaacaaacaaccccatcaaaaagtgggcgaaggatatgaacagacacttctcaaaagaagacatttatgcagccaaaaaaacacatgaaaaaatgctcatcatcactggccatcagagaaacgcaaataaaaaccacaatgagataccatcgcacaccagttagaatggcaatcattaaaaagtcaggaaacaacaggtgctggagaggacgtggagaaataggaacacttttacactgttggtgggactgtaaactagttcaaccattgtgaagtcagcgtggcgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaacgatagactggattaagaaaatgtggcacatatacaccatggaatactatgcagccataaaaaatgatgagttcatgtcctttgtaggggcagggatgaaactggaaaccatcattctcagcaaactatcgcaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgttaaatgacgaattaatgggtgcagcacaccaacatggcacatgtatacatatgtaacaaacctgcacattgtgcacatgtaccctaaaacttaaagtgtaatgataataaaattaaaaaaaaaatgagataccacttcacactcattagggtgtatacttttttaaaggaaaataagtgaagatgaggatgtggagaaactggaacccttatgtggtgttggtggaaatgtaaaatggtacagtcactgtggacaatagtttggcagctcttcaaattgctaaatagagactcatcatctgattcagcaattccattcccaggtgtatatacacaaaataatttaaaacagggactcaaacagatatatgtatgccaaagttcactgtagtgttactcacgattagctcaaaggtggaaacaacctgagaatccatcaatagatgaaaagataaataaaaatgtgctgtatatatgcacaatcgaatattattcaaccataaaaaggaattaagttctgatacatgctacaacatgaataaagcttgaagacattatgctaagtaaaagaagctagttaccaaaggataaatactatgtgattccacttaggcaaattcatagagataaaaagtagattttatgctactaggggctgggggaagagaaggatagaaagttgttgtttaatggttacagaatttgtttgtggtgatgaaaagattttcgaaatagtggtgatggcttcatagcatggtgattataatctatgccactgaattgtacacttaaaaactatttaaatggctggtttcacgctgtatatattttaccacaataaaaaattcccattaaaaataaagttattcaaaagtggtttcattatttaaaatgaagcaaaagtgttttcacgtctttttctctaatagagaaaataaagatgatcacaaatgtgtcccttctatgaataaaaatgaaatgttcattaaaaggaggcttttttcctttttttttcttcatttcttcttaaaaaaaaaacagaatacatgtgcagaacgtgcagtttgttacataggtatacgtgtgccatggtggtttgctgcacctactgacttgtcctctaagttcccgtccctcaccccccaccaccccctgacaggccctggtgtgtgttgttccccacctggtgtccatgtgttctcattgttcaactcccagttataagtgagaacaagcggtgcttggttttctgttaaaaggaagcttttatatttcatatttaaaatgactttttgatggaagaaatagtaccgacactttatttgctttacttagattctattaagaaatttttcttttgttgtatcctttctgaggtaactaagtattgagataattgtttatctttatcatggtaatctttatagaccacatagagagatccatcttaaatattctggtccatcaccatagtttgtttcttcaaacttaacactcaaagtctcaaaatgacagcacatttggggctagtaaactctctgccagtgaatgcttagaggacgtagcataggtagctcagtatctcacaaggcctacggctgtgctcttttctggaggtcagcatcctcttctaagctcatgtgattgttggcagacttcagttgtttgtggcaataggaccaacatccccatttattgctggctgtcacacagggcctattccgagctcctagagacttcccaaagtcccttgccatgtggccccctcgtaggcctgctcacatggcagcttacttttttaaggcctgaaggtaaatctctcttttaatgctttcacttgattaagtcagacccacccagattagtgtgccttttgatgaactcaaaatcaactgatcaggggcatgaattacatcttaaaaatcactttacctttactatattctattggctaaaagcatatcagaggttctgcctacattttaaggtgagagggttatacaagggtgtaatccattgggcatcattctagggtgtgtccaccacaatgtggaactatcaccctgtattgttgagagatggaaagaagagaactgatttttacaatgaaaaaccaaagcagccatgtcaaacttggtaaaagaaatgggcaagtggtccctttatgtgtttcagcttcccatagtgtgcgtttgcttcaatcagggttctccagagaaacagaaccaataaagtgtgtgtgtgtgtgtgtgtgtgtgtgtgtgtgtgtgtacaagccgatagggagataataataaatcagactttcatggttatgcaggtatgcaagtcccaagatctgcaaggttagtcaacaagctagagatgcagaagagctgatttatatatctaatccaagtccaaacgcctgagaaccgggagagctgatgatgtaattctagtccattggctggcagtgctgagacacaggaagtgccagtgtttcagcttaagtttgaaggcaagagaaaagctgatgactcagttcaaaggtcaccaggcatgaagaattatttcttacttaggagaggatcagtcctcttgttctattcaggccttcaactgattgggtgaggcccacccacattatggagagtaatctgctttactcagtctaccgattaagaaaaaaaacactcataggcatacctagaataatgtttgaccaactatctgggcaccacatggcccagtcaagttaacacataaaattagccatcacattgtccttcagtaatcgcatgtcatttcccctaacaagtgacactaattcagttattatgacaaatggactcaaccagtttctgctattccaataaaccagtcaaggatgagtggcctccatcaggctgtttcctgcatctgttgctggagtacattacaggtgtggttacaaggttttaagctgtgtgtctccagtgaactgctggactgctgggagaagagaagtaagctgcactttctttcttttcttttctgtttttttttttttttttgagacagagtctcgctctgtcaccgaggctggagtgcagtggtgcaatcttggctcactgcaaccttcgcctcccgggttcaagtgattctcctgcctcagcctcctgagtagctgggattgcaggcacgtgccaccatacccagctaatttttagtagagacggggtttcaccatgttggtcaggctggtctcaaactcctgacctcatgatccgcccgcctcggcctcccaaagtgctgggattacaggcatgagccacctcgcccagtcacaagctgcactttctcaggagcagagaggctaatatgaagctaagtacagagagaggcccgaggctgcttgtagtttcccagctaggcatgcctattgcctcctctgtctatttgcctttgccacattctccattcattaggactgacctaagtatagatatcaaaaagagaaccaagttactcttctgctgaccaggaatttggtaaggagctcccaatgttccctgcagagaagaggaacttacagagaaatggcctgctgaaaaaggctgacaacccaaatttgcatgtaagtcagtccatgatcattgctgcttcttagatttgagtgtgacccatcctgctctcttgcccaaaacatctttttcaagcttgccataacttcacctaatgatcgctttgccagatagagacttgcgtcaagtgatgtcttgagtagcttagaatatctcatatatagtaagcttgtctttgagaggctgtcagttaaacaggtgttacaaaaagccgttggggaaaaaaaagagaagaaagaattgccctctaggcaactcttaaaggattgtgattattctgcatttcataggaactctaaaagtatctcttttaccactcagcaagtaagcatctaaattggctgggagataatttacgtggaactttttgccctgtctttcttgagtctaatcttaaattctacttaactgtccattaaggaagacgcagagagctgtccttagtatgagaattgggaaatggttttttttttttaattttactttatatatatatatatatatatttattatactttaagttctagggtatgtgtgcacgacgtgcaggtttgttacatatgtatacatgtaccatgttggtgtgctgcacccattaactcatcattttcattaggtatatctcctaatgctacccctcccccctcccccccaccccacaacaggccccggtgtgtgatgtgccccttcctgtgtccaagtgtcctcattgttcaattcccacctatgagtgagaacatgcggtgtttggttttttgtccttgccatagtttgctgagaatgatggtttccactttcatccacgtccctacaaaggacgtgaattcatccttttttatggctacatagtattccatggtgtatatgtgccacattttcttaatccagtcgggaaatggttttactctggctgacatttttgaagcttgtgaaaactggcatgtttcaatttctagaagacaccaataaacactccccaaatgaccagtttctcaacatgaatttaattaatgggaaaatcggaggcacgtcaggagagactcactgacaggggccactggaaaagacagggaggtaagatttgggaagcttgtgctgcctcccagtgtggacattactccaatgccattcaagaagaatgaattcacagctttatttcccctttgcgttagttttcctgttcccatgtatgacctacattatctttcccacgtccttattgctgctttgaaatagagattttgacagagcttcctgtgggactacaagaacttcagtcaataactagtgatttccatggcagcagaaggtttttaaattaatgtggcagtctgtaccttccatctgtgaaggaccaaaccggcactccctcacctctctctttccttctacctggtgtttttaccattcctccttccaatttttttctggccttatagtgcaggtctcctggtactgatctggaccatgaaacacaggaagccagagccaaattggccagcaaagcttcacgttttgtagaggatttaggcttctccaatactatgaaggccatgattctgagcattcacaaatattgctgggagttgtggcagcggagcacaaaaaaacctcaaaacgttctttttctccccctgtctaagttgcaaacaaattaagaagtaaaatgagaacagtgtataaaaagcaattggatagacgtaatcacttggccacagaaaatcctgagtgacagtagacccttgtccccctcttccacccctcacttgtcacaaaggccctccccctacaaacttaaggcataaaggagcagagaagaatgaatgctttctccagtgagctgactcccaaggagaaagtaaaaaggaaggagctgagctaggaatgctagtttatcttttgaaacctcaccagtcagtctaccacttccataaaagagtgaatcatgggccagagggaagccagcactgttatgctaatgcgattcatatcaaaaacagtatcaagaagagggaagaaccccctgccccatgtaagctctgaaaaaaattagaggtcatctggtcaactccagttgaggaaatctggattcacacagatgatgtggcttattcaataaggagtagagcttaggctgatttaggctgatctagaggacagaaacaagaatggtgtaggagttctagagaatcagtttttcaaggatgttgttttgcaaactgcccatcatcatttccatcactgccatcagtactctcctgcaatgttaatatttgccgggtacctatttgatcacattctacatagatagatttagtgcaatgagacaccacaggagagagctaactgtgggatgtctctcctccttgcccaaagagtagagttagctaatccacagtaattattttccgtttgtgaaatgtatatcccagggagttattattatcaaagggtatctatattaaatagtgtcattagatgctgcctgccatcagccattacttctgttcatcagagttttatattcctagtgtgtataaccagaatctaactacttcttcccaactacacaactgccactggtcctaactactgtcacctgttgcttagattatagccgtagcctcctaaccagtctccctgcttccatctttgcgccctgcagtctgttctctacatagcagcaagagtgagcctttgaacacataagccagctcacatcattcttctgcctgacactatccagtggctgcccgccagtcagaattaaagccagagctgttacaatggcctacatgagcagacttccttttacccttctggcctcatctcctacctctctcctcttcaatctctcagttcctgccatactggtctccttcattttctacaaaaacagcaattcacactcctatctcaggacctttacatttttgatacttctactggaaactcttttctcctgggtatctctgtggctcactcccttccgcacttcctccagcctctgcgccaatgtcttcttcttagtgaggacttctatattatgtagattaggctgaattatactgcaatagcagaaagctaattgacacattaggaacttaactcataaatagttatttctcacttaggtggatctagcagcaatttggagcagcttctttccaatcagtgactcagatacccttggaggtctcagcttaacaatttgtttactgtctctttactcctcaccaccctcaaatgtgtaaactatatgaaagcaagaatttttgtctgttccccccccatcttctatatactgtatgctttgaatagtgcctggcatacagtagatttccaataaatatttgttggaagaatgttgaaaggtagtgagatgagaaggaatggaaaataaaaacctcaaaggaagcttctttgtgtgtatgttttcttctcaggttaaatacagtgaagctgtgtcaattctgcatacaatatttggttattgttataactatagaaggcatgtggactttaaaacctacttaggttttcagtatcaagatttgaacatttcatttgttttctattgctgccataacatattaccacaaacttaggggctcaaacaacacaaattgattatcctacatttctgtaggtcagaaatcagacacccatctccctaggccaaaattaaggtcttggcagggctgcattcctttttggagactctaggcaggatctgtttccttgctccttttgatcctcagcacgattcaattccttgcggaatggagatctctgctttattgttggctgtcaactgagggccatccctggcttctagagactatgtgtactctttggcacatggcttccttcctacatctccaaagccagcaatggcaagctgagtctcttcaaacttttgatccctcctgcctcttctttcctttcatctctctgctccactattctaccttcctcattttattttaagagttcatgtgactacattgggcctacctggataatccaggctaatatcccccatctaagggtaaattgaatagcaaccttaatttcatctgcagtcttaaggtaacatagtcataggttccagggatttaggacatgggcatttttgaggaccattattcagcctttcagagatacgcagacaaatagaaggtatgggatagttggtaagaatgtaggtttgggaggcatgcagaccttgctttgaatcagctcttcatcttgatagctgggttaatcgggatatgttgtaacctctttgacattcagttttctctctgttaaatgtgaacatgggttgctatgaatattaaaaatgatatgtaaaagtgtatggtatatatcaagaactctactttactacttaaaaaaataatgtgacaattcctaatgttctgaatctaagcatcaaatgcagcttagagctcaatgtggaggacattgcctttaataaaacaaagtaggccaagtgctcttttgctaaaacctcaattaaccagctaggtttatagggaatgagaggggagttacatataagtgttgataattcatttatacctaaatcgttaaacgctattttaaggacatttgatgacttgaggctttcaaagaagtcgtaatgcctttttcttaaatagtaatgctgccaagagtaagcaaactaaaataccatttgctttgaaattcttctcaaacaaatttggagcgggttctaacctggcacaatatattcttccatctgtaatccctgcaaggacagcccccctgaaaataaacaccagcgctatttactgaatggggaattagaatctgtggcaggcaagaatgcaaagaaaagcacccatttagttggaatatttatttctctattagaattgtttaatggatttcaactatcgtaattgagagttatgttctagtgttttccattagctaaaaatgtgcttcttttaagtatctaaggaggacaaattcctccacagcaaataggtagagaaatgcatttcctggaggtgttgaccgtttgagcttgcaaattgatgaatacaatgttggggccaaattgaactaactgccttttgatgagcttgagtgcagcttgtgactaactagggagaggattttaccagtgcattctttaaatgaaacaagaggatccaaggactcatgtcttgatcaattggaagagcttctcctacatcccttcctgtacttcctccctgcttttgctactactctcatcagtggcacagccacatcatatggaaagccaggtagcacaaagccaaaatgtcatacacatacttcatatttcagaaatggttctgtagatcagcccacctattggtatctgcttcatggtttttgccaaaaggtcagtcaagatgggttgttaatgtacttgagtgaattttcaccattgttcctgggcatggagaaaagcatcaataggtgacagaagcatatatgatcacagaacgttggcaggaaggaaaagaagagcaccctacctgcttgaaaataaaagtatttcctgactaataaggtaaaatgagtttgctacttagatacttttggggggtggttatggaaagatggaggtgcacatgatggcattgatcattcttccaatcatataattttccagcaacatttgcactataattttttttgccgctagcactagaaccaaggaattcctagcggtcaactgagcctggggtggggtcttcgtgaggcagggagctctggacacatccctggaaatttcgggcaaccatcaggaccaaatttctcgcttgacccatgaaatttggatcagagattaggtttccaaacaccaaataaaagtgtgaaggggatagtgatgatgcatagtgcagggctcttccagcatgccatgtgaagaggtgtggtgttgatgagcacattttctaggaagacaggagtgtaatgcctgagaatgcactctatagtatattggtgaggaaacctcagtcctctgagctttaatactccaaaaattgaaaagattgagagaagaaaataggctttctctagcaatttagcctataatattgcctgagaaaggtgttaagatcaaaggctgagaagatttcgggcaagaaagtttatatgagtaactatgacatcactctgtgagcctaactggagtttctctactaattgttactaatgtcaaagacatatgtccagcctcacacacacgtgcatgcaaacacacacacacacgcacacacacacacactgggccccgctggctggaacaacatgcatagggcagtgagttttctagaaactttgcctgaaatgttggcagtgacctccataagtatgcatggaggaagaggcaaaatttagtgcaaaaacaatgcctggaatcgatatgtaaataatctttaaaggctgcctagataattcagttcctgggacactgtggccagaggcactttacatttaaagcaaagtgagtgagaccaaacatttttcaatgaagccagtcacatattgaacattttcatgaaatttcagacagcattttgaaagaaatactattagtcaatttgataatccataagcagtacagccatctttttctccactgagtcatctctcctactttggttagaaaactaaagtgaagttcgtgtgaggccttctctggaccagcagttataagtggttgaaaattttttgtgcgtggtgggagtggaagacaccttcacgttaacttgaattcagcttcagttactacttagggaggatagatagatagatgatagatagatagatagatagatagatagatagatagatagatagatagatttagagacagtgatacggtttggctgtgttcccacccaaatctcatcttgaattatagttcccataattcccacatattgtgggagagacccggtgggagataattgaatcatgggggtagtgcccccatactgttcttgtggtagtgaataagtctcagaagatctgatggttttataggggaaaagcccttttgcttggttctcattctttctcttccctgatgccatgtaacatgtgatttgctcctccttgccttccaccgtgatgtgaggcctccccaaccaagtggaactgtgagtccattaaacctcctttccagtctggggtatgtctttatcagcagcatgaaaatggactaatacagacagagtcttgctttgtcacccaggtttgagtagggtggcacaatcataggtcactgcagcctcgaactcgtgggctcaagcaagcctcccacctcagcctcctgagtagccatgactacaggtgtgtgtcactatgtctggctaatattttttacattaaaattttttttgtagagatgtggtctcactatgttgcccaggctggtctcaaactcctgcatcagcctctcaaagcccttggattacaggtgtgagccattgcacccaccagggagtacttaatacatagggaatagctatcatggggtaggcactatgctggatgctcccacccacattatcttgtttaattgttaaagtgaccttgttaggaattaaacgtcgagattcagtttggtcatctgtaagagataggaaattgacttgcacaaggtcatgttgtaggtgatgttctttccccaacctttagttgtgtttccatgtgtatatatttaactgatgcccaaataatgcttggcctcagaagagaagagaattgacccatacttagtactgactatgtgactgtgtgccagctattgtgcaatgtgcatctccaactttaatgtgcatagcagtcgcttcagaacctcgtgaaaatagattctgattctgctgatctggagttagcagtcctgcaagtctgcatttctaacaagctcccaggtgaaacccaggatgctgggccaggatttacacttaaccctagctatcatctcatcttatggttgaggaaactaagcctcaaggagtatacaggacttgcccaaggtcacactggtggtaagtggtggtgggggtgggagcggaactgtgatttgaaagcaggataggttgattataaggccgttgctggtacagtgcaatctgccacatcgcccaaggtttttgaaaccttcttcttaagagaggagaaaatccatttgaattccaggcttgatgaaggggcctggcactttaaagtcctagtttcttctaaagctctttcttctaagctcagaaaaacatggtctttgcagttaattgtgcatacgtttatgttttttctcttggcttcttcagatagacactttggtttgccacccttgcttcaccttgggaactctaaactactaaggcccaagccccactcataggccaattaaaccagaatctctggaggtggggcccaaacatgggcatgttattaaagctccccaggtgattctgatgtgcagctaggataaagaaccactgaattacagattcaaggaaacaatttctggaaaaatgtagcctcagtcccctttctcgtggatgtcattaaagaaggtccagtgtatttaactagacattcaccaacaagatttccaattagttcttggtaccattttattttgtgactgcgagcttggactgctctgagattgcagcctatataaagtttgaaatgattctgtacagaccctaagggtggggagctggtaaggagggatgagagtagaaagatacaacatcatagaccagctccagggcaaagacacatgttgtaggtcctgattttcttgctaacctaagttcttgggggggtattttgaaaaactgaatttgattttattcaattcaacaaaactggctagtcaagagatggtcatttttaaaaatgagaacacagtgcagggttggattaatgctatagaactctgagcagaccaccttggtgggtgaggctggaacagggcttctgtgtagagacgtgtgctgctgtgcaattttacacagtgaacagcgccactgcacaagagtacatactctagcctgaggtgtgggaagaaacgcaaataattggataatcatgagccagagcctgccctcagggaagagagaggagagagagaggagagagagaggagagagagagaggagagagagagagagagagagaggagagagagagagagagaagagagagaggaattttcactggagagagtaaagaaaggctttacttagagcagtaattttcaaccttggctctgtagtcaaatcatctgaggagcattgaaacctaccagtgctcaggccccagccaggtgtttctgttttaattgatctggtgtggcaacatgggtgttttggtttttaaaagtcctccaggtgatgctaatgctaaaccacaactgagaaccactggtttagattgcgttcgtactgggcagaggagaatgcatacaggcagagaaacctgggagagacaagtagcttgggagagtcgttctccaatctaagtatgatccttgaccagcagcatcagcaccacctgggaacttgttataaatgccaattctcaagttccagcccaaaccacctcaattagaaactcctgggtgggggtccacagtcagtctcaataagccctctaggtgactgtgaggctcacttaagttcgacttggacatgaacgtttatggaaagggagtgcaatgagctaaagctataagacttgaacctaacaagctgatgtcaactctcctgatggtaccattgagatgtacagcaataaccagtgttctaaggtggaatgtactcctctctagtcttaccatatctttcttatctgtttgaaactgtagcacagaaaaaagtatatgtcattcatgcaggggcagaatacttctggaagaagactctgcttttctggtagaagctgcacttttcttcttagtggacctatttctgtcttcagcagggggatctatcctccctggccacatgggcctttggctgatggaaaggctgggctttgaggaagctgcataggtaaggtgaaagagggtcccccaacctcccctttttgcttctcgttcccacctgggccaggacttcggttggctgggccccacctgccattcacagcaggcccctgaggctactcacagaatgccaagtgatgccactcagtagagaaagtctttgtcctatgctgagtaaagaccccactgatgtgtagcagtggtgctttatgttttgccagtcagaggctttcttttacctgggaggttgatgtgcacaccagtgcattcccctctcttcctggtctgcattgtatgggccaaactctccaaaatggaatagctgagtccttgcaggatgctgagcatctttgagggtcaaaaaagtgtttccaggattggagctaactcttcacaaagaggtttgtaggacaaagggactttacccatcaagtccagtgattctcaaataaggcaattttgccttcagttgtcagggcggggattggggggatttgacaatgtccggaggcattttttgttgtcacaactttggggagcagtgccactggcatctagtgagtagaggctagggatacagctcaacatcctacaatggacaaaacagcccttcacaacaaagaattatcaggcttcgaatatcaaaagttccagtgttgagaaaccctgacctagtctaaaccccttatttttgaaatgaggcagctgaggctcacagaggtgaaattacattctaaaggttacacagaaagcatcaagtcagggtgaggctcctggttttccaactaccagagtgcattgctcaacagtttcatctctggcagggacagtgtttcctccattgcagataccatttactttgtgcctactaggtgccaggcaatgggctagactcttcatttattaccgcttcatagcacacaccttcaatgtaggcatgactatccctagaagtggctcattttgtgcatgcaaaacaactgtatgaaaagtgttataggccattaagaaagcaaaaatgattgcaaaagagactgagacatggttcttgtcctgggagcttacattcaagtagtggagaaaagatatatgtcaaaatagtgatcatctagctttttacttaaggcccatgataataaccaaaaacctgtcccgaggcaccacaagataaatttcttaaaacgtatgtggaaattgagagttaggagagggagctgactgtatgccttagcatcatgggaaggctacataggtcaaagagaattatttgtgtgtattatgagtaagcactatcctagatcccacatataaatggtcaatgagacatataatgtctctgcctcagggggcttatattcttgtagggaaagccagacaagagagaaatacatacatatataagtaattatagactgtgacaaattgaaacctccctaacgtggctaaaagggcatctctgaggaggtgacattttagtggaaccctgaaggacataaaggggccacttgaaggacataaaggggtacaaggccttgaggcaggagaaagcctggcatattctagatactaatggaaagctaacgtgagccagaagagaggcatataataaaattgaggaggtgaggggccagcatggtagggagtttgcatttcattctaccatgaaaagagcaagttagcctgaagaaacataggatggatgaagacctagtaatgcttggagaatgagggaggttgcaaaggagaaggtaactgaaatttccaaacattgaaaagttgtttctaccttgaacaaattgaaagaccattagcattgatctgttccattcagtgaattatttacttaagttactcatgcacatttaaacctgctaacttcatagtgtccatggtggcagtaaagcttaaatcttatatagagataagtagatggttagctgggaggaaaaatggaggtcttgagctaacacatcctgtggttgaatgcacttttcagcatgacaggtgctcagtgacatggaagagtcattgctctaattaccccatttttttttctctctttctgattaggtaaggatgtctgataatctgtatgttttgccatattttctgtttcatagattttttaagtattttattgttggagtcactaatatgtgtctaataattttgattggtagtcccattgctgtctacattgctgtggccttggtgatctcagatttgctttgatttaaaatcatgtatcattaattatgttctgttatctttcggaagagttaatttaaaggcaaacagcatcatcatcaaataattgagggcttgttaactgcttccagcttgaagccagcaaaccttgcgaattacagtggcctgctgagggggcagatgcctctgtggcattgtcaaaacagtttcctaggctgtctctggttgcttttctgtctttgaataagggaaaaagttttttggagacaggggtagtcttgaaaagtaaaaaatactgaagaacccaatagctatctaatatattgatgcttttacaaagttgtcttactttatttatttatttaatttttttgagatggcgtctcactctgtcgcccaggttggtgtgtagtggtgccatcttggctcactgcaaccttcgcctcctgggttcgagcaattctcctgtctcagcctcccgagtagctgggattacaggcgtgtgccaccatgcctggctaatttttgtatttttagtagagatagggttttgccatgttggccagtctagtctcgaactcatgacctcaggtgatccacctgccttggcctcccaaaatgctgagattacaggcgtgagccaccacacccgacaaaagctgtcttactttagacttgttgacaaacacactggaatcctggctacatgataggctttttcaataacttactatgtgacttttaagaagttgcttcccctcctgagttttattttccttatgttttaaaacaaaggagtggcattaaattatctctaaagaaattttgtttgaaatgacatagaggatttcatcatagtgtttgtcacgtactaaatatttaggtagctgttttctgaggccaatgttatgtctattgatacaacttttatagagtaaaccaaaacattctaaatataggaaagataaatgattaacttatttagcttcaaatatatttaaaggatacattgcattggaatttttttattctatcagagattaaggtttactataagattggttctttctttacctctagtttgaaatgggaatactgtatttctgtgaacatgagtacgttaggccaggtcagcaggcttagactctgttaaactctctcctcttaccatgactgctccctgactgtgtccttaaccttgacaatggcagaacagcactgctgctgctgagaaaccaaacctagatgcaagcttgcccacctgatggttagtcaatggaaaaacatttgcaatgggaactagctcttttataaaagttgcttataaccatcatcccaccactaaagtcacttattcttatcacctctgtgtctgagtatgccacctgtcagtgtctgtgtgtctgtggatgtgtggatttgcacatgtgcacttgtgtcctcctactctgcactactcctgtgagacttcggagtcctgaatgggagggctgtgttttcgaggctgggggcactgcctatatgggcaaaatttccccccaaaggcctgttctttggcagctattctcatggggctcagcagcctttcaaaaagcatggggcttccagatccagaaataaaccaggagccacttttaccaccttatctgtcttgaagagtcaagttgaatttctgaaatcggaggaagctttgtataaatctaatgtctacctaatcactggaattttttgtccacctccaagactggataaatctatttttgggtagggcagcaggagtcactgaatgaaaggtggacaaatggttcagatgaacagtggcaagagtggttgtcagaggatagaggtcatgtgcaagaagggaatgtaccagattgggtaaaatggcagaaaacattgcattaagccagggaaaaaagaaacccattcccttttcctatcttaatgggctggattctttgcaggtctccttttcccttcataaagctggtaccccatggacgcattgcatcctcatcactttcttagggaatcagaacaaagctacccacctatcttactgctggagtcctgtgggaagtcatctttcattctttctgctgtcaactgcacatacagccaccatcctacttgagggagccctgggaataagtgcatttgatataacagttttaattttccatccaaaatatctcaaattaaagagattttataagccagcgtaatgtgttgcctatacagtgccacttctggtttaaaaaaatcagtgtttctagctcttttgccaacataacatcaagctactgttggttgactactctttttttttctgttttgcttgaattgactgacatttgaggtattgaggagagacagcctgagacccaaagctgacccattaactcccagatgttcacgatttccgaggaaatgttctgtgcctatggttactgttctgatgactccttgaacactctcatcttggcaccttttgcacttgctaaattcaatttgaagaaagaacaaaagacagggaaaattttgtggaaagcaattatcctgcacttttatgaccttcatgtttttcccatcatgatgaattttggggttagcacttgtatcagtcagcatgtagctttcactagaattttgttgtgtgttacagataaccagtcgtatctaattaaacaataatgatgccagtacaaggcattttctgggaattaatgaccagctgggaaaagctgatggctggagagtcagccaaaggctattagcttcagtccactattaatctccagaaatgtcaatttgtgacatcattgttggtactgagcaatgaaaatggaagacagtttactgttatctgtcacgtacttctgaataacaaattccttatgcattgtcaaaaagtcattttttctcttttatcctccaattgtccttcagtcttataatatgttttctatacagcagtgggtgaaaatggaatttctcagtttccatataatcatgggtgcttctttttttaaagagttccaatttggggagttttatttaaatattttggatggtaaaactagaatttgtcttcagctgtgatgctggaatttgatgagtgtctatattatcataactatctgctcatggcaggaaatggttacaaatgttttgaatagcagctgttgctagcaaagatgtgcattcaacaacgagattctaagaagttatagtcgcattcctagtagatgaagggaactctctacggaaaaagctatcgtggtgtgtctatgtaatatttttgattgctgctgctgaatgctagagggaaatagagaactgactaaaatatcagcatcaccatcttgcataatttaatgagttataaaggaagacaacaatccctcatagagtcaatctattaagaacttgttctaaactcataatactaatttaaaagttatgttggtttttatactattttttccttgacatgaaaggaaattcttaaagccccttaagatcccagccaatgagctaggaatgttttacccaacacagaagcttcatatcccatctaaattcagccaccatttgtttatttatttatttttttttttacaaacaccacggcattattcaccccacaagaaatttgctagtagtatcagtcctcctacatgcgtgttaagtgtatgcatttcgggtagtagaatgagtcagctcgtcattaatcaaagctttggaggcactgactcacttctggtgaaatggaatggcctcattgggaagggtgtgaaagaaaacaattcatgctggggtcagttccctgtttctgaaaatgcagatcaaatttgcacctattttcatggaaggttttcagaatagagaatgtagcagtgaaccctataaaggcaaatatcttgcttttgcagggaataaaaataatagtgatacaaaaacactagtgatacacttaggaagcatataaagagcctagaaagaaaaatgtggactgagaggatcctggtgtatacctaaggccaaaattattaaaccaggcctggctcttttacaatccaacaaggtagtcctttgaccaagcgttgtttcgtaggctctcagctggaatctcttgtcttcattaaggggttttgaacatctgaagaatgtttgcaacagcttcagttctctttggaaatcaaaagagtaaagagcagtgactgattcttctgtctgtctccgtgtatactgcttggaagtaaggccctcaccaggagcagaccaagaaaagaaacagaagcaaatttactgataattggtggatattagccagtttaacctatgaatacttatattgtactcaatctgaaacctataagttctacatggtgtttatttagatacaacatgagcatccatattaaaatacgtttttgcactttgggtatgatttaacactgttttcattgtactagcaacagaggtatatatagtcgagtagctatttccacggctttagtattttaaactaagcccattaaaataaaatcgccaagctattagatgtttttctttgaaacttttcttagggctgttgtttctttagtcttccctgggagtatatttgatttaagacattcgctgcttttctgaggctctaacttgagttcattttgttatgtggtgaccacagttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaaggtttgtgcacgacagacgcgtgttttgcttgttttctctcattcttctttctttctctttcttttggattgtgcattgccctctggtgtgctgtgtgttgttcaggccctgccatagctaggaggccccctggctggctggtgaaagtgttatacagtctcagatgggacgctgtataatatggtcatctctggcacagcgcacagcgtcaccctgcttttcacagctgaaacattttcagttgctgtcattttactgccccatttgggctggcaaagttgcttgcttctgtagccaacatctggccaattctgttcccatcaccttgcattcctgaagcagcagtcagctgaggaatgaaacttctaaaatgaaataatgagaagattgtttcaaaaattttcaactctccttcactccataaagcttttgcattgcacttgaagaatgctcatgatctacttagtttgctgaagcaggcccagattacctgtataatgcacgccccgttgcactttgccatggtaaaatgcatgcctcaaggaaactatgagtagtttgttttttcttttcagctcaagtacaggtttggacaactctacttgctgttacttaaactgaggttaataaggtactcattgcaatccatatcacaaatatatcttcaaagtatttcatctggccagaaatggtatttattcattgtttccaacatttttgcatctatcaaagagaaatatttttcacattacaaataaaatgtggtaaatttattgccatctgtttacattccagcttccaaaataacttctgagaattataatgtaaatgctaatacttgttaaacagcccattttcccctcacattaaatatcactgaggcagtttaccaatgaataacatttggaagtgacaaaattcacctgttctttggcagttggtgtatacttttgcattagtggtttttgtataatttctaaaagcgaccttgtttctatttcaagttgcccttttgcatcattatgggaatccttatgataattgtctttctgatatgggagagactggcatgtgggttaaaattcggtgagtaaataaatttctccaaatgcactctagtccgtagttttggaagcaaaacttcacaactcaaagtttccccttttcttctttccaaatagagtttaagacaatcattggcagaaaatgagaagcctacatgtatctgtgtttaattcagccatagaatagagcactcatatttatattctacccatacttttggtgtctaaactattcacgttgagtgtgaccaccgacttccacatatattcatctggaggtataaatggtgaacttttacagtgagtaaaagcaatcatttggttgtttagtggagaagataactaactttattttgtactttaatgaaacaaaaaaattttaaccagtgacaattactttactatatatactacattccaatattttctgctttctttactctaaaaattataaacacacacacacacacacacacacacacacagtttttgtacttgcaaatcagcctaaaaatcaaaatttggtttcgttaagaaaaataagccagttaagaagcagctggttaaattcgctcaagcaatcagttacataattaaaatatttttaacaatatttcagattttaaaaaacagttaagaccccattccttttattattacatataattttgacagaatctgttattttcaagtaccatctggagtgtattgtaaatactgttatgaatattttcagatatagagaattcttaagagaataggtagcagttagactctcttctgcaaagttaggtagtttttgatctgtcatttaatccacatattgagctgttgccattgtgtttaatggggctgccatcctttcacttgtgtactgtgatgatgggcattgtcttctttcagattggagattttcctcagtcttgccctccttccaggtcctcctgccacgatatcaaagctaatatttctgtctttattcttatgaatgatttgtaactagtattaaagtcagaggttttctgggatgacatttaaatactatttgcaatcttactgtaccccctcaaacaagatcccagaatctaatgatgaactcagaccttaaaatgaaaacacttgatctctacacaagttaacaggatccagaaggctttagatgggggcgaaagaaaacatgctgtggagctgatcttggataaataaggaaacattgccaagaacttaacatgcttacttcatgtaggatatcgaagctcatcatttccaggaggcgaagtaactatgggtttggaagggttcactggtcattctggcaacctggaagatttttgcaggactgttttttaattgccgtaagttatagtgttcggttccctcttaaggttgttgtgacattttgttataattagtagaaataaaagacctctttttttttttttaacaaatggatagtgttttgcatttaaactatgtctataccttgaaacattttattgttacgtgaaacattttgaagagatactccctgtcatggcctccgtgccaaaacatgagaccttaattgaccttggctgtggatgctcaccaattctacagcaggtgaaggcaatggacagggtggttaaaccatacattgtttgatctatgcaatgcccgtatgctagtataacctcttctaatgagattatttttttatgcaatgttaaaacccccaaatgaaaaattaaaaaaaaatttttaagccttttggggaaataaatgtttgaattgcgtaagctttagaaatgattaattaaacaggtttatgtgtattgtgatacagttggaattactaaattgataaaaattacccaactcttttttaattagtatagataaagtcttgctgtttcttttgtttggcagtggtttataagggctgggctgttttcatagtttatgacctcttaagatttgctacagataatttaacattgtttatagtcacccatctttttatagatatttttgtcttacgtccagggccctcagaatccatataaaataatacacaaagggactgaaatatctcactggcttttcaggatacacgaaggccaaattacactttgccaataccaggtttctatttatgaatatccaattccaaaaaaatttttaatctgttccaaacatttgcgattttcagtgacatgattatttctataaaaaccacttatgatataatattatgtgagtgctggaatttggctgaagaagtgcacacaagtatctgagagtctaatttggcccagtaccagcaatgttctttgttaaaagaaagccacatggagagtggagatcattaccaaaatctttttcttaccgctccaggagccttttggcaaaagaaagtataagcttcatagctttattcttttgttcactttatcttcctatggcatttgtgccaaaatgaaatcactaatttagagtaactcctggaagccaatctaatattagcatagttgtcatttcctaaatgccactccttggacttttactgatgttcgaagattgttaaagagaatcacaccaagataaatatgcttgcaagtagatagtgttggaaatctacagggaaaaataaatcatggattcccagtgtttgcttttagggtttaaaattctgattacgatagtaaatgtgaagaaattaatgcaacataggaaagtactacagagcttggtgatttgtcaccatctttttatcaggcatttgagctctttgctatagtcctgttttcatgtgattacacacacacacacacacacacacacacacgcacacgcacacacacacacattctgtcttccttagggcattcgtaacctttttattcagagagccatccaaccattgcggctttggttggagaagagaatctgtgctggagattgatgataaagtatggcagcttccaccaaccaagagaaagcaaaattacatgctaaatggtaagggggtatatttgtaactaccatgtctgttactctgataatgcgttgggttattccagaaagagcatacatcaccatgaatatcagtcttaccttaatgatgggagaggaagaagtcagaggaatgctgaggaacatgctgagggaaatgtttttcatcttcatgttttttcaacattgttgttttcctgttgtgccttcctcatcttaatgctaattttcctttcgagaaaaatgtgtcagcattaatttgaattaatagttgaataaaactaaactatggttattaaatcattttgtcactaagctagagttgggtaataacctctgatgcttgtcagctgaaaatatcttgactttcaggaaagacataactaggttccatgtctgtctcctttagaataattgaggggacattcctattctgttagaaaagcatggggccttggtttgcatttctttaattatcagtgataatgagcttttttttttctaatgtgtttgttggctgcatgaatgtcttcttttgagaagtgtctgttcatgtcctttgcccactttttaatggggttgtttagtttttcccttgtaaatttgtttaagttccttttaggctctggatattagacctttgccagatagacagattgcaaacattttctcccattttataggctgtttgttcactctgatgatagtttcttttgctgtgcagaagctctttagtttaattaaatcccatttgtcaatttttgcttttgttgcaattgcttttgatgttttcattatggaatctttgcccatgcctatgtcctgaatggcattgcctagattttcttctagggtttttgtagttttgggttttatatttaagtctttaatccatcttgaattaagttttgtataaggtacaaggaagaggtccagttccaattttctgcatatggctagccagttcacccagcaccatttattaagtagggaatcctttcccaactccttgtttttgtcaagtttgtcaaagatcagatggttgtaggtgtgcggtcttatttctgagttctctattctgttccattgttgtatgtgtctgcttttgtaccagtaccatgctgtaccgttacagtatactttgaagtcaggtagtgtgatgcctccagctttgttctttttgcttaggattgtcttggctatgcaggctctttttggtctcatatgaattgtaaaattgtttttttctaattctgtgaataatgtaaatggtagtttaacaggaatagcattgaatctataaattactttgggcagtatggccattttaaacatatttattttttctatccatgagcatggaatgtttttccattggtttgtgtcctctgatttattttgagcagtggtttatagttcccttgaagaggtgtttcacttcccttgttagctgtattcctaggtattttattctctttgtagcaattgtgaatgggagttcattcatgatttggctgtctgcttgtctgttgttggtgtgtaggaatgctcgtaatttttgcacattgactttggatcctgagactttgctgaagttgcttaccagcttaagaagcttttgggctgagacaatggggttttctagatataggatcacatcatctgcaaagaaagacaatttgacttcctctcttcctatttgaatacactttatttctttctcttgcctgattgccctggccagaacttccaatactgtgttgaataggagtggtgagagacggcatccttgtcttgtgccggttttcaaggggaatgcccccagcttttgcccattcagaatgatattggctgtgggtttgtcataaatggctcttattattttgaggtatgttccttccataactagtttattgagagtttttaacatgaaggggagttgaattttattgaagacctttgctgcgtcattagagaaatgcaaatcaaagccacaatgaggtaccatctcatgccagtcagaatagtgattattaaaatgttaagaaacaacagatggtggtaaggctgtggagaaataggaatgcttttccactgttggtgggaatgtaaattagttcaaccattgtggaagacagtgtggcaattcctcaaagacctagaaccagaaataccatttgacccagctatcccattactgggtgtatacttaaaggaatataaatcattctgttataaaaatacatgcatacatatgttcactgcagcactattcacagtagcaaagacatggaatgaacccaaatgcccatcaatgataggctggataaagaaaatgtggtatatatacactgtagaatactatgcagccataaaaaggaacgagatcatgtcctttgcagggacatggatggatccagaggccattatcctcagcaaactaacacaggaacagaaaaccaaacaccacatgttctcacatgtaagtgggagctgaacaatgagaacacatagacacagggagtggaacaacacacaccggagcatgttgaggtgagaggtatcgggggagggagagcatcaggaaaaatagctaatgcatgctgggcttaatatttcggtgatggtttgataggtgcagcaaaccaccatggcacacatttacctatgtaacaaacttgcacatcccacacatgtacaccggaacttaaaaagaaaagcatgggaccatgtgttctggtgactctgaagagataagaagactttgttctcaacctttttatttcaaagtcacttttttctttcatgacttagggccaccctgcctttgatttatgacctgaaggatcacaaaatgacacaagacaattttctttgctcattgaagcaaatggcagcttaattgcagagtcacaagaaagataaaaaaatattagtccaaattaatgccagaaatctggtggccttggtcattagcagtgagtaaacactatcctctccccacaaagtatttaattctatttctcttacagcttatgtcctgataacattagtaaaccagcaatggcaatgaaacccattctttcttcccccttatttcccctaccttatggcagcaaacacaaaatgaagtcatattttggggatagtttctactctctggaaaacttacagtctaatcaaggagtatgtatagtagccagtaattcactttcatgataagatggacatttatcattctcttattgaatatatgcatctccattcagtctctaggctggaggctggcttttagagtacaaactaataaccgttcgttctttaaaatatcattcactttttaaagcaactgacctcccctctcccttgagcttatgtgttccaatcatggtggtggtttccttgagacaaagttgtttctcctttgtaactctcttggctgaagtcttccttagttaatacttggagcagacatttctcctgtatgaagccagcactgatgacccgtttcaggcatttatgtttaaagtgacacttatctgcgaaagtgctttgaaagttctactagatgaatgacagtgtatgctggtgattttgattttaaaaagtcaaaatcaaagatacttgaaaacatctggaagttatacatccatatgggtgcttcccctttcaaggccaagacatcagggattgtgttggcaacatgctcttgggatgatgtcttgccaacttttctggagtttttttctcttcccagccagttggtaaaccacttaagaaattctgccttctggacccagcatggtatgacccagctaggctatgttccatgtccataaaggcatagcctgaaagactggttgattccccaaatcaagcccaatcctgatattagaagtctacgtctattaaggagatgcacaagaatgttctgctccctctgctccaattttcaccctgtcttttgttttaaatgacaattcacttgcctggttgaagagaatacaggagtgaactataatctttttcacagattcttacatagttatcagatcaatgttttccaataatatttcatgcaacactgatcatatatttatgtaaaaagacagcatttgtggtcaaatatgtttcccaaattacacgccattcctagagagtcacaatgcatatgagtatatgaaagattttaaagagtcttgcagattaggaagctgtctaccttaggcagttcagtggtaaacagcatcttctagctactggacccttttactgataatacagatgaacatcttccaagtaacactttgggaaaggctctgctggctctactaagcagtgtgttctcatcaaacatgagctttgtcaagtagcacacttttgaaaatgattgctgttcccttcctctcgattcccacctactatcgttagagaaaggctactcaaatgttcttcatgtgtctcaagttctttgttaccaatccatgactagataaggatcttatgccagaaggtaaatcactgcttccttcatgaagaaaatattgctgtcttgctgtgaaaagtaatgtcagctgaactaaataagaactgtattaagtaacatagttcacagactagtgctatgtttgtgtaccatacattgagtaacactgctttagattagtgattctcaaacttggctgtacattggaatcaactgaggatatttaaatactactgacgcctgagctcaacatcaaaccaaaaactgacaatcaaacaaacaaacaaagaaaacctgcaaaatctcttgtcgtgcttctggtcccaagcatttcaaataagagatactcaacttttagttactagtttttatatggataaaacatttcattctatgtcctcattgtatattttttcttgagaagaaatatttcttgagaagaaataattaagtaaaaaggactttataactggaaaaaaatttattgtggtagcggctcaacaggggtacttttttttaaaatctatctaagtgattctaatgtgctaacagggttggaatcactgccttaggaaataatcaccttggcataaggtctgctgagtgatgtcagctgtcaatccaggaatcttatcatgctgattgcatgggcctcttcaaaaggtgccctgtgatagagggctcagctggagaggcagcccttatatgacctttagaacttatggccatgtaaggtatccgtctttcccaccatgtgcacacacacctttctgaagttcccttacttgtttgccactctgtgcttttagaaaaataattaggattctccataagcgtgtggtaatctgccaccttgtgaccaacattctttcttgcaagcaattgttgaaacacttgttctgctctcagaatctgatgcagcttgcaagtatgggtcaaagagtttctcagactgtacttaaacaagaagatggagaaggagaaaagggtgtcacgatatgccagaaaagtactgacaattctttacttgattgctactgctctagagtaagattgcaaagcttgactcaagcagcttgtagcctgtgtatctgtctctgtgttacaccagaggctgtcatcgaggcattgccctcttatcatctaaatgtaatcggctactgcagcataaaaggattacagcagcccatatgtgaaacttgactctgacatgattaggaggctttaattgctatccatgtttataaatcattcctagcattttaaactacgtggattctgatattcatttcttatactctacggcattttttagtgtgcttaagaatagcaccttcaataatgaccactgtgaaagcgttaaacaagagacattatattctgcattttatcagcacttgcccttgtcttgcctcacagccaatatccacactcactccagcacatgaaaatcacttgtccacttccacccatgtgctagcaaatttttacttatgagccctagctattttaagatatatattctcagaagcatgtccagctttggaagcagcaagtgtacaatggccccaagactatatctacaaaagggaaagggaagagagcgtacttccactgggccacatcttcagtgacaacactgtgcatagccccttagaagcatgatcacgaaaaccctgtcagatagggttgctactaccatttcacagatcagcaaactaagatgcagaaagagtaagtcacttcaccagtaaatgagaggacttgatttgaacctaatttttctggcttctaaaagccatgccttctcccctccatggcttctccatatgctcagtttcccccctcttgctccataagtgcatttgttatctaaaacaaactgtagtgctaaaaagtgatcttaagtgtaaaggaataaaattctgtctacagtccttcctcagctttgtgacagcaagagtttgtcataagcagaagggactcgactcaggaggtacttgctcattctgtaggcctaagattaggtagagtgcagcactcaaaaggaagagatgaaatgacccttacctttaaggaactgatgacttggtcccggcatacaaagaaataatggagtgattaatgaatacttaaattcgatttgaatgcaatagatctgttcctagataaaagatattaaaagctcacttgtctactctgctttctttaggctagggaatgtgcctttccacctatgtgttagtcagttctcacactgctataaagaaatacttgagactgggtaatttataaagaaaataggtttaagtggctcacagttctgcaggctgtacaagaagcatgatgctggcatctgcttagcttctggggaggcctcaggagacatttaatcatggcagaaggcaatgctggagccagcactgagagaggtggcatcctttttacgatagtctgtccacaaatacagggagactcgaggaaatgacacatccatattgaaattatttgcttcttctctctctttccgtgcatgagcacaggtgacttgccctgaattgggtgtaaaaccttcacagaggacttcaatggggcaggagctgtctcagttgagctccaccagagacctgccattgctctcataatggcacagttgattctgtcccttccaaaagcacaaaacactgggacaagggaaacatgcccctttgtggtcgctagttgccattcaaagagggtttgaatacacacacacacacacacacacacacacacacacacaaatggacacatattactatttaaaatagtttatttgggggaaaaaacacttaaaagcagaatagtacagctcacatggttcctctactggagtcctttctacgatacatccagcccaacaaagcccagattaatcacagccctctatgggataatatgggctcaagcaagccattcatacagcgaggacatttgtctagcaaactgcctcaggctgtgaacaaaatcgggttctttttaagcaacaaggaaggaacaaagggcatttcaaaaagtggggattatagaagctgccagcaagtaacttttctcttatgttccttcttcagccatttcccctctgtacttacttgatttttctctgagaagatagcatttagaatccatgttagaagattcatgaactaattcagtaaatctctaattggcatacatggtaagctgttcacttagtggataattggttaaatgtacccagaatatttagtgagggagaaaaaaaatccccaaagcaaatcagcatagtttaggaaccttttcctctagtgccgctttttctttgtgaatggctactggtgcttaaaagtggtctctctcccttcccagtcaggactccatttaaatatacaacctccattgcatccctacttaatagagctttattaaatggataccataagcatagcacagtgtctgtcaacagtaagtgctcaatgaatatttattattacaaataacttatttatctaacacattttgatattctgtgttcaacggccatttgctctaattccaggtggcaaatgactgagtgcttctcatcaccattagcagaattgatatatttgttaataggtgtttattgagtgtcttgcacaagccaggcattatggtgggtaggcacagcatgataagacagattacatctctgccctcaaggaggaattaaagactagcaggaaagcagacttagaactacttgattatcaagattgtgttgcattcaaaaacactctaatacatagtggcttaaacccgctaaatatattttatttctcttgggctataggttggctctgtggttctgctgatctaagctgggcattgcttatccttcctgggctcaacaatatatttgtggtcagctggtaaggcagggtggcattgactgttctatgatgagtttgtacaggacacctcagctctccatgtgtttttcaagtcttatttatctattttaatattcatttattaatttttttcattgaacatttactgagcaacttttctgtgtgtcaggcactatatggccttgcatttcaattgctcaggaatgagttctatgctggtaacacacattcagtattgttagcctctggccagtattaaaaccatgaaagcagatgagacacatagggagagagactagagaagcaaggcctggggcatagaaacattgtaagatgttatagagaagaaaggactccagaagaaaaagaaggaaaaccaaaagaatgaggtctaaggaagccaaggaaggactcggcttcaggaaggaggaatggatcagtagagctgaatgcggtaaatcgttgctaatttaatacaatcctttcatatatcccttttagcatctaggctttgtaatccagttcctttcaatgtagaacagatgtctctgcctctcacgctcttgggaataaatggcataaatcactgaaatagttaaactgacccttgatagatagagtgatgaggaattagatgttgtctaactgctaaggaaagagtaggtctttgtaaagatgtcatcgatttttcttctctataatgcctgtaaagtttaaggctttggcaagaccaatttattcttttgttgtttatccttttgaatgtagttaagcttgctcggtaattttttctgtaatctaaaaatattggatcactgagaattaaaattaaatcaccccttgagtttggtattttaaaactgacaaactttgaagccacattaatatgatacaatcaagatgacattacatgtgtttccaataaagcaagttttctgccaactttacaaacgtgcacttttgctagaaattgattccttgtctagcagtgaacgtttcttgctgaatgaaagaagtagtgtttaaaaagaacaaatacacagttttgtggtgaagaactgttaacaatatgatatagagtctatgtaattaggctaagtttttatctaggatttgtgaatgttgatcctaaggaaatgataacttcctatgcaaaatatgatgaaagttttctgtacagagtgtcccactcaccaaggtcaaatgctacttccttagtagcctcaagggaggaaataggctatgtgtttttgggattaaaaaaataagaaattaaatgaattcatttttcatagtgtaaggtagagtgtttgggaaaaaaattctttttgaaggtctgtcctatgtatttgaaggtttttttcccttgcacttggattgtcccttaattcagactgtattaggatactacccatttctaaactaacatgagagactagagcttttagacactttttgctgactgccctttttcctaagacaggagaatgtcatgacagaaaatactgcattcccaaaacatctattgaaataaaaaaaatgtagaaagaaaatactgcattcatggacctacctctagcagcattccattttttccttagcatatccaatactacttttctccctgaatttgtttaaattaaatctgtgctgagacaggatcttgtgctttgattataggttggaatctcaatagtggaacatgtgagctaaccagggagcttgtgaacccctttgatatcctgtcatccttttctcacctatgtggtaacctagagaaaggactttgaagaagaaggagaaatatctctgtaggtagatggaagaaggttacatttaacatgcgaactgaactttatcttctctcttgtttagtaaaatcactgctggttggaggagcagggagtggacactgggaaaatcagaagccaacctgtgcccctacagtgctccagagctttagtatttattacatttatggaatgttacctattttttttctacatagaaggttttaacaaatcaagcaacacattctcatacttgataatgaataacattggcttaaaaattacaccaaattatcatgagaagcacaagtgagacctaaaacccagtgagcaaatctgttagtgattcttttcagctgtaaaaattagttgagatatttatttttccttcagtcagtagtgccaggctctgtgttgagctagagcaggatttctcaactttggtgctgttgacatttggggctagataattctgttgtcaagggctgtcctatatattgaaggatattgagcagcatcccttgactctacccactagatgccagtagcaccccatcctagttgtgacaactcaaaatatgtccaaatattgccaaatatcccataaggagcaaaatcaccttgttaagaaccactgggctgtgtaatacctatacaaacaaaacacatatattctgaaaattactctgcttctttgagagccagtcaaaatacttctgtttcatcataaccaaggttctccatccttgggttactaaggtagtagtttcaacttaattcaaactccgccttactcttcctgatccttcccctgcccttctcaaacctttaacttatctcagctatttatacaaatataaatatatttatattatataaggctctccagtagagctcaatgcagtgatttggtataagaaaactgaggctgcttcgggttaaattccactgtcattgaatgagttacaacttggtttgttccctgtgtctactataggagatctggagaaatatgacagagtccctgccttttaggagcttgacatgaaaactctgtatatgaaaaggaatgtaagtcagttatatcatgggctcaggctcaaatataagctcattcagaaaaatcttttcattgctgtccttttagaaggcttctgctcagtctagcctttcttcagcagggctgatgatgagcagaggtgaaggtattcctcaagattttatttttcatgttttcatatctagttcaacattgaaaaacttagaacattcaagctaactattcagactcgactaacattgggtacctataatggtgccaggcactgggctagttgcttcactcagtatttaatctttaaaataactgccaaaatgaagcatcactttttccttacctcatcctggttcctttacactgtcagcaagtctatgagatcaggaaagaaggaattttggaattttcacataatattttgggggacatgcagtaactaaactcattaaaattcagagaaattaatactccaaaagactatcaaagaatagaattaagtttacctcttagctaatttaatgtattttgatttattttttcaaaagcaattgtggtttatctggttcctgtttcttagctttgattttgttcctttatcgtagtaaagtgtcctcagtgactcatgttactttggataaggtccgttccttccttgagtctccatatccttatatatatataaataaaaaaaatttttaaaaaggattggataggtactgaattctcttattttgtatatctcaagatagtttaaaataagactcaatttgttattatgtttcctgacaactttatgcatagttaaaatggaaattcaactaatagatatggttgaagtctgacttcataattgtttcaagtttttgctgcgttggttgagcttgaggggaggtttcctggccatataatgatggccgtgggcttctcctttttcacatttttgctgaaactcgtgatcttaattctggactttgagaagattaaagcctaggcatgacctggtatgggcacagggagaaggaaaagtaacattttgtaagtacttgcctgtcttccttttgaaaattaggtaatatgatcgaattagctaagtaacttacccaacatctcaccattagaaaatggggagatcgaagtacaaaactatattctctttccaagccacactctgtttcttccaaaagggagactctcaagacctgccatatggattaggaggtaagcatacttttcctgttaactctgtgacctgttaactcttccttttagtgcctcaaatcttgacttcagggacctaatgctttcatgaacctaatgcaaagaaccccttgctttgtgttattttgtggaagaataatttggagcaaagaaaatcccctcaccataggcagaaagtcagaaactggaagcaagagaaaatgcttggttggtagaccaccaccctggccactggacttcgtacctttatatcctgattcaaaatggtagatatcaattttaacatcactcctcaattcaccagcccctgtcttggggcttccctggcattcatcttctacctatatttccttccttcccttccagataacacaatgagagtcaggtatggggaggctttattctgaaaggaaccacatctgttttcactttccctttttcatttagatatccactgttttattattgttttattatgatttcccctgtagagaagtatacagtggcagggcgacctgttgtgcatattgaattttacccttcatttactccaatgtttgcctatttctgctagaagctgaacagcaatccatattctccctgtgtgtaaactgtttctggataagcattaggtaccatggcgggatgtttgtttatccaactgaaagtctaaaggttttcaaactccccagttctcttttaggtggtagcctattcatagaatcagcactgctgatttatgagcaccatagctgctcagatctctaatatttctacagctattccaaattccagtagtttagataatggaggaatttaatgaatagctagagaaacatacagatgttccagtttcagtggaaactagagaaacttgtagaatattgcctcaagtcaggttttcatttcacctttctttacccttgtccccagcatctgacattggattaagagcagcaacaccatagccaccattgctaaagtgcaatctgggccagatatcacctcaagtttctataatctcgatagaaatgctagaatgtagatattttatcccatttttatacagaaggaaattgagcctcaaagactttaggtaaggcagaactgaaaaccccagtaggtgttaaaaaatataatgtgatttgaattttgaactataagttttctaagccagatggcttttacatctggggtgttacctgggttactgacttgaactgttgtttaagatgtgactaaacttaaatttatattctctattgacaaaacattttattctagagtaattgctgtactagatacaaaaacactgcattggtaaatcttttgttagctgtaaagatggtagctgcatatgtatgcattcaaatctgcttgttcataaatagaagacctgatttattaaagattttcatatctgacattttaacttgagatttttcactttcctttttctgtgaacagcacggctcatctctgtaagttcaaagtttgtcaagttcataactcttaaaaaccttgcacaaaccataacctcgccctttgccttcccagatctattcccgaaactgtcatcttgatagattcgtggaataacccttccttctcaatttctcagcacttttctgaccccctctgtcttagtctgttttctgctgctataaaagaataccatagagtggaaaatttttttttaatgatttatttggcttaccattctgggagatgggaagtccaagaccgaaaggccacatctagtgagggctttcttgctgtgtcataagataatgaaaggtatcatatgacaaagaagtgtggagggatgaaagatagaggaaattgaaccaaacccatccttttatcaggagcccactcctaccttaactaacctactcctacaataatggtattaattcattcatgagggtagagccttcacgccctaattaccttttaaaggtgtcacccataaataccatcacattggcaattaaatttcaacatgagttttgggggacatattcaaaccatagcattcttctcctagtccctcaaaattcatgtatttctcacatgtaaaatagattcattccatcccagtagccccagcaatcttatttcaataccaactcaaatgttcaaagtctcatctaagtcatatatgggtgagactcagggaggcaaattcctcaggcagtttctctccagctgtgagactgtgaaatcaaaacaaactgtctactttcaaaatacaatggagggaatggggaatggccaagaaggctgactagaagctccatagctctcaaagagaggaatggaaaggacagtaaacacagcaccttcaactgaaacattcaggtactcgcattgggactaacgaaggaaacaactcaacccatggagaacaaagaatgacagcccacctgagagtgacacagaaccaagtgaacctcccccacccaaggaagcagttgagtgaatgtgtgaccctgggaaaccacaattctcccatggatctttgcaaccctcaggtcgggagatcccatcgtgaatccactccactgggaccttcagcctgacacacagagctacacggagtttctgcagagtagccactcaggcacatgtggagacccaggagctttagatacgccagcatttcaggcttctcagcaaaagtaactgcaactccagcaaagtgggaggttggacacctgtacatacccctagaaaagaggctgaatccaggggaccaagcagtgatagtctgtggacaccacttccactgtgcctcacaggataagacccactggtttagaattccagccagtcaccagtagcagtattgcacctacctgggacaaagctttctgggggaagggtggggcgccatgtttgctgtttgggcaacttagctgatccagactgtaagctttggagagtctaaacctaccaaggtttgaagggatcccccagcacagcacagctgcttatcaaaacatggccaggctgtttctttaagtgagttcttgctcttttcctcctcactgggcaggagctcccaactggggccaccacccactcaagccagttttctctggccaacagagatttgaaaactccctgggacagagaacccagagtgaggggcaggctgccatctttgctgtttaggtgacatagccagtccagcctgtgagctttggagagtccaaactgacaggggacagaagcagtaccccagcacagtgcagcggctctacaaaagcatggtcagacttcttctttaagcaggtccccagtactcttcctcctcatggggcagaacctcccagccagggcctgcagccaccccgactggtgttccctggtctacagagttttgaaaattccctgagattaaactcccagaaggaggggtgggctgccatctttgctgtttaaacaacttagcctccagcttctgcagagccaaagctgaccaggagtggaagcaataccacagcacagcagagtagacccacgaaaatgtggtcagactgctttttaaagtgggtccccaaccccatttctcatcaccaggtggagcctcgcacctggggtctctggctacccctaatggtgttctctggctgacagacgtctcagctctccctgggatgcagctcccaatggtaggggcagaccgccatctttgctcttaggaaaacttaaccattccagtcttcaggcttcagcgtgtccatggtgaccaggggatgaagtggacccccagcacagcatagcagctctacaaaaatgtggccaggctactttttaaagcatgcccccaatctcattcctcctaactgggcaagaccacccaactgggattgcccgccacctcctatacatgtgtttaggctggcaacaggtccatacctccctgggatggagctaccagaggaaggggttggctcccttatttgctgtttcacagccttcactggtgatacctccaggtactggcaaatccaagtctactagaaactggagcagacccccagaataccacaacagccctatggaaaaggggccagactgttaaagaaaaaaaaaaaaaaacccaccaccaaaaggtcagcaacctcaaagattgaaagtagataatttcacaaagatgagaaataataataatcagcagaagaaccctgaaacctcaaaaagctagagtgccctctttcctctaaatgagtgcatcacctcttcaacaagggttcggaactgggctgaggctgagactgagatgtctgaaatgacagaaggagaattcagaatatggataggaatgaagttcactgagctaaaggagtacattgtaacccaatgcaaggaagctaaaaattatgataaagcattgccggagctgacagacaaaatagatagtatagagaagaacataaccaacctgatagagctgaaaaatacactacaagactttcataatgcagtcacagctattgattgccaaatagaccaagtggaggaaagactctcagagcttgaagactggctttctgaaataagacaggcagacaagaacagagaaaaaaagaatgaaaaggaatgaacaaaccctttgagaaatatgggattatgtaaagagactgaatctgcaaccgattgatgtacctgaaagagatgaggagaatggaaccaatttagaaaacatatttcaggatatcatccatgagaacttctccagcctagcttgagaggccaacattcaaatttcaggaaatgcagaggataccactaagatactctacgataagatcatccccaagacacataatcattagattatccaaggtctaaatgaaagaaaaaatgttacaggcagctagagagaaaggccaggtcacctaaaaagggaggcccatcagactaacagcagacctctcacttgaaaccctgtaagctagaagacattgggggccaatattcaacattctctctctttttttttttaacattcaacaatcttaaagaaaacaaattccaacctagaatttcatatctggccgaactaagcttcataagtgaaagagaaataagatcctttccagacaagcaaatgctgagggagcttgttaccaccagagctgcctcacaagagctcctgaaagaagcactaaatgtggaaaggaaagactgttaccagccactacaaaaacacactgaattacacagtctgtacacagcccagtgacattatacagcaccacataaacaagtctgcaaacataatgatgacaggttgaaatccacagatatcaatacaaactttacatgtaaatgggctaaatgccccaattaaaagacacacagtggcaagctaaacatcaaagacccattggtatgctgtcttcaagagaactatctcacatgcagtgacatacacaggctcaaaaataaagggatggaggaaaatctaccaaggatatggaaaacagaaaaagtagaggttgcaatcctagtttctgacaaaacagactttacccaatgaagatcaaaaaacaaaacaaaacaaaaatccgcatcgcataatggtaaagggttcagttggacaagaagatctaactatcctaaatatttatgcacccaacacaggaggacccagattcataaaacaagttcttagagaccttcaaagagacttagactctcacacaataacagtgggagactttaataacccactgacaacattagatcactggcacagagaattaacacagatattcaggacctgaaatcatcactggatcaaatggacctaatagatatctacagaactctccaactcaaaacaatagaatatacgttctcatcactacatggcacttagtctaaaattgatcacgtaatcagaagtgaaacactcctcagcaaatggaaaataactgcaattataacaaacagcctcttggaccatagcacaatcaaatttgaaatcaagactaagaaattcactgaaaaccatataattacatggaaattgaataacctgatcctgaatgactttggggtaaataataaaatttaggcagaaatcaagaagttcattgaaactaatgagaacaaagatacaatgtaccagaatctctgggacacagctaaagcagtggtaagaggtaaatttatagcattagatgtccacatcagagtgatacaaagatctctagttaacagcctaacatcacaactaaaagaactagagaaccaagagcaaacaaatccagaagctagtagaagacaagaaataaccaaaatcagagcttaactgaaggagatagaaacatgaaaaaccattcaaacgatcactccatccaggagctgttttgttttttttttgaaaaaaaataagtaaataaaatagactgctagttagactaataaagaaggaaagagaagattaaaataaacacaatcagaaatgacaagagggatattaccactgaccccatagaaatgcaaacaactatcagagaataggatgaacacttctttgcacacaaaccagaaaccctagaagaaatggataaattcctggacacatacaccctcccaagactgaattaggaagaaactgaatcccttaacagaccaatagcaggttccgaaattgaggcattaatagatagtctaccaactgataaaagtccaggaccagagggattcacagctgaattctaccagttgtacaaagaagagctggtaccattcctactgaaaatgttccaaaaaattgaaaacaagggattcatccttaactcattctgtgaggccagcattatcctgataccaaaacctggcagagatacaacaaaaaagaaaacttcaggccaatatcctcaacacaaaaatcctcaagaaaatactggcaagccaaatccagcaagcacatcaaaaagttaatccaccatgatcaagtaggctttatatctgggatgcaaggttggttcagcatacacaaatcaataaatgtgattcatcacataaacagaactaaagacaaaaaccacatgattatctcaatggatgcataaaaggctttcaataaaattcagcattgatttatgttaaaaactctcagtaacctaggtatcaaaggaatataccacaaaataataaaaaccatctataacaaagccactgacaacattatactgaatgggcaaaagctaaaaacactccccttgataaccagcacaagacaaggatgccctctgtcacaactcttattcaacgtagtattggacgtctcggccagagcaatcagtgaagagagaaaaaataaagcacctccacataggaggagaggaagtcaaattatccctgttagcagatgacatgatcctttatctagaaaaccctagtctcagctcaaaagctttttaagctgataagaaacttcagcaaagtctcaggatacaaaatcagtgtgcaaaattcactagcattcctgtacaccaacagtcaagccgaaagccaaatcaggaatgaactcccattcacaattgccacaaaaagaataaaatatctaggaatatagctaatgactgacgtgaaagatctctgcaataagaatcgcaaaacactgctcaaagaaatcggagatgacacaaacaaagggagaaacattccatgctcatggacaggaagaatcaatattgttaaaatggccttattgcccaaagcaatttatagattcagtgccattcctattaaactaccattgacattatttatagaactagaaactattttaaaattcatatggaacctacaaagatcttgaatagccaaggcaatcctaagcaaaaagaacaaagtaggaggcatcatgctacctgacttcaagctatatactacaggactacagtaaccaaaaccacatggtactggtacaaaaatagacacgtagaccaatggaacagaatagagagcccagtaataagtctgcacacctataactatctgatcattgacaaacctgactaaaacaagcaatggaggaaggagtcactattcaataaattgtgccgggataaatgactagccatatgcagaagtttgaaactggaaccttttcttacaccatatacaaaaatcaactgaagaaggattaaagacttaaatgtaaaatccaaaactataaaaaccctagaagaaaacctaggcaatatcattcaggatataggcatgggcaaagattttattatgaagatgccaaaagcaatagtgacagaagcaaaaattgacaaatggaatctaattaaactaaagaggttttgcacagcaaaataagctatcaaaagactaaacagacaacctacagaatgggagacaattttggcaagacatgcatctgacaaaggtcgacatccagcatctataaggtacttaaacaaatttacaagaataaaaacaaacaaccctattaaaaagtgggtaaaggacatcaacagatacttttccaaagaagacatacatgtgaccaataatcaaatgaaaaaaaaatcaacatcactggtcattagagtaatgcaaatcaaaactacaatgagataccatgtcacaccagtcagaatggctattattaaaaagtcaaaaaatacctgatgctggcaaggttgtggagaaaaaggaacacttatgcactgttggtgggagtgtaaattagtttagccactgtggaagacaatgtggcaatttctcagagacctaaaacagaaataccattcaactcaacaatcccattactggatatatactgaaaggagtataaatcaatctattataaagacacattcatgtgtatgttcattgcagcactattcacaatagcaaagacagaatgatagactggataaagaaaatgtggtatatatacaccatggaatactattcaaccataaaaaatgagatcctctcctttgcaggaacatggatggagctggaggccattatccttagcaaactaacacaggagcagaaaaccaaatactaaatactgcatgttctcacttataagtgggagctaaattatgagaacacatggacacatagagggaacagcacatactggcgcatttcagaaggtggagggtaggaggagggagaggatcagcaaaaataactaatgggtacttggcttagtacctgaatgatgaaataatctgtaaaacaaaccctcatgacacaaatttacctacgtaaaaaacctacaattgttcccttgaacttaaaataaaagttaaaaaaaaaaagaaatggaatagcaaggaaaaaataacaacatacaatggaaggacaggaatagaatatatattcctattctaaaatggagaaataggcaggaagggttagttgtttcaaataattcccaaacccagcagggaaaacatcattaaatttaaagctggagaataatctcctttgactccatgtctcacttcttggatacactgaggttgggattgggcccccaaggtcccagaacgttctgcctctatggcttttctgggcccagtctacccagcagctctcacaatttggagtctcatgcctgtagctttcccagtatggagttgcccacttgtggccccatagttcttgattctctgaggttgcctttctcccatggctcctctagtcattgccctagtagtctctctgtggtggctccacccctgtgacaagtttctaattaagcccccaggcagtccacaacatcctttgaaatataagtggaggaagccatctctacacagctcctgccttccacacacctgaacaattagcgtcacatggatgctgctaacatgtatggcttgtacgttctggagcaacaggttgagctgcacctgagctcacttgggccacagctgggttggccaggggacactgtgctggaatgtggggagaatagacccaaggcatccttaggcagagagtccatggaagatgccctaagcccttcacccaaaaccattctgccccactggtgctcttggactttgatgagaggggcagcctcaaagatcttcgagatctttgaaatgccttcaggatatttctcccattgtcttgacaagtagcacctgctcccttcatttatgataatctctttagcaaatggttgcttggcaatacctttgatttgctctcctaaacacaccttttctcctactgtaggagatagcttaaaacacacacacacacacacacacacacacacacacacacacacaaacaccccttttcactctttacatggccaggttgcaaattttccaaacttttctgttctgcttctctattttaattataaattttatctttaagtaatttcttttctcttacatctcactgtatgtggttaaaagttgccaagcaatagcttgaatgctatactgcttagatatttcttcagccagattcaccactcttaaattatgcattctataaagttctaggacacgtgcacaatcctgccaagttttttaaaattatataacaaggatggtctttactccagtttccagtactttgtttctcatttctctctgagacatcctcagaagggtctttactttccctatttctgtcaacattctgatcataatcacttaagtaatctctaagaagatttgaacttctcctatagctctcctcttcttttgagccttcaccagaatcccccttaacattctattcacagccatctaggctttctctagcctgttcctccaaattgttccagcctctgcccattacccagttccaaagctacttccacagttttaggaatttgttataacaacattcccgtctttattacccattttctgtttttatttgttttctgttgttaaagtaaactactacagactgggtcatttataaagaatagaagtttaagccaggcgcgatggctcacgcctgtaatcccagcactttgggaggccaaggtgggtggatcacctgagatcaggagtttgagaccagcctggccaacatggtgaaaccctgtctctactaaaaatatacaaaaattagccaagcattgtggcacacacctgtaataccagctacttgggaggctgaggcaggagaatcacttgaacctgggaggcagaggttgcagtgagctgagatcatgctactgcactccagcctgggtgacagagcaataatctgtctaaaaaaaaaatagaatagaagcttatttggctcagggttctgcaatctgtgaagtcaaagattgagtggctgcatcttgtgaggaccttcttgctgagtcaaaaaatggcagaaagcatctgccttagtccattttgtgttgctatatggaatacctgaggctggttaatttgtaaagaaaagaggtttatttggctcagagttctgcctgaacaagaagcatggcactggtatctacatctggtgaaggtctcagagtgcttccactcatggaagaagcagcagaacaggcgtctgcagagatcacatggtgagagaggaaggaagagaaggggaagaggtgccaggctatttataacaaccagctctcttgggaaccagtagagtaataactcaccccccagggacagcattactctattcaagagggatctacttccataccccaaataccttctactaggccccatcttacaacaccaccatactggggatgaaattttaatatgagatttagtggggacaaacaaaccatacccaaactatagcagcatcacatgctgagaaaacgtgtgtgtgagacagagaaaggaaattgggccaaactcatccttttatcaggagcacacttctgccttaagtaacccattcctgttataacagcattagttcatttatggggccatagcacacatgacataatcacctcttaaagtttccacctcttaataccatcacaatggcaattaaatttcagtattggttttagaggggatattgaaactattgtactctccatttaagttcttatcacttcctgctaaaaattaaaggattttgtcttcccatagagggaatgtcctgtgtctttttcctggcacgtagtaggtgcccaatacatgtttctgaattgaagaccacaatgctactgttttataaagcagatggcgggggaggggtgcatacaaagtaaatggaaccttctgatacctctcaatgcaaaaaaaaaaaatacttctaataattggaaatattgactgttccacaccattgttaagggcatgttagccttactagtaagtggctttcacagaatgtgttgcacaataagatctgtctcttgagtgctgttttaccttaatggagatttttttttttttttttttgagacggagtctcgctctgtcgcccaggctggagtgcagtggcgcgatctcggctcactgcaagctccgcctcccgggttcacgccattctcccgcctcagcctctcgagtagctgggactacaggcgcccgccaccacgcccggctaattttttttgtatttttagtagagacggggtttcaccgtgttagccaggatggtctcgatctcctgacctcgtgatccgcccgcctcggcctcccaaagtgctgggattacaggcgtgaccaccgcgcccggcccttaatggagattttaaaatgcagagtgagcaatagattcattagttaatcgaggcaactagcctccacatagaatttttttgcaagttactttgggttaaagacatttgggttgctgattgtattttcctgtatttttaattctgagctgtgagagtccattcatatatatcgttttctcctagtgccttctgccgattgcaattacctataatgtaaaccactgtacatgatattctgaaggtccttgagaatttgtcgtcaccagtgtattcatgagggaacattccactagaattaaaacaaagaactcgtagctgaacaaacccgggttttaaccccacctctgccacttattagctgtgtgattggaggaaaacaagcataaaatagagacaatgataagattcaacttacagagttgtcttgaggattgattaagcatagtgcctataacatagcaagtaatcaataaagggaaattatttttattacctttgtttatgattatgatgatttagctctgagtgattcttttaacttatcttgccatccttaagcttatacagtcattgacatgtaaaaatgggccttcagagtcctcatctgtttttagccactcgcaaactgctcactgggacctatcttatactttgcttctagaatgattcctgagtttcacatattctgttcctaacacttaataaattctagctattctaactattgttaaaattgcctttacagcagcatttcctaatatgttacccaaatgaaatactcacctaggaaagttcccaagagtaaaaactatttgagaaacaggtactagccataaccctgccctggaaattttcactgtacattagaatattaaataatctaaacagtcctatatgatttattttatgtatataaaatcatttccacagttacaaagtactgcctccccccatgaaagctcttctgtgctgctgtcttaatttctatattcaggaccctcaacattctttcactctctttctacttcaggagtgtccctcaatacgcaagggcatgaagttgcaatcactgggatccagccacagcaccgcagaacaacctgatctgttcattagaagtttccagggagttgcttctcaatgcctttttctatcttggatacaaactcttctagcattagaacatgctctggtagctggcagacttttcctttgataccattgaatcttaaaatgtagccaatggaacaggaagtggaatctatatagaggcggctatgtgccataaatgctcccccatgttacaattcctgatgttacaagccttatggcttgtctttcagtttactgtgctttaatatacctgtgtaccagtgtagtgccataagatccttgttggaataaaagttacttaaggtatgtagctattgagctaggatctcttgggtcataagtaaatgccactttattactatttgagtatttggatttataaagaggtaaatgggagtgattattcaatttgctaatagatccactgaaagattgctttgtaatgctgttccaaagtatatttaaataagcattgattcatatgcacctttctaagatcaaaccattttattagataaaataagggattaccttatttgattccatcccttagcagcattcttaggatctgattttctgtttccgtttagtcggcagatcatgaagaggctttcataactggaatatatattgtgaaatattaccatgtagatctttcctttaccacttgagaaatgcatactttaaacatgtgtttctgtgttttatattctgtggaaagatatcataatttggtttcactttggatagattttgtttgaaaattataaatgacttttatggaaatgagttaggaatttaaggggtgtgccaaattttaggccacctgggtgccattagtatattgtagacatatgttgtctaatggaattcacttagcctaaaagaattaagaggtttccggaaatagcaataacctaatgcattgggcaaggcatcctaaaactagagttacagcaccatggcacatggttctgtggaaaatagcacatccaaatatttcagaaaggatagatgtaatgatcttctagaaaggatctttatgaatcagaaagctgagctgatggtgactgagagcatagatggctattcaatccagaaaagtttttctgtcagatgctatctctgaatgcccttgcccacattgtgagacccataattggaggtctagacgtcctcataggttgtcccagtgtagctgaactatttctttattgcctaaggagttagaaactccctatttaagaagccatgtaattaaccatcctagggtgagttttgctgccaccacagaaccaagtatagtgcagaattttgtacactattggtaggaagcctaaaattccatttttgtcatactgccactgaaaaaactatcagcttatcttcatgagctaagagtgaggctgcctattaatatcatttgcttacatatttaacatattatatgctagtcgctgcactttaaatacatgattccatttactgctcattttgcgaatgagaaaactgaggcttagaaaggtaacttgcctgaggtcacacagcttgtaagtagcagaacagagactcaaacccaggcaatcagagtccagaggtcaagttcttaactatagcagttcattttcagagggtctgtgtgcttatcatgggggcctggaaaagtaaagaatgaaagagttgctttttcctttgaagtaaaagcaagagaaagcactgagttatttttatgtagctgcacattatggacgactattatgtgccaggtaccaataataagtctttatacacattatttttgtaatcgccataagaatatcatgagtttgatcttaatgtttgtccttaatttcaggatgagaaatggagatgtggagtatgaatttgtgtttacttgcccaaggtcacctggctagtaaattggagctggaatttgaacccagatttgtctgactccaaagacaatgctctttaactattatgtatacatttccccagtaagcaactcctaaaacattgaaactgtcacaacctgtatggggatttctcacaactaagatgtcacagtgataggtaagaggaagagaagatcagtgtaataacagcccaaacatcccgtagccttattcagtgatcctagagtcatcctctttaaaggaacacttttctcatgtccttggtcctgtatgcataaaaaatgtattggaagctacctgtgtagtggaggaaatgcccagaggagaaaatggttgagcatgaatattgttcttacgcacgaattgaacagggcatataattcccttgaagcagaaagacattgttccttttccttaggggccatgaaactatagctaagtgaaggaaaaggaggtgagttagagactttgtaacatagaaaatcctagccgtgcccaatcacttttcttcaaagaccaaatgttaacatatcatgggctctttgaatatacttagaaggaatataggcaaaatttagtaaaatttggcctgtatttatggccaatatcatatatagctccacttaaaatgtactttttatctttaagactaacatattactgtcattatatatgttcagttatcccttaacttttgacctgcattaggtcagttttgaacaaaaagtatcgtagttggtcaggttctaattttttaggttatttaaaaagaataattctccctatttgctctttgccctgacaagtgagtaggtcaagtgcatttaggatacagctttgccactgaagtcaccacatcagtcattcagtcatgtatcttattgttttcttctttcatcttccacagcagatgtcctaaacctctgcaactgggctcaagcctttgccccatctgaagcctactcatcagatgaactgtcttgactttgcagatgaaagtccaggggaattcccttagcttccctcttctgcaccttcaaacttaccccatttgtagtcagcctccatcccattccccatcttagagaaaatgtctttcttcctgtgccaagttaatcctcctttcctttttggtatgtgctgtggatcacattcttcctgccccttcaattaccttgatctcaatcagtcttccctctcttacatttctagcttcttccttctcacttcattgactatgctgtctttcaaaatataaatatgctcagataaaggagctctagagactggatgactattggtgctaattggcagggataggacatgcaagaaaatgagttacaggttcactcacatgcttcacctattccctatataaaaataatccatcagtttaatgttctgatctcttaaatggatataataatatgggcatggtatggttcttttgaggatccgatgaaacagtgcatgtcacctcactgaacaatatgtatcaccaaacatagaaactagcacctagtaagtgctcagaaatgataacaattgcagtcatggtgttatttacagtacttatagtagtaatagcaggagtaattgtataggggaattgaactgaaatagattcaaggtgccccttgcttctaaaagtagaagcttgaatcccattgttgcaggacttttccttagctcagctacagatagggttcttgtcacatagccatgaaagattaggcttgcagacaatttgaagggtgagtaaggcagggttttattgggtaaaaaggaaaaaaaaggggaaacagaaactcttagtgaagtgagagagtgtgtttatcctgccagcgggcttcccaacttacagattgaattctgggttccacccagaaagaggagaggccaggctcctccctgctgcaaactgtgaacttctgtggccccaccctatcatgcactcctcctagtgcgcaggcgggctggagtctctctggggactccttcccacctagctatctcaccatagccccactgcccaatcctttttcacagtgtttaatatattacaactgtatctcaaccctctatcatctcctctcaaagcttctcttgttccagacacattggaccacttgacaatccccaaatcaggaggctgtgaactttcacgcctcctgactctgttcatgctgttccttcagtcttccccgcctttcccccttctccataacacctcgaatgatgttctctgatatgtgacactttcctcatctccacactactctgtgcagtgttggttatcccacagtctctatatgtactgtaccacactgtatgttcatagctgacttggttttccatttgctacacttggaactcccagaggacaaggatgagttcagcttggtatctccactgcctaggcattcagtaaaagcataatgattgtggtaatggacaacttctgtggcaccatgacactgcctgccaggtaaggaactgcatggccagtttaacaaaaattttgattacattattagagattctttatttttgaaattttagagcagttaaatagcaatgtcactttcctaaaatttcggattcctgtatctgttgcccttctttcaagcctgcagctctttgtaagtttcagtaataactctgtccacttgcccttccaagtttaagtgtgataacaactttatactcttgctcatccctgggagcttcaccacctcataagggttttgtgagtgctatctatacttctttaaatggtccctttattaaacactcttcagttattcccttgagtgtgctatctattttctgcaaggacactgcccatatgaaatgacccttctctttcagtgaacccaggtagcttttggtaatttgtttccatcaggttattgactgcccctgaggtgtctcgaaagatttctatcccattatctataactgtagtctgggaaagttgttgacaatccgtagcattactatgtgcaacaatgtaaaggtaagaaattgctttgactctcttactgtgaagaatatagtgctacaacctgtcctcatttctgcaggaggagataaacagaggccttctgtatgctttagaatgattgattctaaccaagcatagaaatcctgggcagaggaaaaaccacatttcttgacttgatcttgatcttttaggtcacttctaaacctgaggttgatcttgatttggtgtgtaatcatatcatgtcatcatcatcagatattttgtacctctcatatgtgaggacctataatgctagacacaaaaatgcagggtatgagccttggttctccttcccatattgaagaaactaggctatgggagaataatttgattatttttctttttaaaaggcttgaaattaactttctcttatactcttcctcctgtcattcaattttatcgccattgatccctccactctgttccatgtatttagtcacagaaccatagaaatctcttttaaagcaggattattcaatagaaacataatgtaagccacatgtgtaattttacattttctagtagtcacatttaaaaactaaaaagaaactggtgaacgtaattttgatcatgtatcttatttaacccaatatgtccaaaatattatttcaacatttaatcattataaaaatatttagtgaaatagtgtactttctaaatacgaagtcttcaaaatcttgtatagattttgtacttaaagtacatctcaatgcagatactaactactcatcagaaatattttgtatttcaatttcatcacatttatagctgaaaaagtagattgacattgcccaagtcgttccaggcatactcaaaagttttctgataactgaaccacgtacaggtttttgtatcgaaataaaagtttattaaaattttaaacaagttaaacattcagttgctcggtcacattagctacattttaggtgttcaagagccttatgttgctagtggacaccatcttggacaatgcagttataagctatctctagaatgtatctccttttttcacttcactaataaagcctaagatgaaggctttaccattggctgtttggcctattaccacattctcctatctagcctctttgtctttcattttctgccagcttacctcaggctgtcatgctccctgattcctgaggcattttggtaaatcacatatctggtcacataattttactgcttaagaattctttactgcccactgttgagtgaaatgcaatgcccaattttctgaatatgacttgctggaccctctctgagctggtccctgacaagcttcctagtgtcttagtctgccacccctcatgtatttccctgtactttaaatgcactggactattctccattatctaggagcaccatgcacaaacaaccttccacaaattcactctcactaatgtctcccaaattttgcactttcttcagaacccagatcaaatgccatttactataagaagctttccacaagcccttctatcagacagtggtaactttcccatgtatctctcaaataaaatactttttccactgcgttaccttcagatgtaagttgatttgtctcacgaactagtctgtgagctcagagcagaggttagcaaactatagcccgtgagccaaattgtgtgttttaattaatataggttttttttggagcacacctatgctcattcatttacatattatctattgctgctgtcatgctgcagtggcagaattgaatagttccaacagaaacttaatgaccccaaacccaaaatattgattatcttgccttttgcagaaaaagtttggctacctatgtcctagaggatgaggacactgtcttatgcatcctcagtgctaagcattgcactaggtacatgcaagttttcagtacatgtttgtggaatcgaacaatagataaattgaatcaaattgaattgatgagttttatgaaagttgatgtttctgtctgtaattggtaagttatttgaggacaggaatggttcttgctatttctttagaatgccttatgatatttaccttattgttagttactttataactgttcacttaaataaaagaatttttgtttttccaccttcattctttttgtttaatactatgtaccacctaccattttttctgtaatttctatttgattttacttgtttctcaaggatgcaaatggattaaatcctgagaagttgagtgcctccaatacacaattacataatggaagctgtgaactcaagtcttggcttgatctttggtctaattggctgcttcagataagccacttggcctaacttgttgtttttttctgaatcttcagtgcaaatcacaatattccaccttcaagttattgtttgaagtacatgtgaatgtgatatgcagttccataataagtattatgaacataatttttttaaataaagaaggtatttttctccactaaaaatggagaaataaacattatatgtgctgattttaaacattacttagagtcagcctccattattgaaagttttctgttttgggtaagaaactggtggccaccaatacttccatattaacaccaaaagaccatttggccatcccttttaatgtcatatttaaaaagcggaattctgaaagcaaacctgggaaatggcttccacacttgagccatacatttatgaatggagaacttgaagaacaagagcatacaaatctcagagaaggatctggaggctttatgatatgaaagcaaaaagtacaagagctgtcactggggagttccatttctataaggactttctatgtactagtagctagaagcattcattattcactccaacctccagccttatagtttatgtttctagcttgccttttctcagaattcttaggttaatgacagattctagttactgagcactactatataccatttatatattttgtttatataattgatatcttgtcctaaaaaaaccccactgaggtaggtattaatatttttaatttacagaaaaggatattgagcctcaaaaaggctacataagaagtaagtagcagatctgggttttctacctaagtctctagagcccatactcttaactaccatacaaactgtaagattttctgagattaaagcaatggggcttccgaaaaaaaagtttccatatggtgctttgaaatattctacctttttcctctgaagaatgaagtcctagagctgggagaggccagagaagtcacctgttaagaggctgaatgacttgcccaagttaacttagcaaaattagtggcccatacaattctctagcctcctgacacctggtctactgctctgtatactacatttcaatccacatttctggataaaaatagccaagtgcatacccattttatttttattttaaaattcatttaaagaaaagtatttctgctttgagaaaatgaaagaaaaaaaatgacagccctcccaaagtaaactaaggatgattcttttttaccaaatctttagggaatccagccagagatgccagcacataccgaattgcttgtttaagagttctgctgctgacagtctggggtgctgtgagcaaatctctaaatttctctgagccttaattctcatctgtaaaatgaagaacttgaactagatgaaatataaagtcctttctagcatatgagtgtgtgtgtgtgtgtgtgtgtgtgtgtgtgtgtgtgtgtgtgtgtctgtgcatatatatatccttatataactttaggagtatgattagataactttaggagtatgattaggaggtgccaggaccaattgaaggagatagatttgggctcaaataagaaattccttcgtatggacatagccttccttaagtagactgagataccgtaagtagtggtgaatttcctgtcattgaagttattcaagtagaaatggatagcaacttgttggaaatgtcatagtagtcattcagacattaaattgatgattgggttacaattatgattaatgttattccatacttcacactctgagaaatcaaatatgtagaaatctctaagcacaaccacaaattttaaccctgtgctcaactacacactcattcaacagtcgattattgagtacctttgaggattctaggtactgtgctagaactggagatgtcaagacttaggacattgcctctgtcttgagtgttacagaccaggagtgtgcaaactgtggcccaaaagcctgatctcacccactgtatgttttggtaataatagtttactggaacgcatccatacttattcactttcatattatctatggctacatttacgttacaacagaattgagcagttgcaacagagaccatatggcccacaaaacccaaagtatttactatgtgattctttataacaaaagtttgccaggccttgttgtagataaacatgtacatctgtaacttcaatccagtgacctaagtgggaaactggagaaaacataaaggcagcacatatgattacttcttcttgaacaaggatcagaaatttttcagaggaattaaaccatatcattgtgctgtctttgagtgggaagagacattacaggttataactgtcttcattttccatcagtatctctgcatattgcccctatagcattcatgacacaccactgacattttcttaaaaaggagagcatacatgcaccctacagataagtggcaaaattatataaagtttagcctgccaatttatgcaggagtgacagcaacatccataggttgcctttgcattctaaaataaattaagaaccagttatgttcatgttactgttttaatttaaaaccaaacaatttcagggtctttatctggttcatgctgaggacatcaatctataggaaactcttcaggaaataaaggactagggtccatcctccttcccatacagagggatggaagcccagtgtctgtggccattgttgttaccacaaggcggtatacctaagtcctattaagcaggactcacaagttctcaataatcagttttagggcagatatggaaaaataaccataataatcacatttgccctcctatcattgcagggcctcctgaagtgctatccacacagttgaaattctcaagataaatgttgttgactgattgactgtattcttccaaatttactaccaatctggagaggactacaacagtgtgattaatgatttgtaaaatattcttttcacttacatattcaaagccttaatcctctaattatttttaaaatgcaatgtgagatggatactatgacaataggggtcctgaatgctctcctaataagcagatgaaggtctccttagagcagggatgtcccatcttttggcttccctgggccatattggaagaagaagaattgtctttgagccacacttaaaataccctaacagtaacaatagctgatgaggtttaaaaaaattgcaaaaaaggtctcataatgttttaagaaagtttatgaatttgtgttgggccacattcgaagctgtcctgggcctcatgcggcccatgggccatgggttggacaagcttgccttagagaaaaacaaatcatttgttaaagttttaattttgacatgatttcagacttccagaaaagtcacaaaaacagtactctatagtacatcagtttcctattttttgcaattacaagaaatgctgcaataagtagccttgtgcttacatattttcatattgttggtgatacattttcaggataaattctgatgagtgcgattgctgggtcaaaatacatatatttttgttaaatattgccaaattcccttcagaaattttatatttctaccagcaataggaattgtgcctgtttcttcacagcctcacctacagagtaggttgcactatttaatttttgcctgataggtgagaactagttatcagtgtagttttaatttacatgtccttttttatgagtaagggtgaatattttttcataaacgtaaaagccattttaatatctcttgtgacttattttcatatttttgatcattgttctatctgagatttgtttttttatccccttgaattttaagaattctttgcatattagaggtattagccatttatctgttatatgtgtttcaattattcctcctcttttgccagttatcttttgatttctttatggtttctttatggtatcttttgatttctttatggtaattttgggcatgcattaggtttttggttgttgctatgtagtcagatttaacaatcatttgttttattgtacctggatttggagttctaattaggagaactctttctacacccagtttaagaagaattcacccatgttttctcctagtgtttgtttggttttattgaacaattagatccctgatccatttggaatttatttttatttttactttttttcttcttttttttttaaattatactttaagttttagggtacatgtgcacattgtgcaggttagttacatatgtatacatgtgccatgctggtaatcatggatgtaatgtatcttttcctaaatggtgtccattgttgcagtatcatttgaaaactccatcttctctaaagttatttgagatgtcacctttattatatactaaagttccatattttcttatgtctatttctgaactttctactctatttaactgggctctattgatgtgtcagtaccacacctgcattttttttcattttttcccgcagctttttttggatataattgaccaataaaaattttacgtatttacaatgtacggtgtgacattttgatatatgtatacattgtgaaatgattacgtcaagctaattaacatatgtattaccttatatacttattttttgtggtaagaacatgtaagttttactttcttagcactttttaagtatacaatgtagtattattaactataatcatcatgctatatgtaagattctttgaacttatttctcctatctaatccaaactctgtactctttaaccaaccccatcacccctccccagcccctggcaaccagcattctactctctgcttctatgagtttgacatttttagatttcatatataagtgatatcaagcagtattcatctttctgtgtctagcttatttaacttaacatgatgccctccaggttcacccatgttgctgcaaatgacaggaattcattttattttaacactgattattgtttcattgtgtatatagaccacattttatgtatccattcacccactgatggacacttaggttgattccatatcttgagtattgtaaataacgctgcaatgaacatgagagtgcaagtatctctttggcatactggttttatttttttaacgtgtatccagaaatggaattactggatcatatgatagttctatttttaattttttgagcaacctccatactgttttccatgatagctgtactaatttacattcccactgaatgagaacacaatgatattccctacatcctccccaacacttgttatcttgtgataatagtcattctaagaggtatcaagtagtatctcattatgattttaatttgcatttccctgataattaggatgtcgagcattttttcttatacctgttggccatttgtatgccttcttttgggaaatgtctacttaagtgctttgctcattttttcttttggttatttgttttcttgctattgagttgtttgagttccttatatattttgtatactaatcccttaaatgtatggtttgaaatttttttttccattccataggttatctcttcactctgttcattgtttcttttgctgtgcagaagctatttagtttgatgcaatcccaacaccctttaaattatagatgatttatagtatgttttactgtctagtagggctagtacctgctcatagtttatcattttttgtgtgtttcactggctattgttaatttttccatgtgaggttcagtgacaacttgtctaattctaaaaataacttattgttatttttattgggattatattaaatttatgaattaatttacatatttatactattgagtcatcctatcaaaaaacaagaaatgtctttctatttcttcaagtctactttcctttcctttatggatggagaaaatgtaaattaagaaaaatatagttttgggattttgaatttatacaggatgtgaaaagtatatttaacaagcagaacatgtgcatatgtaacaagcagagaagaacaaattttctccactgccattctaattatattccaagatagaaatgtcctagtccttcctttattcattcatatattctcattggtgactccactgaagccagaaaacatacttaccaaaaccaatgagaatactcataagagatgacagtcatgactgataatactcaaaattcaaaaccatcttaacagtctggaatgatcaacctaaactcaacaagtggagaaaattctgcactgagtcttaaaagtggaattgcataggtgaaagtcaggaaaaagttgcttcaactgcattacttttgacatctggaggaggtatctagattgactgcaaacttaacagagcacggtatttcactgtagcaactgttaaaatggtatgtttatccaagcttcattaaatgggtatcagtagcacatcattgccctagagggtggatcaagaagcagcagaaaagtaaaacaaggaggcaggtgttgtttcaacttggatttcctagtaaagtttatttgaccaaagaatttgagggagagaagaaagagagggagaattagaatgaaggaatggacaatcatagagcaacaacaaaagcagagagctcagttaggaagctgttggtgcagtaataagcagagtatgaggtgctctggctagactccgcaatgatagtggagattatgaaaagttatcagcattgtggaagacagtatggtgattcctcaaagacctagaaccagaaataccatttgacccagcaatcccattactgggtatatactcaaaggaatataaatcattctactataaagacacatgaacatgtatgtttattgcaacactatttaaatgcccatcagtgatagactggattaagaaaatgtggcacatatacaccatgaaatactatgcagccataaaagggaatgtgatcatgtcctttgcagggatgtggctgaagctggaagccatcattctcagcaaactaacacaggaacagaaaaccaaacactgcatgttctcactcataagtgggagatgaacactgagaacacatggacacagataggggaacaatacacgccagggcctgttacagggtggggttgaggggagggaacttagaagacgggtcaataggtacagcaaaacaccatggcacacgtatacctatgtaacaaacctggaaacccgcacgttctgcacatgtatcccattttttttagaagaaatttttttaaaatccaaaaaatttttaaaaagaaaatgttacaaatcttattcatgtaaaaacatgtgtaactatatttcccaacttttctacatatggaatgtattatcacattggtctaaaatcaaggtataaccaagatcatcaggaatggagaggtaggaagtggtataagagccataaattctcctttttccatagtgagacattaacagataccatcaaaagtggaaaaatttggaggtaaaccacttaaaaagtttaaatgataactagatgatgaaccaaaaaccaaagactattcaaaacaagtgcctcatatccaagagaaatgaaaacatgtccacacaaaatcttgtacatgaatgttcatagcaccattgttaataatagcttaaaagtggaaatgactcaaagttcatcacctgatgaatgggtaaagataatgtgggctgtctgtactactattatgataaaaactgaaatattatgcatgccgcaaatggataaactttgaaaacattatgctaagtgaaaggaaccaatcacaaaagaccacatgttgtatgattccacttatgtgaaatgttttagaataggcaaatctagagacagatggtaggttagtgcttgcaggggctgggaggaggagggatggagagtgattgctaatgggtatggggtttctttttggggtgttgaaaacattctaaaattgattgtggtgatggttgcaaaccttgtcaacacattaaaaaccactgaactgtaaaaaaaaaaaagaaagtggttggatttgtaatatattttataggtagaattaatgagatgtaatgatggattggattggggatgagggaacgacaaaaataaagggtaaagtttagtttttgtgattgaacaacctggtggatggtggtgtcatttactaacataggaaatactggagggaaagtaggatagggtacaggtgggactggaaatctagagtcctgttatagtcatgtccattttgagatgtagaagtttgacatagagctacacagttaattactatacagtgtctatcttaaaagagcccctagtcttgttacagaggcagaaaactatttttttattcttttttattattattatactttaaattctagggtacatgtgcacaatgtgcaggtttgttacatatggatacgtgcgccatgttggtgtgctgcacccattaactcgtcatttacattaggtatatctcctaatgctatccctccacactccccccaccccacaacaggccccggtttgtgatgttccccttcctgtgtccgagtgttctcattgttcagttcccacctacaagtgagaacatgtggtgtttggttttttgtccttgggatagtttgctgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgctgtaataaacatatgtgtgcatgtgtctttatagcagcatgatttataatcctttgagtatatacccagtaatgggatggctgcgtcaaatggtatttctagttctagatccttaaggaatcgccacactgtcttccacaatggttgaactagtttacagtcccaccaacagtgtaaaactgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataagtgtcttcttctgagcagtgtctgttcatatccttcatccacttgttgatggggttgtttgattttttcctgtaaacttgtttaagttctttgtagattctggatattagccctttgtcagatgggtagattgtaaacattttgtcccattctgtaggttgccagttcactctgatggtagtttctttagctgtgcagaagttctttagtttcattagatcccatttgtcaattttgtcttttgttgccattacttttggtgttttagtcatgaagtctttgcgcatccctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatgcttatagatgtgtggtattatttctgagggctctgttttgttccattggtctatatctctgttttggcaccagtaccatgctgttttggttattgtagccttgtagtatagtttgaagtcaggtagcatgatgcctccagctttgttcttttggcttaggattgtcttggcaatgcaggctcttttttgtctccatatgaactttaaagtagttttttctaattctgtgaagaaagtcattggtagcttgatggggatggcattgaatctataagttaccttgggcagtatggccattttcacaatattgattcttcctatccatgagcatgggatgttcttccgtttgtttgtgtcctcttttatttcgttgagcaggggtttgtagttctccttgaagaggtccttcacatcccttgtaagttggattcctaggtattttattctctttgaagcagttgtgaatgggagttcactcatgatttggctctctgtttgtctgttattggtgtataagaatacttgtgatttttgcactttgattttgtatcctgagactttcctgaagttgcttatcagcttaaggagattttgggctgagatggggttttctaaatacacaatcatgtcatctgcaaacggggacaatttgacttcctcttttcttaattgaacaccctttatttctttctcatgcttgattgccctggccagaacttcaaacactatgttgaataggagtggtgagagaaggcctccctgccttgtgccagttttcaaagggaatgcttccaggttttgcccattcagtatgatattggctgtgggtttgtcataagtagctcttattattttgagatatgttctatcaatacctaatttattgagagtttttagcatgaagggctgtagaattttgtcgaaggccttttctgcatctattgagataatcatgtggtttttgtctttggttctgtttatgtgatggattacatttattgatttgcatatgttgaaccaggcttgcatcccagggatgaagccaacttgatcgtgatggataagctttttgatatactgctggattcggtttgccagtattttattgaagatttttgcatcaatgttcatcagggatattggtctaaaattctctttttttgttgtgtctctgccagattttggtatcaggatgatgctggcctcataaaatgagttagggaggattccctctttttctattgattggaatagtgtcagaaggaatggtaccagctcctccttgtaactctggtagaattcggctgtgaatccatcaggtcctggactttttttgtttggtaggctattaattattgcctcaatttcagagactgttattgttctattcagggattcaacttcttcctggtttagtcttgggatggtgtatgtgtccaggaatttatccatttcttctggattttctagtttatttgcatagaggtgtttatagcattctctgatggtagtttgtatttctgtggcattggtggtgatatcccctttatcattttttattgcatctatttgattcttctctcttttcttctttattagtcttgctagtgatcttgttagtgattttgttgatcttgtcaaaacccagctcctggattcattgatttttttaagggttttttgtgtctctatctccttcagttctgctctgatcttagtaatttcttgccttctgctagctttcgaatatgtttgctcttgcttctctagttctttccattgtgatgttagggtgtcaattttagatctttcctcctttcttatgcgggcatttagtgctctaaatttccctctgcacactgctttaaatgtgtcccagagattctggtatgttgtgtctttgttctcatttgtttcaaagaacatctttatttctgccttcattttattatgtacccagtagtcattcaggagcaggttgttcactttccttgcagttgagcggttttgagtgagtttcttaatcctgaattctagtttgattgcactgtggtctgagagacagtttgttataatttctgttcttttacatttgctgaggagtgctttacttccaactatgtggtcaattttagaataagtgcgatgtggtgcggagaagaatgtatattctgttgatttggggtggagagttccgtagatgtctattaggtccgcttggtgcagagctgagttcaattcctggatatccttgttaactttctgtctcgttgatctgtctaatgttgacagtggggtgttaaagtctccctttgtcattgtgtgggagtctaagtctctttgtaggtctctaaggacttgctttatgaatctgggtgctcctgtattgggtgcatatatatttaggatagttagctcttcttgttgaattgattcctttaccattatgtaatggcctttgtctcttttgatctttgttggtttaaagtctgttttatcagagactaggattgcaacccctgcttttttttgttttctatttcattggtagatcttcctccatccttttattttgagcctatgtgtgtctctgcacatgagatgggtctcctgaatacagcacactgatgggtcttgactctttatccagttttccagtctgtgtcttttaattggagcatttagcccatttacagttaatgttaatattgttatgtgtgaatttaatcctgtcattatgatgttagctgattattttgcttgttagttgatgcagtttcttcctagcatcgatagtctttacaatttggcatgtttttgcagtggctggtaccagttgttcctttccatgtttagtgcttccttcaggagctcttgtagggcaggcctggtggtgacaaaatctcttagcatttgtttgtctgtaaaggattttatttctccttcacttatgaagcttagcttcctacctccccatacatccaagctctgcttttaattgttttgtcttgagtttcacatagtgtttcagttacataaactgaaatttgctgttgtaaaacgtaaaaataatagaaaataatcattcattttttttttgctagtaacatcagttttatatcactggggcatcgactataaagcctggctgaaggcagggccggccctcaacagattacatagttagagtagggtctggttcaaggtctggtgagtctccacattcttttccttgggactattcgtggtcttctctagcttattggtggccttctccaattttgctgtagacctttttgtaaattctgcttgagtctcaacccccttcagctttttctccaccaatttgatatcctctgcgtatttacacattttcatggaatattccctctctaaggccctcagtgccttgatggcctagtccatggcttgaagtttctcctccagctgtctggctcagatcttggtcacctgagctatctctcctgagtgatctagttttcctccccagatcttctcctcatacttcatgggctggtatttgatgaacttcatccttctgtccctctcattggctacctactgagtatcttccagcttttgcagggctacagccagatgcacctgtgccagtcaagctcctcttctatctgctcaatgaggcgttttatagagaccacatttgcctcagcaacagtatccttatcttcctgttccagtttctccaagatatcattcatgaatttaaatactcttctgtgtcatctcctgtccccttcagattcttctggaggccctgctgctcctcacccagctgtttgtagcagtcttcagtttgcttctcattggctttgacttcctcgacggggttggtggcattatccttctccacctttagcgtctgaattttcttattgatagtgtccatggttacagtggtggatgggccacctggcacgcagtgaggatggggcagattttgctggctccactgactgagattcacgctcctaatatgactaaagtctttcaataagttgggagattttttttcagaattgttggctgcttctgaaacataagaaagtttatttttatgattaggtaagttatatagcagaaaaaatatgaattttaaaaggagaataaaccttcaaagttaacaacaaaaatgactagagtaagatgccactgaactaaatgattaagagaatattttggaaaactatgttattatataaggatcttattttcattaacctagttattcattaacagccatttattaaacacccatactgagtcaagtgccatgcttcatcctagggtcacaaagacgaactagatgcaagggttgtagacttttttaatcaaataataagccataccaggttttgagtagtgacccagcattcccctttctctttaggattaaaagtgggagtgaaaaaagggggagttaatcaaggggcataaagtttcatttaagcaagatgaataagatctaaagatctgctgtacaaccttgtacccatagtcaacaataatatattgtatgtgtaaaaatttgttaagagggcagatttcatgttgtgttcttactacaataaaataaaattttttgaagaaaataaatgtttttgaattggttatatcctaaaatttacagaatttaactggcctttatgcttttttgaattatgcaatttttgtttctcattccaactacttagcagatgattgattagattgtagagcctaaaatattcccccactctcacccttgacttcagattgctggagcacaggtccaatcaaatgttgcatttaaaaaaaatacaatccatgcaggcaatttaatgaaagcatcagccatttttgtagttagattccttcctaaaagtatgggtgtgcttatgtttatcacaattttctcaattcagttaatttcaaggttaatctgccaactgtctgaacatatggcaaagtattttaaatgggtttaagggaaggaaatgatgagatttcctcagacatcaatcttagcatctgatattaccttgtatatttattttccccaagttaccatatatagatgatttttgttatccgtatctgagggtatttatataaagttgaatgtgtaggaagttatacatctccaaatttgtgtttacaaaacatggataaacccaggtcaattaatatttcacctgcttaaagcatctgccttttcaatttgattcgtgtcaagaaataatttttataagatagttttatcctgaatgaatcatgataccatttagtattaactgctattatccatcttcaccctatgatcaatctgatatttcaatatttatttaaaataagatgggatcttttagaccccacattctgaaatgaagttataagactgtaaagaatctgtttctaatattaaaattgttttaatgtatagtttagtggaaaagacagtctgaaaaatcaaataatcatatgtttccaagtttaccacaacatagtacaaagaaagattgaatgtgaactgttttttaatatacttatacagcacagacttgaatcgcaaggcggccttctaaaaataggacgtgtgtacttacacaaatataacctaagtcaaattgcatagtgacctatcatgttaatgattccccatttataaaccaggaagatctcaatattatatgtggtttcaagtgtatgtgtgtttgtgtgaatgtgtacacatcccacagaaacatacataatattggaataattcatgctgaagaattatggttaaaagtgcattcattgaacaattaatggctccaaataatgattgtggccacataccctgggaaactggtgcacagtgaattgcacagttcaggtgaaggtgacatatgacagataatgatggtggcaggaagagctgtgacaatgagatagagagcattttctgagaaaatataatgccacatttgaagaatttagctgtccatgagaataaagtgaatggttctgataaggtcaggaaaacgggtttgagaggataaatcagaagcagagtgcttgctgtttaacttcagtgccttttccttgttagggagctaaggatattttaagtgaatgaaaaagaaaatgtaaattctgtgggagcaaagtgtgtcaggtttttaaagcatattaagtctaaatgtggtaatgcattcctcactttggaggggtcacctggagagctgactcctttcagaaatgatggcacagactgcaccaaagtgagcattattggttagagtatgaatttatttttttttcatttgcttcttactttcaagccacacgctatgctgccactgcatttggcatcaaatcaaaagaccaactctgcttcacaggaagaaatgtcaccacaaagttgtgctttttgtgaaaactgtgctgttgctatttttctgaaatgctgtggaattgtgtggaacagaggaaggcctcatcagaactctgggccaaaacattatcagctagtcatgaaggacatagaaatggatagctgtagtagccaagagattccctacaatgacatcgtcagataactgaggtagtatcttaccagtttcatacactcttagctaaaacatcacactctggggctcagatgtcatgcataagcttggcctctaatatagattctgcgggtaatgctcctttgggcttcacccagtaggctgtgaggatggaaatcctaaaggtttagtctgaactgccaagaccctcacccaggaaaataaattgtgagagagactagcctaagcagaaatgaataccatggaatggacttcaataaacatgagatgatgcccactccaagcagtctagatgctcatcttgatctaatttctagagctgtacctcttacctgccctgttagctaatggaagggatcttacagatttctactcaaattctttatctaatggttggatcacctctgaatcatcctcacgtgctttcagcagtagcaattatgtagccaagataggtcataccttcacatccaaatagagagaacttcaaatcctagtgatttgaattggtagactagaaatggtggcagaaaggctaattaagagatagatacactataataagaaagaggtggtgagcctgaaccaaagtagttgccattagagttggagaaatgcaggaataattgggtaaaaagttccaggagaacttggtgttggcgtggatgtgtggctcagagagagtgaagaaaaaacaatgagtctgaggtttcaagtcttggttccttaataaacagaggtgcttttcctagaaagaaataagaaggaagagttagtggaagttgtttagccatgtttcaaatattaagagtctgaggtgctgaaaaaacatggcattctgcaattgatgctttggagggggcgaaaatttgaggagaatggagtgagtaatacataaaagtatgtgagaccaacaaggaagagcatgtagatagagaggaaagggagtcagggatagaatccctgtgaatacttgcttttagtgcagagaaaggaaaagacaaagagcaactaggaaaaggaggcagggaacagtggtcagaaaggtaagaagaaaactaggacagcacaatgtcatagaagccaagatacaagaggagttggccaataatatcagatacttaaaaaaattcaaggaagtgttccttttaggacatctggcaagttggccaaataggaacagctccagtctgcagctcccagtgagaccaatgcagaagatgggtgatttctgcatttccaactgaggtccccagttcatctcattgggactggttaggtagagggtacagcccagcaagggtgagcagaagcaggatggggagttgcctcacctgggaagtacaaggagctgggaccctacctcccccagccaagggaagccgtgagggactgtgctacccggctgacatactatgcttttcccatggtttttgcaatccacaggccaggagattccctcgtgtgcttacaccaccagggccgtgggtttcaagcacaaatctgggtggctgtttggccagacactgagctagctgcagtagtttgtttttgtttttgtttttgttttcataccccagtgatacctggaaacccagcaagagagaaaagagagaactgtttactcccctggaaagggggctgaagccagagagccaagtggtctcactcagtgggtgccactcccatggagcccagcaagctaagaaccactggcttgaaattcctgctgccagcgcagcagtctgaagtccacctgagacaatgaagcttggtagggggaggggcatccaccattactgaggcttgagtaggtggttttcccctgacagtgctaagaaggctgggaagttcggactgggtggaacgcaccacagtgcagcaaagcagctgtggacagactgcctctctagattcctcctcactaggcagggcatctctgaaagaaaggcagtagccccagtcaggggcttatagataaaactaccatctccctgggaaagagcacctgggggaaggggcggctttgggtgcaggttcagcaaacttaaacgttcctgcctgccagctctaagagagcagtagatctcccagtacagtgctcgagctctgctaagagacagactgcctcctcaagtgggtccctgaaccccgtgcctcctgactgggagacacctcccagcaggggtcaacagacaccacatacgagagaacagtggctagcatcaggcgggtgcccctctggggtgaaacttccagaggaaggagcaggcagcaatctttgctgttctgcagcctccactggtgatacccaggcaaacaggacctggcatggacttccccgaaactccagcagacctgcagaagaggggcctaactgtaagaagaaaaactaacaaacaaaagcaataacatcaacatcaacaaaaaggacgcccacacaaaaagtcccattcgaaggtcatcaacatcaaagatcaaaggtagataaatccacaaagatgaggaaaaaccagcacaaaaatgctgaaaatttcaaaaaccagaatgcctcttctcctccaaatgattgtaactcctcttcagcaagggcacaaaattggacagagaatgagtttgagaaattgacaaaagtaggcttcagaagatgggtaataacaaactcctctgagctaagggagcatgttctgccaatgcaaggaagctaagaaccttgataaaaggttacaggaactgctaactagaatagccagtttagagaagaacaaaaatgacctgatggagctgaaaaacagagcaagaactttgtgatgcatacacaagtatcagttgctgaattgatcaagtggaagaaaggatatcagagtttgaagatcagcttactgaaataaagcatgaggataagattagacaaaaaagaatgaaaaggagcaaacaaagcctccaagcaatatgggactaagtgaaaaagtgaaaagaccaaacgtacgattgattggtgtacctgaaagtgacggggagaatggaatcaagttggaaaacacacttcaggatattatccaggagaacttccccaacatagcaagacaggccatcattcaaattcaggaaatacagagaacaccacaaagatactcctcgagaagagcaaccccaagacacataatcgtccgtttctccaaggtcaaagcaaaggaaaacatgttaagggcagccagagagaaaggtcaggttacttacaaagaggagcccatcagactaacagcggatctctgtgcagaaaccctacaagccagaagagagtggggtccaatattcaacattgttaaagaaaagacttttcaacccagactttcatatccacccaatctaggcttcataagcgaagcagaaataaaatcctttacagacaagcaaatgctgagggattttgtcaccgccaggcttgccttacaggagctcctgaaggaagcactaaatatggaaaggaaaaactggtaccagccactgcaaaaacatatcaaaatataaagatcaatgacaatatgaagaaactgcatcaactaatgtgcaaaataaccagcaagcatcatgatgacaggatcaaattcacacataacaatattaatcttaaatgtaaatgggctaaatgccccaattaacagacacagactcgcaaattggataaagagtcaatacccatcagtgtgctgtattcaggagacccatctcatgtacaaagaaacaggctcaaaataaagggatggaggaataattaccaagcaaatggaaagcaaataaaagcaggggttgcaatcctagtctctgataaaacaaatttaaaccaacaaagataaaaaaagacaaagaaggccattacataatggtaaagggatcaatgcaacaagaagagctaactatcctaaatatatatgcacccaatataggtgcatatatatgcatatatacacacccactttcataaaacaagttcttagagacctacagagacttagactcccacacaatattagtgggagactttagcaccccattgtcaatattagacagatcaatgagacagaacattaaaaaggatattcaggacttgaactcagctctggaccaagctgacctaatagacatcaacagaactctccaccccagatcaacaaaatatacattcttctcagcaccacataacacttactctaaaattgaccacataattggaaataaaacacggttcagcaaatgcaaaagaatggaaatcataacaaacagtctctcagaccacagtgcaatcaaattagaactcaggattaagaaactcactcaaaactgcacaactacatggaaactgaacaacctgctcctgaatgactactgggtaaataacgaaatgaaggcagaaatgaataacttctttgaaaccaaagagaacaaagagacaatcttccagaatctctgggacacagctaaagcagtgttaagagggaaatttatagcaccaaatgcccacatcagaaagtgggaaagatctaaaatcgacaccctaagatcacaattaaaagaactagagaagcaagagcaaacaaatttaaaagctagcagaagacaagaaataactaagatcagagcagaactgaaggagatagagacacaaaaaacccttcaaaaatcaatgaatccaggaggtggttttttgaaaagaataacaaaatagatggaccgctagccagactaataaagaacagagagaagaatcaaataaacacaaaaaaattataaagaggatatcacaactgaccccacagaaatacaaactgccatcagagaatactataaacaactctacacaaataaactagaaaatctagaagaaatggataaattactggacacatacaccctcccaagactaaaccagggagaagtcgaatccctgaatagaccaataacaagttctgaaattgaggaagtaattattagcctagcaaccaaaaaaagcaaaggttaagacagattcagagacgaattttaccagaggtacaaagaggagctggtaccattccttctgaaactattccaatcaataaaaaaagagggactcctcccgaactcattttatgaggccagcatcctcctgataccaaaacctggcagagacacaacagaaaaagaaaaaaaaatcaggccaatatccctgatgaacatcgatgtgaaattcctcaatcaaatactggtaaaccgaatccagcaacacatcaaaaagcttatccaccacgatgaagtcaacttcatccctgggatgcgaggcaggttcaacatatgcaaatcaatcaatgtaatccatcacataaacagatccaatgacaaaaacctcatggtttatctcaatagatgcagaaaaggcctttgataaaatacagcaccccttcatgctaaaactctaaaaaaactgggtatttatggaacatatctcaaaataataagggctatttatgacaaacccctagccaatatcatactaaatggacaaaggctggaagcattcctttgaaaactggaacaacaaaaggatgccctctcccaccactcctattcaacatagtattggaagttctgttcagggcaatcaggcaagaaaaagaaataaagtgtactcaaattggaacacaggaagtcaaattgtctctatttgcagacgacgtgattgtatctttagaaaacctcatcatctcagcccaagaactccttaagctgataaacaacttcagcaaagtctcaggttacaaaatcaatgtgcaaaaatcacaagcattcctatacaccaataatagacaagtagagagccaaatcatgaatgaactcccattcacaattgttacaaagagaataaaatacctaggaataaaacttacaaggtacatgaaggacctcttcaaagagaataacaaaccactgctcaaggaaataagagaggacagaaacaaatggaaaaaaaaatccatgctcatggataggaagagtcaatatcgtgaaaatggccacactggccaaagtaatttatagattcagtgctattccattaagctaccattgactttcttcacagaagtagaaaaaaaaaactacctttagtttcatatggaaccaaaaaagaacccgtatagtcaagacaatcctaagcagaaagaacaaagctggagccatgatgctacatgacttcaaactatactacaaggctacagtaaccaaatcagcatggtactgataccaaaatagatatatagtccaatggaacagaacagaggcttgagaaataacagcacacatctacaatcatctggtcttcagtaaactttacccaaaaaaaagcaatagggaaaggattccctatttaataaatggcgttgggaaaactggctagccgtatccagaaaacagaaagtggattcctttcttacaccttatacaaaaattggctcaagatggattaaagacataaacataaaacgtaataccataaaaaccctagcagaaaacctaggcaataccattcaggacacaggcatgggcaaagacttcatgactaaaacatcaaaagcaattgcaacaaaagccaaaattgacagatgggacctaattcaacttaatagcttctgcacagcaaaataaactatcatcagagtgaacaggcaacctacagaatgggagaacatttttgaaatctatccatctggcaaaggtctaatatccagaatctacaaggaacttaaacaaatttacaagaaaaaaacaaccccatcataaagggggcaacgtaaatgaacagacaattctcaaaagaagacatttatgcggccaacaaacatatgaaaaaaactcatcatcactggtcattagagaaatgcaaaccaaaaccacaatgagataccatctcatgctagttagaatgacgatcattaaaaagtcaggaaacaacagatcctggcgaggatgcagagaaatacactgttggtgggagtgtaaattagttcagccattgtggaagacagtgtggccactcctcaaggatctagaaccagaaataccatttgacccagaaatcccattactgggtatatacccaaaggattacaaatcattctactataaagacacatgcacacgtatgtttatcacggaactatttacaatagcaaagacttggaaccaacccaaatgcccatcaatgatagactggataaagaaaatgtggcacatacacactatggaatactatgaagccataaaaaaagaatgagttcatgtgctttgcagggacatggatgaagctggaaaccatcattctcagcaaactaacacaggaatggaaaaccaaatacctcatgttctcactcataagtgggagttgaacaataagaacacatggacacatggaggggaagatcacacaccgggcctatcggcgggtgggggacaaggggagggagagccttgggacaaatacctaatgcatgtggggcttaaaacctagatgacggattgataggtgcagcaaaccaccatggcacatgtatacccatgtaacaaacctgcatgttcagcacatgtatcccagaacttaaagtaaaattaaaaaaaaaagaaagacacaaaacttactaaaaaaaattcaagaagaatgtgtcatctgaaacaaagtcattggatttgatggttagaacatcattctctccctttattataacatcaatactgccaccaccaagtctttaataatggttcacttcaccaacctcagtgatcagtgcttgaaggacactggagaagtaaagtgattcaactttaatttattcctttaataaacttttgttggactttactgtaagccaggcatcatgcaaggtattagctctctgttgccactgaggtataatattagcagtgcctgctccctgctttatagctgggtcttagtataatttttcatagttcttcattatatcttcaaaagtatcctgatttggacaataaattatatttatgtaattatatttattacttatgggccagtccagtcctacatttcttttagcatgaacttgactggaatgaaacatctatgttggccatgtggtctatgaaaagaaccattttcaacaccattgtctttccaacataggctgtgtgttcctgaactcacctgtcccagacctgctatctatgtgttatctgccaatcaaccatgacagccattcaatttggattgatcttgatgattcagagtaactctgtcacttacaggaataacttatagtacaaagtatcctaaaataattgtgtattttagcactgttttgtgtcattgtgtttattgtaggactttttgccaaattatatagtgtgaagaatgagtaaggctagtagaactgacctggttaaactaaaatttctcctctatagaagctagactcaggatatttttagctggtcaataaagagttaagagtgttagctagaggcacttgggaatccaggctgtgcttatttctcaggtttatgaataacttaaacctatgtaggagttaattaatttggctccattccacctacagtttagcttcttgagcgaataacttgacccctcctatactctgagttcgtagttataaagagaactcccaacagaatgaataaaacctcacttggattgtctgagtttaacttcttgcatactttcatggagaaactataagatgtcaggcacagcacaaaatgtcaaaatacctcttcagttaaggacaaacacaggcattgtactatttctggctagagttatttatgattctgtttttttctctcttaaatgactgacattctgaagagggagttaacctgtgacttggtaacagtgatagagactgttaaaagcacaccgaattttgctcactgcatcctgacctctcctttccctagagaatagttcaaaacaaattattacctttgggacgataggtcagtttccttacctttgatgttctccgcgactaaataagaagttacaggtattttctcacttgtcagaattttaaaaagaccacccattaggttggcagatcttccttgtaatacctctaaaaggacatgagagatcagactggaggtaaggcctgttaactgagtgaaacagatgagctgaatcatatgatgtcgcaatgtaaatgtcacaatgtaaatgaagtgtgacttcatagaaagtactcatgtcactaggatcatccaatcttcatagctactcaagtgcatgccttcactgaacatcatgacattctagagtatagcctattagctgtgatggcaacttgtatagttttgctgacttcattaaaaaaatttaatccttatgaatcattcatttcataaatgtgactacattttatcctgagttgcaaaaaatactggctggggacaatcgcattactcacccaaacaattttatcgtaagatctgagaaacaattaccagataaggtgagaagccatcacctattttcagagttataaaatatactggatttcaccatttcccccactttgagaatttgttccaggatggaggggaggctgttgttctgagccatcttccacttaaattagagcattgggcatgggagtacagtccctgccccttgctcccaaaccacctggaggagaggatggcaatgttagagctgcagcctgaggtctcattactgaatggagcagcaactaccatttagtgagcacttattttgtgtcaatgatattgcatgtaaaattgcaatattgaatttaatcctgacagcatctcaatgagttagttattgtcactatcccaattttacatacaaggaaactgagaagcttctagtcatgttagctcaaaataactgtgaccttggacaggaccagaattctaacccaggtttttaggccaaagcccatgtggacttcactacatcatgaatcttcagatgaagtttaaaggcagggcaaattgacctaattgaagcctagctgaagccctcacacgtataggttaatacatgttgtacggtattaattcctcctctgttagaatttttacattcagaattatcaagaatttactgacacacatattagaccaggagatgtttccaatcacagggcatttactaggtcctgactgccacccattgattccctatgccttgcagtccaagaagtttggcctgcaccctgaatgctgaccatcctggaatctgtagctggggatttgtaagaattaaagtactcagccctagaggtaaatggaactatcctcttgtgtatctagaaatgaaggtaccttaaaccatgctcagagcacgtagtagtttcctgtggttgccgtaacaaattaccacaaatctggtggcttaaattaatagagttttattctcttgagtttctggaggcaagaaatttaaaatcaagttttcaccagggcactctctctagaaggtctagaggagaattcgtttcaagcttcttgtagcttatagtggccccaggcattggtgttccttggcttgtggctgtagcacttcagtctctacctgtcttcgcatcacttcctcttcttatgtgtcttctcctcttctgtcttaagtattcctatgccttccttttataaagaaactgctgtttttgaatttagagcctatcagataatccaatataatcttatctcaaagttcttaattacatctacaaagaccccttttccaaacatggtaacattcacaggttacaggagttagggcagggacatgtattctgggggaatataactcaacccactacaggggacttgacatccccaactgtgctctgaaatacaggaaaccaggatgtacagggccaaattggaccactaggaatatgaagagagaattatggctgccttccattcctactttttaaaatatcactcctcactcatcatgccccatcagtctccagattctcttaacagcctgtgggatcagtctcaggccatcctaggtccatttgttcactgaaacaaagtagtataagagaaagagtataaatttaggaatatgacagaagttggttaaaagctactccaataattcttggtgatatggccttggataagttattttaacctctctaggactcagaatgctcacctgcaaaatagaaatgagatcactttggtcacatgctctagggagaaaaaaatatctaggctttggagacaaggagacatgggtttatttcctggctctgccacccactatctagccatgcaatttggggcaagacattgaaactctctaaaccttagtttcctaatctgaagaataggcgtaataacttgaagagatgtcaagatttaattttaaaaagtacagaaaatatagttggtgtcaattcatgtttattaaatttatcgttgttattgttgttgatgtcagctacaacttacagagtacctagtctatgctagacattctgccatgcatgatggagcaatgcagatatgtatctcagtcctcctatagagcagattgatcgtaagggagaaagatagtattattgtgagaagctagcaacactactcagctttttggccactaaaattattttctttgaatacagttaagtcatctttgctcttgggtaaaattgcataaattttaggaatttagaagggaatgaagaagctggaggtgaattaaatattaatgggcaaacattttaactatggttaaaattttgatatcaagaccacagatcaaagctaatgtcttttctgtcaaaattcgtagattttaaatatatcctgggggtaagttgagaaatgttgatgactaacaaatgaaccttttaaaattgcatttacttttctagctgaatgctcctggagtttttccaatgatgttcattagggtgacaaaaccagcttgaatgtacataaatatcttgctttgtacagaaattaaagtgttggtacagacattaagatactaccattcaggccactgagagagccttccaggacaacaatctaggagttattacttcttcctttgattgcagtttcatacaaagcagtagctaagtcttctgtgatcagttcaaatgcaacagcacaaccaatggtagaagaaagaactttccaaataaaacagccaattaacagtttgacataaaaaggtgggcctagctatcattctagagattaggtaaaggaagcacaactttttggtttcatgaataggcaaatccaggttttgaggatccattgttgtgttcgtttattcaacagacagtgactaactacagccatcagttggtacttatgaaggattggttctagaacccccctccacaatgtggataccaaaatctgaggatgccatagtgccctatataagatggtgtggtatttacatatgacctacacatatcctctggcatactttaagtcagctttagattacttaaaataccttatacaatgtaaatgctatggacatagttgttatgctgtattggttttcttaaagttttggttttctttttgttaaatttttatctgtacatagtagttgtatatatttatggggttcttgacatatttttatttgtattttttattgttacacagttttttattgttttttctgaatatgttttatgtgtggctggttgaatctgcagatatggaactcacagataaggaaggttgactgtacttgagtacaccagccttatgtcaggtgctggcaatatatagataacaatgacttagccttaacaggtaaatttgaaatattttggtacactatggtgcattttggaaagggtatggcaaatagctttgaaagtacagaggaagtaaagcatgcctatgtcttagagagtcaggtgaggcttccaagaggaggggacaattcagctgcatttgagaagatgaataagaagcaaacataggattagaggcagacattttactaaaggcagaggccaaaggcataaggatgagaaaacacaaagaaaccataaggtagatgaaggtgatgagagaaagagttggctctttaggtctgaacttatgtgggaatcatttctgaggtgggttcgccaggaccaggtgatggataggctattgaaaaggaaaaagactgtggaggcaggcaagccatgaggttttagggttggatattggatgggcagttcaggtttgctccagtgccatggatgaaatattgtgtcctcccaagattcatatgttgaaactctaatcccaatgtgatgatattaggaggtggtgcctttgggaggtaattttgggagggtagagtcctcgtgatgtgattaatgcctttatgagaagaggctagagagatagctagttctctttcccccatgtgaggatacaatgggaaattggctttctgcaacctggaagaaggcttcaccaggatccaaccacgctggcatcgtgatcttagacgtccagcctccaagactgtgaaaaatagtcctggaggctggaagtctaagatcatggtgccagcatgtgtgtgtgtgtttgtttttttttttttttttttttttttttgaatggagtctcgctctgtcacccaggttggagtcaagtggcgtgatctcggctcactgcaacctccggctcccaggttcacgccattcttctgcctcagcctcccgagtacctgagactacaggcgcctgccactacgcccggctaattttttgtatttttagtagagacagggtttcaccgtgttagccaggatggtctcgatctcctggcctcgtgatccacccgcctcggcctcccacagtgctgggattacaggcatgagccaccgggcctggccgtgtgtttgttttttaaggccactccatctatggtcctttgttacagcagcctgaactaagacagaaattggtactaagaggtgggttctgatacaataaatacctaaaatgtggaagtggctttggaactagataccagaaactggaggaattttgaagtgcattttggaagaagctggtggtgaagggacttttaaagatgattctggtgagagctcagaaaggaaagaagaacactgtagacaaaacttccatcttcttagagaacaaataaataatcctgggctgggcgcggtggctgacgcctgtaatcccagcattttgggagaccgaggcgggcagatcatgatgtcaggagatcgagaccatcctggccaacatggtgaaaccccatctctactaaaaaaaaaaaaaaaaaatacggaaattagctgagggtagtggcaggcacctgtaatcccagctacttgggaggctgaggcagcagaatcgcttgaacccgggaggcggaggttgcagtgagctgagatcacgccattgcactccagcctggcgacagagggagactctgtctaaaataaaataaaaataaacaaatgaataaataataatcctgtatagaatgcaggtagaaatatgaataaaggccattctgatgaaatttcagatggaaatgaggaacatgttactagacaatgaagaaaagatgatcctttttatgaagttgcaaagaacttagctgagtcatgttcatgttttggtgttttgtggaaggtggaacttgtgatgaaattggatatttatttagctgagcacatttctacacaaactgttgaatgagcagtttggttccttctcactgcttatagtaaaattcaagaggagagaaatgacttcaagatggaattatgcaaaaaggaactagaacttaaagatttggaaatttctcagtatgtccatattgcaaaaaaaaacaaaatgtgaaagtatgtttgaccaaggaatctttgacagggagattagcatggatgtcaaccacaaacataatcagctaccccaatagaaaaaactgacagtttgaactgaagggaatggagatgggaaggaatggaggaaggctgtcagacttcttagattgtattggacaggaccacagagttatttgcttgaaaatgtgctttattcctgaagacaaggcaagaaggatcctaaaggtgattcagagatcattagtgccactgcctgagtttcaaaaggtcaaacaatctccacccatagccatgacgtatgggatacccagagccttaggggcctgacccctgcccagcagagttgcaggggcaagatggccaccccagtgggtccagaagttgggacctctgccccagcatgttcaggagacgagacctccatctcaatgggtctagagggcagagcattaagccaaaaaggattattctcaagccttaagatctcatggaatttgccttgctaggtttcagacttgcttgcaactggtcaccccttctttctttcctatttcttcattttggaagggaatgtctatcatatggccatctcaccactgtattttggaaagacatgacttgcttggtttcacaagtttataaatagagaagaattttgcctaaggatgaattgtaccttgaatctcatccatatctgatttagatgacatttagatgagactttggagttgaaaattaagaatttgggggttggtttgaatggaatgaattattttgctattagaaaggacaagaattttgggaagccagattggaatgcaatgaactgaatgttttcatcctcccaaaatccatatgttgaaatccaatcccaatgtgatggtattaggaggtgtggtctttggcaggtaattaagttatgagggtggagccctaatgatgggattagtgaccttataagaagaagacagtgttctcactcataagtgggagttgaacaatgagaacacatggacacagggaggggaacaacacacaccagggcctgttggggggtggggggcaaagggagggagagcattaggacaaatacctaatgcatgcaggacttaaaacctagatgacaggttgataggtgcagcaaaccaccatggcacatgtatacccatgtaacaaacctgcacattctgtacatgtatctgggaacttagagcaaaataaacaaacaaacaaataaacaaaaagaagccagagaactaactggctgtctttctgccatgtgaagagacaaagggaagttggctctttgcaatgcagaagactactctcaccagaacccaactatgctggcatcctgatcttgaatttctagcctcaagaactatgagaaataaatgcttgtttttaagccatccagcctctggtaatttgttatagctgccccaaatgactaagacatccagtgtctgttatggggagcagcactctttctctgtgcagcaaaatctgggctgccaaagccaatacttccctgatgcttccacagccccatctggctgattaagggctaattcaaatatcaattaatcgttcctcatttaatttcttttaaaacattttcacagtgcagataatgaggaagaatattctgctttgaaaagtcaaacaaaaccctccactttaaagaaattagtctaaaactgttgcaaattgtaaactagtaagtgagcagatagtgacaatttggtccaggagcttaagatttctctgtttcacaagggaaagattaaagcgttgcttcactatgtaggatttcccaaaaagaagggaaaatgcccagttacagtttttccaaaatgacctattgcatttcctctccttgacttggtgctaatagaactggtgatatgttgtgacctgaaaagtagaaactaatgatggaattgtggtgttaatagggaccactttaacactatgaaggcacagaaaggttatgtgccttgcccagcatcacacactagttattagcagatctacatgggacctgaagtcgagaggccaaaaagtttctgttgcctttccttgggtcattgctgcctctggcttgctggtgaatgatcattggatttggctaagtgaggatacagtaggaggtgaagtaaagagatgggtgggggaattctgacaaactctgagaggcaacaagttgtctgactcactgtgacaccttgaagaaataagcatgcttgaagcaggggctttatattagagaaatttggaaagtagtcccccaaggaaggctctggaggtggcagactgagtcatccttacttggaaaagagctgccatggtcttttgatttcctgccagtaaagcagcttcctcctcttcaggtgcagatacagagtgggtatttatactttagttccatcccaccttggcccaattttttttttctggggagtgaagatggaaatccctctgtggcttttcctacaggactagttggaaaaataggcagaaaaaggagtttggattttattatgtctgttgggtagttcctagaagatcttaagaaaaggagtgaatgctttgatttatttttttaaatagattactctggttctgagtgaagaatggatgctacaaagttaacgaagctaagaaagaaaacatctgaagcaattgctttagaacaaatgggtatagtggatcagattaagatggtaatagtagcgactgacaaaagtagacagaattggtatgtatatttgaaagcaaagtcagaaggacttagaaagaattgaacatgatgtttgaaaatgagtggaatcaatcctagctttcttatgtgagcaactagaaattgctgggagagatgatttgtgggtaagaatcatgagtttgcatctggaatcctaggtttgaggtccctatgagacattcaagtagagatgtcaagtagtcagttggacatgagtagaaatataaacttgggagtcatcaacacatacatagtgtttaaatctgtaggactgaatgaggccgaggtcatttagagtgagaagaaaaggagctgtaaaaaatatttagaagcaaagaccagtggcatagaaatagaactatgagaataaaatgtcctggaagcccagagaagaacagatttttttaaaagattggctagttggctgtgtcaaatcctgctgggagctcaagtaaatgaagagcagagatcactgactttgattacctgaaggttgttgataactttgataacagtgatgtctatatagtggtggagaaggaaaagctacattagagtgagtcaaggggagaaaaagaatttagggttgaaaatagtgatggtagactacttatgaaagagatttggttgtgaaaggggacagagacatggagaggtagctggaatgcagaggtgagttaagatatttgataaatagggtatgcctatctgctgatgtgggcaatcctgtaaagagggaaaaacttaagatgcaagaaagagaggaaagcccttgagaaggctagatgggttgagatggatactgagcacagttggaggagttagccatggagcgaagtaaggacatttcactacagtgctcctcctggtcaattgagtaaaggtcatcatatgtgactgaaggtctggatgttggatgtacatgtaggtttgagaatagaaaaaacactgtaacatcattgtgttggagaatggaagtgtgaacattaaagggaagtgtagtagactgttcaggcaacacagagggctcatttgaaatgtccaaccatgattttaaagtgaaacttgttaacactgctgtgtgcttttctcaagcaacactcacctgctaaaatacagcagtgaagtaggaagagagtagagttaactagagttggggctttgcaaggcagatgtgtgtgatggagggaaagagaaattagggagttaatatttggaaaatggtgaatataatggattatcaaatataaggtctggatagagagacttgaatacatgaggtagatgacgaactgtgagaaggtggtgaggtcagtaccttgcaggtcttgctaaaattagagaattaatagaatgagattactctggcatatgaactggaaggaaaagaagtaggctaatagagaaataagggcccaaaaatgagattaagattggccaatgagataggaggtggaaagtatttccaaaaggaaagagcaggtaactagtcaagatatcaagtaaaatagggatagaaaggtaaacattagacataatgacaagaagatcattgttgaccttaacatgagccatttcaatggaatggtaggattcattgtagtggattaaagattgagtgggcaatgaggaaactgacacaagagaactcaggacaccttttctttttttttttttttaattttttttttattattatactttaagttttagggtacatgtgcacattgtgcaggttagttacatacgtatacatgtgccatgctggtgcgctgcacccactaactcgtcatctagcattaggtatatctcccagtgctatccctcccccctccccccaccccacaacagtccccagagtgtgatgttcctcttcctgtgtccatgtgatctcattgttcaattcccacctatgagtgagaacatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctatcgtgaataatgtcgcaatagacatacatgtgcatgtgtctttatagcagcatgatttatagtcctttgggtatatacccagtaatgggatggctgcgtcaaatggtatttccagttctagatccctgaggaatcgccacactgacttccacaatggttgaactagttgacagtcccaccaacagtgtaaaagtgttcctatttctccacatcctctccagcacctgttgtttcctgactttttaatgattgccattctaagtggtgtgagatggtatctcattgtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttcttccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctccatatggctagccagttttcccagtaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattgtgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttgttgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttccttcctcttttcctaattgaataccctttatttccttctcctgcctaattgccctggccagaacttccaacactttgttgaataggagtggtgagagaggccatccctgtcttgtgccagttttcaaagggaatgcttccagtttttgcccaggcagtatgatattggctgtgggtttgtcatagatagctcttattattttcaaatatgtcccatcaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttgcatcccagggatgaagcccacttgaacatggtggataagctttttgatgtgctgctggattcgttttgccagtattttattgagggtttttgcatcaatgttcatcaaggatattggtctaaaattctcttttttcgttgtgtctctgcccggctttggtatcagagtgatgctggcctcgtaaaatgagttagggaggattccctctttttctattgattggaatagtttcagaaggaatggtaccacttcctccttgtacctctggtagaattcagctgtgaatccatctggtcctggactctttttggttggtaagctattgattattgccacaatttcagatcctgttattggagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcttttcaaaaaaccagctcccggattcattaattttttgaagggttttttgtgtctctatttccttcagttctgctctgattttagttatttcttgccttctgctagcttttgaatgtgtttgctcttgcttttctagttcttttaattgtgatgttagggtgtcaatttttgatctttcctgctttctcttgtaggcatttagtgctataaatttccctctacacgctgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgcgattattaatcctgagttctagtttgattgcactgtggtctgagagatagtttgttataatttctgttcttttacatttgctgaggagagctttacttccaagtatgtggtcaattttggaataggtgtggtgtggtgctgaaaaaaaatgtatattctgttgatttggggtggagagttctgtagatgtctattcggtccgcttggtgcagaggtgagttcaattcctgggtatccttgttgactttccgtctcgtggatctgtctaatgttgacagtggggtgttaaagtctcccattactaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcaggtgagatgggtttcctgaatacagcacactgatgggtcttgactctttatccaatttgccagtctgtgtcttttaattggagcatttagtccatttacatttaaagttaatagtgttatgtgtgaatttgatcctgtcattatgatgttagctggttattttgctcgttagttgatgcagtttcttcctagtctcgatggtcgtttcattttggcatgattttgcggcggctggtaccagttgttcctttccatgtttagtgcttccttcaggagctcttttagggaaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggttgcccttaacattttttccttcatttcaactttggtgaatctgacaattatgtgtcttggagttgctcttctcggggagtatctttgtggcgttctctgtatttcctgaatctgaacgttggcctgccttgctagattggggaagttctcctggataatatcctgcagagtgttttccaacttggttccattctccccatcactttcaggtataccaatcagacgtagatttggtcttttctcatagtcccatatttcttggaggctttgtttgtttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttcagcacttctctgtattggttattctagttatacattcttctaaatttttttcaaagttttcaacttctttgcctttggtttgaatatcctccgtagctcagagtagtttgatcatctgaagccttcttctctcagctcgtcaaagtcattctccgtccagctttgtttcgttgctggtgaggagctgggttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaacctcagctgcaggtctgttggagtaccctgcagtgtgaggtgtcagtgtgcccctgctgggggtgcctcccagttaggctgctctggggtcaggagtcagggacccacttgaggaggcagtctgcctgttctcagatctccagctcgtgctggaagaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttccgggctgctttgtttacctaatcaagcctgggcaatggcgggcgcccctcccccagcctggctgccgccttgctgtttgatctcagagtgttgtgctagcaatcagcgagactccgtgggcctagcaccctccgagccaggtgcgggatatattctcccggtgtgccgttttttaagcctgtcggaaaagcgcagtgttagcgtgggagagacccgattttccaggtgcggtctgtcacccctttctttgactaggaaagggaactccctgaccccttgagcttcctgagggaggcaatacctcgccctgcttcggctcgcgcacggtgtgctgcacccactgtcctgcacccactttctggcactccctagtgagatgaacccggtacctcagatggaagtgcagaaatcacctgtcttctgcctccctcatgctgggagctgtagaccggagctgttcctattcggccatcttgtctccactttggatgtaagccattttaactgggatgtggtaatatctcattatagtgttgattagcatttctctgataattatgttaagcaccttttcatatatctgtgccatttgtatgttttcttttgagaaataccactgtctggcactccctagtgagatgaacccggtacctcagatggaaatgcagaaatcacctgtcttctgcgtcgctcaggctgggagctgtagaccggagctgttcctattcggccatcttggctcctacccccaccttttcaataagttattgctgtttaaacatttttatgatagctgctttaaaatccttatcaatcaggtaatgctaacatctaagtcatctcaatgttattatgaactgagtatctttttttttttcatttatgttttgcgtttcctggatcttggtatgacaggtgatatttttgtttgtgtcctggacattttggctaatatattgggagactatggatcctatctaaatcttgtatttttagcaagaagtcactccattgagatttggcgtcaaggttctggcctactttgtgagttgaggctacaatggcagtttaatatttttagagctttcgcggtgctattttggtcggcatggtttatctggtgccttgggaactcccactggtccttgcttgtgctgcctgagggagcagacagggttttcccaggcccacagaaataaagaaccttccttggtaggccacttgtcgtggctgggcctttcccatcatttccacccacctgctccagcatcctctggcagaagaagggattcttgggtccttttttctcctttgttgggacaaaaatgcttcacgtacagggcaccctcttgtggtagaaatcccctggttgctgtttcctggatacctgatgtctctcaaaatgggagagagtgtcaggtccgtagaaacaaaaaacctttttggacaaggtctgcttgttggggcaggatacccattgccagtactgcctggctgcctggtgtttcacagtaagggaagagagtcctgggctgtcagggaaggagagtgcttcccctggctacttattattagtagggctcccaatcatgtccccttgctgccattcccaggttcacctgatattgtgagaggaattaccatttgatccagtaaagaagcaagcctacctgggctgccatctgctgttctgtcagggatcaggaaatgctgggtctgtgtcaccttgttctgttggatagggggaggatcataagacaccctgctactgtgctatttatccaatactgggatcctaaaccagttagccagccttttaccaccttacagagttttcctctagttgttgcttgcattattcccagggttcatatttgtattaatactttgggcagaggagcagggagaaatacatctacaccatcttgtctggaccagacatctgattgtagtttaaaggcctaaaatgggaagcaaagagagggagaggagagtcaacagagcgaggtcccaaaaagtgcttagagaaaagaactcagaacacagatgaggatataagtattagcaaaggacagagaggaaagaagatgcatattcagataggtttataggtttggtagcaggaatttgaggacattcttagccgatgaatctacttactttcctgtgaaacagagaggcaacataagagcccaaactcgatgttttacatttttggttatgaaccccagttgcacttcttaccagttgtgaggcctttggcatatcacttaaatccctgtgtgcctcagtttcccacaaaatggaaattaaaacagcatatatcctcataggaccgttatgatggttaattgaagtgagttaatatttgaaaatgcatttaatatggtataagtgtttgttatgtaggcaaaaatatctcgtaaggttcttacgagatattaaataagataagctctacaatgtgtgcagcaaactgcctggtatataacattcagtgttactatgattttcaaaagtattctttgcaggcttaggatattttcttgaagtaaaatcataggtcacaatttgccaatcccatgtttttgtcagagagggtctaggtgacagtgggcacaaatacataatatcagtcttggtagaaatagtagggatggggaagctgcatatgaggaactccaagatgcagttggagcatctatttccctgggaagctttaggcaagtgcccaaggcccactgagcttctccagccttagcatacattttgctatgttgtatgcagctttctgccctccttttcttgaagtctgagtgctcctccagggtagagaccggcaataggaaaaggtttcaactccctcacatcacaacatatctccatgctataatatacaccctctcccaaagtaacatttgaaagtccctgagaaagccaaatggactcaagtgtctggaatatgttaatatgggcagtcagctgcataaattgcaaaacagaagtcatgcttctatgtattctgtgacagcagaaaaatcgtaggatcttctatcacgatgggaaaggaatacaaagaagaattagtgccatcttgtggagtgatatatcattaccacttaagagtcgccagtgagaactgggttatatttttttagtatctcccgagtcctggtctgcaagaaatgcttgaaaattacttgcagaattaaatgaataaatgagagacgagataagaattggatggagactttgttaatttaaacatcaccttgataaaatgtttgacgcactgtccattgcgatttggagacctttaaaaatggtgttgtagacaccccaagtcattattatgtacctaccataaaggaaaatgaagaataaaatatttgcattaagaaatcaagaactatgaactttttcttgtcctggccttatcagtagtaggtgagtaaactttctaatggtatttttctcttcctgattatcaatgtgctgcaaattaataaatcattcaaagaacacgaagagctggggcacagtgactcatgcctgtaatcccagcactttgggaggagaaaaagggtggatcacttgaggtcagaagttcaagaccagcctggccaacatggcaaaactccatctctataaaaaatacaaaaataagccagcgtgatggcgcatgcctgaaatcccagctacttgggaggctgaggcacaagaatcacttgaaccttggaggtggaggttgcagtgagccaagattgcaccactgcaccccagcctgggtggcagagcaagaccctgtctcaaataaataaataaacattttaaaaataagaaaaacaaagagcatgaagaatatgggtagcttcggagcaggtgggtgttgtccatattctattaagtttaatgaaaataaattgctgacaatcaactattttgacctataacaatgtcagtttcttatggattggcctaatattttaaatcagttcacttaatttattctgggtatatgataggtcaggatattgtagtaggccctagatgatacagggacaaataatacatgggccttgcctttaggaatcttaccatttggtgtggaagtgggcacttagataccatgccttctattttaataatttctgttaagtgccaacagtgtggagttaagccaaattttgtggaggtgctatgagaggtctaggaaagcataatggtttggaatggtgggtaagagcaaggactctggcaccaaactctctcagtttgaatgttaatttcactacttactagatgggtgactttggccaaagtgctatgcttttctattcctcagtttcctcatatatcaagtgagatcacatactgcccacctcatatgattgaagcaagggttaagtgagttccaaagtacttggaataattcctcatgcatagcaagttgtgtataagttttagctgtcttcgtcaccatcatcagtcatcatcatcatcatcattaccatcatcacctctattcctgcagaagtattagagttgtgttttgtaagctgagttaaatttcattattcgttttttcttttgaaaacgttgccaataatttatttattgagttcctatttttcccagttcctgtgaagaatgggtaggaatacccttacctacttttttctactagatcatcatttttgtaaatctgggcctgaggcaagagctttacaggcaaaagcatgggacaatgaaaggacagaggacagtaagactgttgtcattggaatgaatggctcatgggggcttgtatcaagttatggagaagataagccaagacttagattatttgtatctattcacgtgtatatttgtgaaggcaaaacctgttctcggttggctttaacaaaatcagctgaaatagctggacagaagctacataaggtaagggcaaaggcatgctgcattgctggcatatagtaccttaggcctattctgtggatacttggttgatgctgaatgctctttgtccccaagttgtaaaatcacccctccttgaaaattattctctaataaattttttaatcataaattaattttgtgccatggcaaaggtattgacagctaagaagtaaaactgtaaaattaactgctatggactaagaacggctaaaatttcactttgtttttaatgccttaaccacctgacaacatattgtagcatgactttatgaaacatggataacattcatcatttgagtctggagatccaaattcagtatttcagagtgggatcatgatgggctgtagtcatgagtgtttactatgttgtaaaaacgtccaagtgggaataatgacatgtttgcactccctgtgacttgatcactgaaatctggaaagctcatcaacttcacccattgtcaagtccacctttgctcctttgtcctctgaggacccagtgagatcagcatttttctggaagggctgcaagtgaccccactggaaggagcagcactgtgcatcaggatggattcccaggcacactatacattgtggggtcacaggccatatgggtggactaactgatttcatggctgtatttgaattgacttccctcctggaatcctgatgcctcttttaattttatgtggcaactatcatttgcttttgctgatcattcattcaatcacctctatcatttctcaatgagggcatttttaaatatattatttatatatttttatttttttttttttactaaatatagaccagccatcaacttgaacttaaaaactgacacaccagttagttcggtcaatagtgcagaaatattcttctatgctactatgatttgagcccactatagatacttttatagctagttatgccagcaagactcaatgaatgatacttgtccagattgctatcaggagctaatcatatgaaaggtaacaccagctttatgtaggatctgtttatacttagggtacttcctggattttgacggttttcaaagctaatggcctattaaataggtcccagaggtaaaagaaaaagtggcttggcctaaaccatggtgaatcatcttatggtagagttcaggtttctaattcataatcttgttagcagaacgtgcctttgaatggaaagtaacgtacaacctctgccaatctttgcaactcactaacaaaactcagcaaagtttgcccaatgccaatgtttaaaaaaatggatgaaaacagcatggattgaagaactcacatacaaaatatataaggaatgaagacaaatggcatcaaaattgtatctgggtaaaacatttgctgttgagtgtgccataatttgagagcacaaacacagccttgagggtaaagttcaaggtacgggtgtccccttttctaaggggacataacacataagcacataacagtcctcctgttatgtgctaaaagaaaggaagctcatattagattgctccagatgtagaaatcataacaacaataaagatgataatattaacaagtctaatttctggaacatttagcctaatgtttaggcatgtttacatgcctaatatgcattatcacgtttaattcttgctttttttccagttgaaatcttattttattttttacattcagtatattaattttaaaataaattttgtgcatatttaaggtatacgacatggtgatggatatgttcatttgtcccactatagagatgattttactatatatatatatatatatatatatatatatatatatatacacatatgtatcttaatatttgcttttatgaaatccttgtatataaatatttttattctcctcaatgtaatattttaaaaacttcattttaaagaaaaaataaatttatatgctctcttaaagcagagagaacaaaacctaacaaatcaacagcaaaaatgaaggcactctttttcacttcaaatggatttgttatcacagtctgtacagaatttagcagtgacaccttggtgttctaaatccttctaaactgagtttcctccttttttttctgcaagaagagcttctttatcttccagaatcatgactgtattcttttccttgtatactctatcttgcagtcagggaatgaccggagagcgttctcatgtgtctctattaattactaccccaaatatacctttttctggaggggaagtaccaggaaaatcttccctgtttagctgttgcaggggtatcacatgttgggttttcagatgtagcaaacaaaaatagaggccagccagttaaatttgacttcagagaaacaacaacaaaacaattttagtataagttgatcccaaatattgcatgggacagacttgtactaaaaaatgtatcatttatctgaaattcaaatttaaattggcaccctatatttcatctggcaaacctatatactaattataatttccagattacataattgagttacagcagtaagaccaattttaacttgtttcatcatagtgggaatcctgccgaattgtcttcacttccttagaaacaaatgagtagcagatgtctgatttggtgaatgggttatcagctgagtacaaccaacttacataataatttaagcaggagcaaggatgcatgctaattatatgtaggcttgcatagaaatttttctttagtttactcattttagatgtatagtatttcagagtctgaaaaagctgtggaggtccatcggtgtaatgtcacctccaaaatcccccaccgtggcctgggaccccattctttacactgtagggttgctgacaaaatgttaccaggccagaggggtcagtcgtggccaaagaccaacccacattctgcttttcaaaccttgcacccacagaaggcacttcccaccttctccaccccacaccgacccagacatgtacatacgtgccttgcacttgccagatcatgcactcccagtttgtgcctcctccgagctggtgcctttttatataatttgcatgaaggcagtagactcttggccctgattcataaaaacatttaatgcccatttgcaaagtcactacccagagccaagcaccacattaagttctgggaatgcagagatggatggggcatggtctcttctttctaggaaattagagtctggcatgggacagacaagcaaagaaatcatttaaaaacgtgccacgatagtaggtgtgcataggacacgatgagagcacagaggacagaaagctatctcagcctagtagcatggaactaggagggattctcagaggggttggaacttaagcaggatgtaaatgaaagaatggggttagtgagtcaagagggggtggaagggagggagaaaaggcattctaggttgagggtgacgcagcaccagcaaattcacagagatctgaaattgagtgccctgcttgggaaacctcaagataactcattttagctggggtaaaagtggggggctgagggtgtggcaaattataaagggtctttacagagagaatgatttgggaaacactgaattaaacaatgccctgtggggtaacattgctcctgctatattccccccagtgccgaaaatattgactagctaatagtaagtactcaatatatgttttattaaatgaatgaatgaacaagtgattgaatacatggcaggacttgtcagagcctttgatagaacaatgtgtgttatagatctcaagagaggggcatagtatgcagaattctcaccttatttgaccacataaccgtttttgtcactgaataatacatttctaaaatctattatttttgaaacacacttggggaaatcatgttctaaaggagacatgaaaatgtaaaactacatgaataaatagaaagtgagagaaatctatgataaggtttcagggcttatgcttacatgaaatggtgctcaattttttctctatcgtcttcttggaactaggtgattcattgatagtgggcagcatgagaggccggacacaaggtgggctggcccaaattccagggggctttgcaagtcctcttcggcaacaataatttgtattcactttttattttcccttgtttacacgttcagattgttctatagctaatcagaaaaatattcactttccctgtgggcctaatggtcccacaccaacgctaatctcagaaactgtggtcttaaggtaaaaacatgtatcaagcgctaactttacaccagacactttccacattttaacttactgattttccatgatggtcatggttataatggtataataataattacatattgaatgtttactctctgccaggcagtgggctaagtacagtttacaattgttatctcatttgtccttcgtgacaacccaactcatttataacaatactgaagcacagagaggttaagtaacttgtaaaaagttacacagctggtaacttgcagattagggaagtggacctgggtctgcctgatgccaaagcttacatattacatgtttaaccaccccgccatgttactgttaagcttactataaatcctttgcagtgtataatcaaagagaagttcaatttcactcctatgtccatacaaatatatcttcaagaaaacaatcctaacctcaatgactaccattaaataggatccatttatacctacttgccaagtagtcatggatcagttatgtatcattgctatatatgtgaataggtcaagcgtgttacagtgttattagaacagtcaaccgaatcatgttaaaccctgattcataacttgtacttgatgcaggatattaactactcacagcataacacaattagacacccccagaacagaacaaaagcagtcaagagtatgctgtgctggaccccaaactagtgagttccccactcttccctcagaggctctagggatccatgaatctgcttcttctatcttctcacacatagaccaaaataaaacgaagtaggctggttgtgaggcttaatgaaatgtctcctcctaggctgttggcccagagactggccacttgtgaaattatatatatatatatatcatatatatataatatatacttatatatatatatataatatatacttatatataagtatgatatatatatatactacttttgactttacattttgcacttgcatttaaaagtattcattcagatcattgcatagtccttgtagttgcattaataggtaggaatgacatattttaattttgtcgtaaaatataacatacatacaaaagagtgcatgtacaattaatgatgaatatttacaaactgaactcacctaaataatgagcacccagatgaagaagtagaacattaccagcacccccaaaaagagccactgtggtcactaacccttaagggtaacctctatcctaaattggaacagcataaaagctagaagaactgaaaccgtggtctagctactaaatgacagacatacttggactatctgactccagagcttatacatcagacaatgcatgcttaaaactacaagcctttccacatttcatagagggaagaatatttttagttcaaaaaatgtttcacgatgtttgaagttaaaatgacgagtttctaaatagccaggcctgaaagagtgaccatggctgtggagaggggagcccatgatgatggctgactttcatgatgctgccccctggatgggttcatgacagtagtgatcaaaaagggctaagggccaagtcctaaacctctgtaactttgcagtcccttcggggctctcttttctgagaagatattcccacagtagaaaactgccactgacaaagtttcattggccaggtagtgtgagtcttaattgcaaccagattttatgtggcggaacagacaacactttgctctgatgatgtaattcctgccaaactctgtagtatatctctggtttctaattctccaaattcccccatggaattgttattcccttttcacagatgggaacactgatgttcagaaagtttaaatgccctgaccaaggtcacatggctagtaaattccttggccaggatgaaaagccatgtctgttttgactagaacttctgcctgtatccgttatatatcaagcttgaaacactccatagcttcaccaagagttgcttcattggagatagtttgactatggcctccagaatttcagatagatgtcctgaatttctactattttgagatgattcagaaggaatttgcagggcctcagaatgatcattaatcacatcagttactactgatgatatcagaaccagactaaagtattgcttgtttctcaaagtttgatccatggaccagcagaataaaatgaaggatctcaggccacatcctagacctcctgggtaagaatttgaattttaacaagatccccatgggacttgtgcacacattaaaatttcagatgcatcattgaatgcctggaaacaaagtttagtatattctgcaaaatgggctatgtggattttatatcttggataaaagacataaaaatatgagtgagattatttattttatttcaagaagaagaagccagcaccagtgccttgctgaggccaagaaactcaacttggcaatcccaattcctgaatcctgtttccataatcgctctccaagttctggtcccctctcacctcacatcatatagcagaaaacgtagattcccctgaagccgcttagactctgaaaacttggcccacagagcctcgtccttgagcacctgggcctgtgaatcatctgggcatggatgctctggtgagctttcccggccttggaacctcacctacaaccatttaatcgttgacaaggttgacaaagacaagcaatgggaaaaggacttcctagtcaataaatggtgctgagataattggctagctatatgtagaagattgaagctggaccactacccttcaccatatacaaaaattaactcaaaatggattaaagatgtaaatgtaagacctcaaactataacatgaggagtggtgagaagattctaacaggaaggatctctctccttcactttggtctctttgcaggcatgttctatcgttagcattaattaggtttacagtattcacacacctgctagggaaaaatagactccttaatttgctgcaaggtaaggaaacatcagccatctcagctatgcctttgtagacattataaatcatgtgcaacatcaaaaagatatttaagctccctaaatatgggttgcgttatttgacttctaatagcattctgactagcaatagcaaagagaaatgggtttgcactgaaatcatgtcagcagggaggttgtaactgctactctgaaaacattcttcctgcttcccaaggcattttgtcattagtggaacgaccactgtgcaattgatagccttccagaacttgttagctctgtaaagttgatgtcctctaaaatttcacattagcaagagcacatcacagagtcattcattcatttatacaacaagcatttattgaccacctactatgtagcaggtgcaaatctgtgtgctacagataaaatggtgaggaagtccaaactcaatggtgagctctctgggtgagacagacatttaacaaataatgctcaatttacactttaaaaaatgtaagtattggtgtcaaatgctagtacacaaaggtacaggctacagtggggatcggtgagaaagaattaagtcagttatgtagacatggaggatggagtcagagaagattttcttagagaaatgacttttaagctgaggtgaggtctgaaagatgaatgggtgtcaactaggtaagatgggcgagagagcagagtggaaataggggcttcactcccagcagaggaaatagcaagtacacagtccctttggtgggaaagagcatggaacattcgagaactgaaacaggcccagtaagacttgagagtaaagagagaggaagagttgcacacgacaagtgtgattgtgcagggccttgatagtcatgggaaggatggtgatgttttctctagtgcaatggggagacctcaaagggctcggagagattgagtataatttgttccaggcctcacagctgtaaaggacacagtggtgattcaaacccaaggccatctgactgctgagacagctctttcaatcacaatatagctcctgttcatttttatgcaactacactttttctgaaatctcctccaggccttaaacttcaggccatctctaattcaaattgtgccttgatttgttttgaaagatgtcttgggtgttttctactacataacaaatgggcactgggacagagtgcctgttatagtaccagtgagataagtgagtctagctttctatgtcaaataagctggtggaatttataatagagaacaggaccacagaaatctatctgaagaaaggcagtatgtgtcattagattctgtaaagagaagccgtgcctaatagatctggaattttctgaaggggtgactaagcaagtgaatgagggagagacagtacatgtaataataatcacagctgcatgcaaagcatttttgcattacaaaacactttattaataattacttctctcactggactgctgtgaacattacatggaatgatatattattgcctcatttcacagatgaagaaagaggctcagtgaggtcataagacttttcccaaatacatattaaggaaatgatagaactcatatccaaagcaagatccctccaactcctgagttcttaaccattttattgccattcagaggcttagcacatgtttattgtgttgaatagatgcttgccattattgtggaggaacttattgaaaagaagaaataacagccatttctctgatgaccccagatttctttcctgcctctgtgttgcctttcaaatccccaagaaggcatgtttatatgcatcacctaattggatccttacaaaagtctaaaaataaaggtaaagttaaccacattttataaaacaggctactggagcattaagaaaggggttggcaaatttttctgtgaagtgctagacagtaagtacttaatattttagggtttgcagcctctgttccaactactcaactttctggttagaaaacagccatagactataaaacaaatgagtatgattgtgtctgtaactaatggcaggttctataactatagttacagaccttgacattcgaatttcacataattttatgtatcatgaaacagtcttcatttttatttctttaaaccattttaaaatgtggaagccaccctaaacttgctgctgtgtaaacatagatggcattgggccagatttgaccttgcggccacagtttgcctttaagcagcctacactagagtgtatgcctaatagctgttatactatttgcaaaaagttgagtgtttacatcatcgggggttagaggattgctccatatccaaactttatttcgggcagaaaaatagaatgtgattttattcagctagagtatcacagggttaattacacatgctttcatctggaaaagcagcccctcgtgttgaggtttatgccaagagtctatggcccaggttcagagatggcatgcttcctcatcacagtttgttcctgagatgctggattcttctcatagttccctggatctgaagttctttaggaatggaaggggcttctcagctcagggtctaagctagaaacacagtcagcaaaggctactcatgcagggggaagtaaagccggtttggaatgattggatcagtggaactgccagtgcttacctttctactacgcctcaggcacagggtagttggcaaggtatctagttgacaacctcttgcttctttctaaggagcagccagctggtgtgtgagcacttattgtcctcatgctgccctggtccagccatttccctggctctgttttctcactatctgatatgtaaatgcaagagtgacagctgtcccattgctgaagatgtattattaacacgggatgtagcatataactgcaacataccatgtggagaaagagctaaaggccatgttttacagctggtgacttaaaggcgggcagggggtagtgcacaaagggaagaatgccaactctttagtatccactgaagcagtccctcatgttgaggttcatgatttagggtagaggataatactgtgcatgaagatgctaattaactgttaccagaacactcaatccaaaaacaaatgttgactttagggtcttagcatctaattatcttgcttgcagtgcaagagacacagtgtctttgcatatacaacaagccacgcttttgtgcacaggcaaatgtgttggatgtgacaatgcaaggactacaaacacttgtggagtgtgttctctatcggtccccaaaccagcaaggacatacatgatttcccagctggacttgtaggtagtaagtatccacccaaataggggaaacccctccatatatatagaacatgtatatatataaaatatatatagtttgtgatctgcataatatattatatatttacataagatgtgtgtagtgtaactgaaacaatggatccctttgcttaactcacagcatgctttgaaatatatatatgtatatataatataaactatgtattatcttggtgtatatgatataatacatacacataaacataaacattttttcccaagtttgctgtgagctaagcaggtgtctccattttctctacttatagtcaagtatggtaaaaacaaaactcagccattttggaaattatgtacaagactgtgtctactcagcagttctgctaacttagattctggagtttggggacctccttaagggtatttcatttggacctgagatccagcattcctgggcttcccaatggatcacatatccaagccaaatgtagtgaacacaggaagactgtgattcaggtaaatattagctattattatcatcattattatatgctggatattgctttaggtgcaattttatgcatgatctcatttacttcttgcaatatgcctatcaagtaagtactactattattcccattttacagataagaaaacttaggcacagagagggtaagtgacttgcctattgttgcatagcttgttagtggtacagccagggttcatacccagacaatttgactgtcaataccaagatcttaactctaacactatgcttcctcctcataagacagaattgaagcccataacgtcctaaatgtggtggagaaatataataaatttgaagaaagatgtaaattttatctttgaacaaccagccaattaatttcttctttgtctaaacagtcttcctctcagtccaaaaaatctagttctcacaaaaatggatgaaattaaaattacctatcctttgttcatcctttcattaaataagtatttattatatatgctagggcagtaagtagagatttcagtggagttaacggctatgaaattcttccacatacagtggttatcaggtcaaaggcaccattgggaagttggtatcaagccaaatgacattgaggagtcataaataaagttgctcctgaaaccataggatgagatgagattgccacatgcaaatgtctagagctacattagccaataagataggcacctgccacaggcagctagttaaatttaaacattaaaattaaatgaaattaaaatttcagttcttcagtcacactagatacacttaattatcaatggtcacatatagaaagtggccactatactggactgcagaggtatagaacctttctattatcacagaaagtgctattgcatagcacttacctagagaaaaaaggcaagaagagaaagaaaaaagaggtgttgacagacctctgtcaccacctgcaattaggagtcagaaagtggaaaacgacgcagtaaaggagacaaaggaggggatggatttcgtggaaagataaccaggataatgcagagtcaggaaagtcaaggtatgggaatatcaaagaataaagtgtggttctcaatgtccagtgctggcaagcagtcttttgaagttaaaggtcaaaaatatcctctggaggtggacatatggggcaaacatgatggacactgatgatggggcagctttgttaaaccggcactgtgctggacagtggaggtccctagtcacagtcgctgctttcaagtccaatggggcagacatcatgaggaagtgcagtattgatttgctttttgagcaactgacttgccactggcttactactggctttaaccctgtggatggcagcatggctccttacctatctgctgcctcagtggtcctttcaaagcctttgaccttaaacattcccaaagcagttccaggagtggtgaagcactcagagctccgggagagcagtactactcagttcaagggtgttgactgagtatagtaatgagagtaaaaaattgtgtctgtgacctttgtgaaattcatcagtaatcattaacaagatctgaatggcaagcaagagaaagagcaggcagcattgtagagaatattaaatctcaagaaccataaaaaagtatcgtcaaaggccttttaagttgacttgaattaaacccctgaagttctttcaggcacatttaacatggtgattctgctgagatcagggccggagaggaacataaatctacatgatatgacagtatctacatccagtatctacatccatgtaaatctacatccagtatgacagtattggattttgatccagtacctgatgtaatgcaatttgtgaccagacacatgttcttagaagctgggagaaagtttagctttcattttgacctgtccttacttgattgttccaggtttgtttttttgtttgttttcacttgtagctttctaggcacctcttatggtgagatgttagagaacctaggttaacagtttagatatggattctaatctggctctgtgttgacccagtgacctgtcaataaagtcctcatggtacattatggtacaagaggaaagaaagctggaggacttgacagtaagctcacattgaagtggaatcctggctatgcctcttactagccacatgaccttggacaaagtagttaaacttgctgagcttcacagggttttgtggataaggaggagtggtatggacaaaggcaagcctgctagccctcagtcttctaacttgcaactaattgtctgtaaatgttttcctttgttttggccagattccccacaacaccctcccctgcccaccttggtgggttccagaatctctcttctctaactttgtaaagtggggctaacaccgaggcaggcttgtgtcagctttgtggtcctttttccctaggaatgaacactggaactcaaacgaaggggaagagggttaatggaaagaaactgctttttaagcacttgcaaagggattttattccttgctttctctttggtccaagtatgcacacacaggtacatgcacacatagacattcaaaccacacagtggtgcctttccacttattctgtttaggatgactgcaaagaattgttgaaagatggtaaatatgtgttaggtgcacgacaatataaataacatcgatctgggttaacggtgcattgtttaggaactctggcacaaacatctttgagcttaataatggttgctaaaggtgacaggagttcagaaagcagaggactcctttcattgtaacaatcatctccccacttacccccactacatcctcatacaccccaacaaggcatgcatagcatccagcagagttccaggcatatagcaagggtttattaaaggctgttttcattcataaaatcactggtgctaatcgttaggtatagagaagaggtgaaatataggatcttgaccttcactattaacagtaacaattgccatttacagaaggcctatgatgtgtcagctgctttactgctctagcctcacaacaagcctacacagctccaagttacagatgaggagctaaagttaagagaggtgatgtaattgtcgaaagtcacatgacttctaagtggcagagtggatttaggtctcttggattccacagcccataccccttccacttttccaatgctgcacttgagaagtaggccagttgggacaatgcagtggccagacttcagctacagagtaaggcaggcgggactgcactgagaaggttaaagattactgcatctcccctggaaaccagggcctgagaacagcaagctgatcttttgtagctgctccacatattttctttctcctcagccagcattagaacttcattcttcccttgtttgcttgttcagagaaacaggtgatgagaaaagcacacttgaggtgtctggagagcaatgccctgctttgcttactataaatagctccctctcagccagttgccataaatggcattttacaggggaggcaaccagtttgaaataagccctaaggagatgtcggggcatcaatattcgcttggtgtatgcagtgttcccaatctattgcagaaggttaggagtgttgagttcttgaagcaaaagtggttttgtcagatacgtgatgccatcccaagcccttggtcagggaatctgcaattacccagaaatctgcttttttaatttatgaaccaaaagccagcaatgactcagaccaacctgcaatggaaaccaaatgtggactatgtgcagtaaatatttttacgctctcagcttccactcattactttttgctaccctgttggccttaaggagttgtcgttcaaggaaaggacctgcctgctgttccggcaaacctggaatgtgagcacttttgtattaaaatgtgtgcagaccatcctaaaatgattaaaaggaggagcatgaatttattcacatgagtcgctttcattattttccattagtaaatagccaaataattgattgtggagctgttatttaattagcataaatgaaatgactgttatatggaatagaatgtatatattgattttggctgtgtcctttaacaaggataaattttcttacttctgacagtttttgtaatcaaaactctttttttgctgaaaagcaaaaagagctgggggaccagaaagcttcagggtaggctgcaggagccaagcagtttaaggaggggacacatggtatgccaagggccttgcatttcctgtgtgagaggagccagattggactcatctcaaccactagctagtggtcactgagaagagagggtcgaagatccagagcagagatgagtggagagctgcaatgccaagcatgaggacctaggaacttgctgtgtttttcttgtcagtttcagtggtccggttgctgaggtcttggctgttgattgctctagctgggatgtgtctggaaaagaccatgcatagaaatgtacggtccttgctttgagaaggtaacattctgggactaaaacctgggtgcaagggaagtgcactgagcatcaggagacatgctgtgtgaacacatgacaggtccttttctcttccccagagtacattcccccggtatgtacattgagggaggaggagaggactaggttccctgagctcagatgggaggaagaagtgtagtagtagggacatttagggatcactctggcttcccctgcatttgtttctccccttccaacttgactttgaggagcagacacagcttccttattcccgcctagtaaaagttaacttgccacagatttagagctgaatttcagtactgcatgtgctagttcagcacagtgactaacagtacagtccctgaagtacaattgacctgagttcaattcctacccttactacttttttgatgtgcagctctgggcaactcaattatccttgattttcgttttgtcagacatggatgtaataatactaccaattcacagggttgctaaaggaactgaagtagatcatccatgtaaagcagctgtcacagaatctggtgtatagtaggttctcagtaaactttcctcattttctattcctttctgccttcctgatggtcccacatctccttgcctgtccctcattgtagcactcagtatattgtcttccttattcgtctaaacaattcaaggtcagagatcctgtgttgggcattttttggtgtcttccttcctgtgctccgttgccatgtctcatatactgccagctcactattggttcacacacatttctaggcacagaaaaaaaaattcacagagaaaaaaaattcacagagcagctagctcttccttcaggcctttgactgacattttaaggatggcagaaaacacagcaaaatagttgtttttagagtttcttggaaattcacagaggttccatgctggatttgaattcacctctaaatgtctattcagcaccaagttcagaaaattgcaagccacttgggagaatatgccaagtggcatgcagaaaattgcatgccacttggaattcagcgacatacactataggtgatgctcaaagggtggggaggtgggaaaggggtgaggttggcagggaaaaccctgaggcagtagtgatcaatgcacatgatatgtaatgtgaccaagagtcaaaccaggatgctaggtatgttcctcaggcagcatgggattaggtaccaagccagtaaatggcatactaggtgcacagacagggttgtttctcatcgcacccatcccctgcctctgtgtaccttttgctcaactccttcgatgtggctccagtataggtcccttgtcactatgcaccattacacttcaggaaaagaagccttactgcagcttgtggtgcccaaggaaggcttcacagataacagaggtataattcagcttggaagtaggtaaaggactggaattagatcaagagaaagaaggagggtgttccagatggagtatatagtggacatcacctggagccagaaatatggatggcatgttggggaaggaggattaggaggagggacagaactgtgagttcaacaggatgactggagtgggaaatttacaccccagactgacaatgtaatgtacaattgtcccccaggcagcctggtattcctgaaggctgcggtctgacaaagggctggggtaggggaattgcaattagctaagagcaaatggttatttctaaaagcatttctagggctccccatttcagttagaaacatatggcactggcaagggtccttgctttatttgggcccgttgcttagccttccctggccacaaattgctatggaaaaaagcagaaaggcagctgtcctgcctgaaggagcaatcattagctaatgctgccatctccaggagcctgcctgctaatagccagcacacagcagtcctgcttcaaactggctgcccaggcagactcctcccacccccaccgcagttcccagtgactagtttggcttctccagcctgaaatttgactggacagctggagagagggagaaactgcccagggcttctggaatccttgactgccagctgccttctcttttctctggtttgacaggaattgtagcaaaggttttcatctggaggatgagaaactccttttgttagtttgctagagctgccataacaaaatacggggtgacttaaacaacactaacttattttctcacagttctggaggctagaagtccaagttcaaggtttggtttcttctgaggcctctctccttggcttacagatggacaccttttccttgtgttctcagacagacgtttctttgtgcatgcatccctggtgtctctttgtatgtcctaatatcttcttcttataaggacaccaatcagattgaagtagagcccatcctaacagcctcattttaacttaatcacctctataaagaccttatctccaaatatagtcacattgtgaggtattgggggtatttcaacctatgaattttgtgaggacacaattcaatccataacacactgcatacagttatcagagagccctgattcttttcctctctgaacctttgtctccccatcattacaataatgggttagagcaagaagcttggagttcttgtcaaacaacaagttttgcagaaaagaaatgcaagtttgtgatgacttgctaatgaatggtgtttcacagttcagggtgatttcttattctgagaataaactaatgtaatttcattatagagtttgaacttgctatatattttcatgtatttgttatttaataaccatgtttattgccttatgcaggccacatactaggctaaatgtgagaaagaaaaagctgaatgcattagatcatatttttgaattagttcttattataagtttagacatgtattccacaagaaattgttggaccttgaagtgtaaaaatcaaaaccaatattgagtttataaccattcctctaactattaacaattggtttgtaagtatagactttgattaacttaattccctatagagaattctctggttggtttattgattgattgattcctgaattccaatagtatttttaatatccacaatgtgcaaggcatggagttaggtgctagggatatggtggtgagtgaaaccaggaagattactgccctcataaaacttactgtctagattgaatctgaggctacttgtttatttcatgaaatgtgatgagtgtatagtaaaagatatgttggaggcttctaagatcacccccaggtttgatgattcactctggaacttgttgggctcagcacatagtcatgctcctggctaagatttattacagcaataggacacacagcaaaattaacaaaggggaaaggtgcatggagagaagtctggaggaaactacacacagacttccaagagtccgctcccagtgcaatcacacaggacgtgcttattttccccagcaacaagtatgacagcacacatgaaatattgtctaccagagaagctcattagagaatcagtgcctacggtttttgctggggactgatcacataggcatcttctgcctgggatgtaccaaaattctagatgcccagaagggaaacaggtaggggtttggcataaaccacattgtttgtgcaaaactatttaaacatagtgaggcacttttaccatttagcaagttttgtatcagtgtaaagaacttttgccagccaagttcccagacaccagccaagggccaaatgttgaagcagtcctttctaaggacagaagtctcaggtcctgagactggtgaagtaatgtgagtggggctagtattctggaaattaagattcccaatggcagcagcaaaagatgcaaaagcctagtgggagagagagcctgacttactcatgaagctgaaagtagtttggtatgcccaagagaaggtgagggagtcaaggtaatcaaatggacactctttgtgatactcatatccatttattttttcaaaaaatgtgcattgggtgttatataaggaactgaggacataacagggaatcaaacaaatattcatgtccttatggagcctccattttagtgcactttatatgcatacactgaattatgtcacatccattttactggaaattctccagtctcgagcaaaacatcaacatttacatatatttcgcacactccttgataagaagaaacacaagaagatgccttctactcaaaattccagttaagactgtgtattagtaacctgtgtgtattaaatgctgataaagttgattctacttggaaactatttgttaccactatgatcagaggccttggcattttgtcagttgtgagtcccatgatcagaaacccatttatgtgctggtagtgtgatttttttgttgttgttgataaccataatgaagaacaacctgttagctatttagagagcagtaagacacaaccagttcagtaaagagatcaatcagctttattcaaacaaaagagcatcattagaagcctagcatcagatcaattttgattaagtcaacaagaatgctgccatttagtagactagaactattcttgttaactgtcaagtgtagtcagccaggacacatctcaatcctgtctccatattataccactgagagttcctcttggcttaacttgaggcatttcataaaagaaacatctactttcacagagttcagtcttacactcagaaatttaccagatttggccacaaaactgaagaggttgggaaggttacagcatttatacactcatctcatgaatcttatagattgacattgtttattttcaactgaattagtctctttcagaactccagtacactgataaggtagaaagttgattaatcagatctatcctgatgtctgtacgctaaaaatccaaagtgtagctcatagccatgaaaatgggaaaccacttttggaactgttactttgtttctaccagtacaataaatttctatatatttgctacgtttttatctgacaaagctgagtaactgacagtgcttccctgtctgctgtaggtagctaagaatcagcaaggagaaaaacacagcactccagataagtaaagcttttcctagcatttagctcttggaaatgacaaaaatttcgagacatgctgacgtacaacttgaatcactgcttgaattccttagtgcctagaacaacagaacagaggccagaaatcagcatgctctcaataaatatctggtgaattaattattgaaagaatggattaattaaatatataaacacaaaatagtaattagggagtgtgcaaaaattgaaactattctgtaatatggttagttatctgggtttctatttcaaattttaagattcatttcatgtttcaactataaaaaattcatcatcaataaaaatgagttatggaaggtgcagattcaaacatagatacctttgatttttttctgacaatgaggaatggcctcagagataaatgtctggaaaataaattgttcacaaaaatatattttagattaaacccatggtctgtgctttggtccaaacaatgtgaaggatttgtgtacttcaaggcagtataaaattgagagactcaggagcataggctcagaggacagacagtcctatgtctgaatgtgtgaactccaggaggtcaggggtaatgaggtcttgtttcccactatcactagactagccatctataaactttctgatcacacacctctgcctgagtgtgcatatttatgtatgtctaaattatacatacgtatatatctactaatatatttcatatttttatttgttgtattatagagtatacgcaaacatacacagtttaaaagttgagaaaaacacatattccaatatgctctttccatatctaatttttttttcttttttgagatggagtcttgctctgttgcacaggctggagtgcagtggcacaatcttggctcactgcaacctctgcccccggtttcaagcgattctcctgcctcagcctctcaagtagctgagattacaggcatgcaccaccatgctcagctaatttttgtatttttagtagagacgagatttccccatgttggtcagtctggtgtccaactcctgacctcaggtgatctgcccgcctccgcctcccaaagtgttgggattacaggtgtgagtcaccgcgcctggccgtccatatataattgtcttgcccattcctgaggctcatgcatcccgctttggagaacacttgtctagcatgtagtccatcataggtgctcaattaataacatttgttgaattattgaatgagtttaaatccaggtttttctacttactgtgtgaacctgagtaggttctgctatccatattctaggcctttgttttgtcatccataaaatggtataaataataatagctgtgttggggggttgttgtgaggcataaattaaataatatagcaaatgttaataataattgctgtgatattgatgatgatgataacaatggaaaaacatgtttaattctccacttcttagatgaaatgatttaggtcttgccctcatcacgtcattacttttgaccatggatacacctcatatattccagttgatacgatgcattccatacacaggattttgaagtaggatctgttcctgcaggacatctgttccagcctgtgaacataattttctggtaatgggcatagagaaaagcaaaaaaggaggaggtatttaccctctttaagcatatctccaaaagtagtgcctttcaatgatataagttgtgaaagaaagatgctagtggaaatgatataaaagcaagaccaagacacacttagaagagttgaagggtgacatcttatgtagtaactcccctatctaatcaactatgagacatagagttaccctccacctgcctccccaccctcatcagaacctgcctatgcctctgagcatggatcactttgaagtaaggcaggaatgaagccaggaaaagttctgcagggactcacatttctcatttctcttctgactccttagagcccagattctgctagtctggcgtatagtgcatgattatactgtgagttggcaatggggcaatagagggtgcagggaaagaaggaaggaaaaataacttcctcacctccttttctttcctcaccccactgtctccaccactttcaccaaggttgtcctaccaaggttgtcatcttctaatgacaaaagccagtggatatatacaatcctgaactaactcgacttctcaagagtgttttatttgaactctcaggaggcccttcttccttcctgaaactctctccttccttggtttgtgtgatatcactattttctactttgtcttttaccttttgtctggtcttccctagtctccttcactgcctcctcttcctctatcataaatgttagtgtttctcatggtttcatcctcagccttcttctaatcttgctctatgcattcttcctagagcagctcatccatctccacacccccgccatgactgtaaacaccatctctttgctcatcactacagaatctttatctctagaccaggtccctttcccatattccaggcttactacttttagattatcttcactgccttacccctacaggcatacctaacactgaatgtatgtgtatatgtgtgcgcattcacatgtatgcagcaaaacaattagttggcagagagtcaaaaaaaaaatggtatgtaggatgagctgtcactttttgagtgatgttgtgcacatttagtttcctcacctataaaaatgttaaaaaaatccatttcggtgatgggttcactagaagcccacccccccatttacaaatgtattacccatgtaacaaacaagcacatgtaccccctgaatctaaatttttaaagatgttaactaaagctgtcttttggaaagaaataaaattaaaatgtccctccattaatttgaattatttaaaactctgacagtttagcattgtaatatagctggaaataattattgctctaatagccaacaactgttttcacctaaccatagttatttaaatcacccatataattataaacctttatttatttaaaaaaatggggaaatgcgctccaggtttctaacaccgcaaccatcctgttgcccaatcagaagccctagaatactctttggaacctacctcctcttcccctccccattgcagtccataaccaacgtctgtagattgtatatccacagtggccctgtgttctgttgccttttctctagtcacagtgtcattgccttaattgaggctatcaacattgctcttgcacaattgacatgctctccgtagttctctctgcctctagtcttgtggctacaaccaccatactagtcttcatgctgcagccactgaaatctttctaaaatgccaatctgaccaagtctctcccttgcttaaaggcctagcatggttccccatggcataaaggattgtgtcaaatcctatcccgtgatccagggggtcacacataatctgactcctaacaccttccatcgttttatccctcatcctatctctggaaatctgtgctccagccattccaaactgcctgcatttctaaactgtgctagactgtcccaagcctgcatgtctttgtacttgtgaaatctgcctgcatttctaaactgtgctagactgtcccaagcctgtatgtctttgtacttgtgaactctgcctgcaattttctcagcccagcacattttcaccctcccaacaattgatttgactaatggccactggccttcaaaactcagctgcaaacacttgctctgagacaggctttcctgatcatccctgaggctagatttggtaggtaggcatgggtacccgcccccctgtgattttacaatgcctgtgccacatttctgtcattacacttatcaccttttaagataattatgtgtacgtgtgtgtgtgtgtgtgtgtgtgtgtgtgtgtgtgtgtgtgtgtgtgtattttggtctctcccccctgggactaaaagctcatttaggccagaggctttgtatgatttctctagagcagctactctcttcacctagttgcctcctgctcttccttcgtttctcagcttaatatcatcttctctgggatgctttccctgacttcaacctcccaacccccaaccaatggaaggttctgtgagatatccctcctctgtagcatagaacttctcctttgcattgaaagtgcctgtttattgtctgtctcttccagtaaacactgaactccttgaagaaagggactaggttttgttcacaattatgtttcccactgcaacctcctatagccaagcacagagagcagtacagattagacacttgttaaacatttgctgcttcacttttcttttggagattgtgattttgcctcttatttctttcattaaaattgctttcccatttttttaaaaaatatttttattgtggtaaggaagcatagcatgatatctactcttaaatttttaagtatacaatacaatattgttaactatgagcgcaatgttgtacagtggatttccgtttttaaaacactcctggttactttttggttacttttccaagcattatatagttttgtaagtttggactgctaccttgtcctctaggtggcgttgtttgaaaaagaaatggcaaagttgtatatgctttcaaataaatgagtactgtatttgtctgctagtactgacataacaaaataccacagattgagtggcttaaacaacacaaatggatttttctctcagttctggaggctagaagtccaaaatcaaggtactgttaggttggtttctggagaagcctctctttctggcttatagatggccacctcttgctatactcatatatagcctttcctctccatggaaagagattgagctctagtgtttcttcagcttatagggacaccagatctatcagattagagccctgccttatgggccctaatgtaaccttaattatctcccttaaggtcctgtcttcaaatacagtcacattgggggttagagctttagtatatgcatttgggggatgcaattcagttcataacaggtatgcatcccaagattatcaaaattttgtgcaattatatgaaacaatatatttaaatcaccttggagcaaaggagcagaattagttgtaaccaatgatcaaatgttctgagtgtcatttaccttatatctcaaaggagggggattatgctgctggagcagtgcagggactagtggaagtcccagagaacctttgggcttgagaaacggtatttgaattctctcccattccatcccttcaggttactattcctgaagcctagaatctcgttggcaggcagagaagctccattctctccaggtcaagcggacgtcttcaaggactttaattttaccatttccaaggtaccaggcctccaaaagctccctcaaagaacccttgcctagaagagaaccaaaaatactagaagcagtggagatggcctcatccttggaaactttatgacctcatcccgctctggccatctgatagatgggttgagaatacagtgccaactgagattaagacctttgagaggccatgaagaagggcctttctgagtgattctgtcagtcctggctaaagaggcctgtgcccaggagacatcagcctggcgtgcccttgaagtgtttttcactcaatgctattattaagggaccttagtagctactgtgggaaataaaggattctgaaggcaaattagtatgtttattccggagtttctcacataaaatagatttatttaccgtaggctttagttgaacctttagcaagccaaatacataatactaattaccaatagtttggtgtgctgtgcagtctttcacaaactcactgatcacaggaccttttcagtcagagaatcttgatcagattattattctccaagactctcttttaggaagggtaacaatgaagaaaatcatgaaaaaagcgattgctgtgagatgcactttgactcaaataattcctccaggcctaccctgctctctccctccctgagccacctacacattggcccccagtaatgccaaattcgtttggcctcctatcttggctgggctgccttctcctgttagcatgcctttttcttgactgacttagaatttccataggattctgttgtcagccttgtttccaggttccattctttctgatgagaattggtgggcacacagatcaggcccttgggagtgtcagaacctggtttgttcctaactctatcagggagcttagagtctgccctggttacgagggaaacagatgaaatcacttgatacctttcaaatagaggctttgcttacagcccagggtagagtgccctagggagatactaagggacttgcatactagccatcttacaaaaggctaatttgcctggccacactggccaaggaagaataataagaaggaaaccaccccactgcttactgtatgctgggcactgtgataagtgctttgcatacattattcgagttcttacaaccaacctatgagatagacagaatttttggatccactttacagagcaggaaactgagtttcaaaaatctgaggagacaagcccaatgaagcatagcttagcataagcagaagagcacaggactccagtctatgcccttgtggctctagggtccctgcttttcactacttttctctgttgcttccgggtgaatctagggaggtggtgaggtccatctgcattgtgttggtcaaatcaaagagtaccttagatagctatttgaaatagtctctttctgccccctcctgcaagagccaattacttttaggaaatagctctgtggtcaatagaactatttttttttttatagacaatgatctaggttctggtagggaacctacaactccagtcttcatcctcacaacgaggtgctaacttagatcctcatcactgtcacctgtgtctcttaagagagctccctatatcctatcttcctctttccccctcatattctccactctgcagcccaggtcacctttctgaatgtcatttgattcctttctggtgtaaaacctactcaccattgagataaatccaaactccttaaactggcttcctaaattattccctgcctatttcttcagtgtgtacctcccaaaccctctcctctgtgccaaatctcaccccttagtctgtggacatgccaaacaacttccagtttcagctgtgtcctgtttagtttcaggtaatttcacacttctaaatattctccctcaccaacctcatctgccttgggaacagctgttcaattttcaatgctcagttcaactatcacctgctgtgtgaagtttttctggttccctctcaccttctctgagtcttgccaggcctggtacagcctcagagccttatattctttaagatggcactgattgccttctgcaggtatctctcatctccagacaagctccttccccagcagggacttgggattatttattctcgtgtctcaaacacccagaacaggcctaatccataatgggaacccaggaaatgtttgctgaataaaagaatggaaaggaagttttcctgaaatagagtaagaatttgacattaattttgaaattggccaagagaatcttcaagataaatgaaatgaataaggattgtaatttgatttgttttgtccctattgtcgcgagatgctaacctggaaaaatctaaatatttaatttatctttccatgaaactcctgagaggaaaaagaaattgttgaagccggggttggtgccttgttgttgggaggattagcatgcaactgaaatacgttatttctccacaagggggtgctatgaacacatacgaggccattctcttattcttcctcagagagagagaggaactgcacaaaccaagtaacttttttattttccctgcattgtatacaattgtgcaagaatggaataactctccaccgttgccagaaaattatgtatgcctcggacaaggcttcctactaataagattcacactcacacacatacccctaactcctttaaaaggttcaggcatcaagtttaaagatgtatgatttgtggtatatctggaatttgttcattgacagatttagatgttatgtagtatgatgtcagaaacacaactgaacagaataaaagcatgcactatgctgcttttaactctcgtataggatagaccattttagaggaagactcatccaggtgtcagagatatcagtcagctcttgtcagtaataacacgtagatatagtagtaccagctgtgtacacttgtttagatttgtttcttatgaaaccatgatgggcagcacacataacacagtcaatatttgggaaagttgtactttgtgtaaccagtggcttaagcaaatcaaatcttgtcttcaacatctcatctccagtttctaccttcagcatattttgatggccttggattctgagtaatatttttgaactgtactcatgtatgtcttcccatttagactcgttcctttaacccctgggctctgtgtgtatgtgtgtgttttccatatttataactcctgcacatgacaaaggtcctgatacattgtaaggactcagttaatgtttgtggattgcttccttattgatctgttttcacaaaaatgctgccaaaaaatgtcaagcaggataatgatgaggttacaagagagacaagtgaatgggcaagaagagactaagggtaaagtaagaggactaacttccattgactgcttacgaaatgccacgcactgtgctgaggactttatataaatatctcatttaattcttataaaagcccaataaagaaataattatcaccccagtcccaccacctgtttttgcatgattgtggccatgatatcaaaataatcaaatagatggtatttggaggtatataatagtctttacctatgccttccatacatcagggcctcaatggtgcttgactaggatttgcactgtgggttagtatagttcatgggttgttatttgaagctgactcttgtgttcatgcaggagggcaggaatcttcctggctgttctgtctgcccctgttaccctcagtgaaaatgaaaggaagcacagtacatagtggttgacaggaatgaaggtttccaaccttctaactgtggttggagagcttcctgtgtggcatttcccctccttcctggaactctttagtattgtaggaaatgagtgacttgggcaattgcgatagacttcaagcaattggattcactgaagaacattttatggaggaggaggaggaggaacacaaaatcttgaaagctctgggttgagagaaaccatcaagggtatccacgttaaccactaagcaagcttttgaatcccctgatagtattccaaattgccatctctgtgaccttgaacaaaaaacttcacctctcttagtgagtttccacataggcaaaaacaaaaacaaaaatgaaaaaaactaaacaaaaccttctagggttgtcgtgaagatcagagagaacgtactcctggaatatattaggtacccagtacaagttttaaaaatagactttatttttagagcagttttaggttcatagcataactgatcataaggtacagagttgacatataccctgtgattccctggatggcctccccactagaaatatccacccactggagtggtacatttgttacaattgatgaacctatattgacatgcccttatcaccgaaagtccatagattacataagggcttgctcttggtgctgtacattgtctgggtttggacaaatgtataaaaggccattatagtatcatacagaggagtttcactgctgaaaaaatcctctgtgctcctctaattcatccctccttccccaccaacccctggcaaccactgatccttttactgcctccatagttttgccttttccagaatgtcatacagttggagtcacatggagtaaccttttcagattggcttctttcacttagtaatatgcacttaaagttctatgtattttcatggcttgatagctcatctcttttagccctcttttatgccattgtctcgatgtaccacagtttacttattcattcacctactgaaggacatcttggttgcttctaagttttggcaactatgaataaagctgctataaacattagcgtgcaggtttttgtgtggatattagatttcaactcatgggtactcagtattttttaaatgaaaaatatatctgtccttactcccataaattcctcctttccatcaattcttcccaaggtgagggatcagtgcatacaagaggcccaatttgcagcaaaatgctcattaattagccaagaggctgcggtggcacagcaagtaaacaacgtactacaaatctgtttacagcggcttctgcagacattttaaaacaattaaactgtcaagggggcctggagacaagagctttgcattttaataggaaatgattaaatctcaggcattattgccttcgatgtgtctaggctttaagaagagggcagagtattgattgaggcctccaggaaggcaggaagcttacttgtgctgcttgaccgcaatgcagtgaaagcttggagatctgtaactccttgggctggaattaaaggccagtagccaaaaatttaactggatttgtcaccttctgtttagttggactctgcctgtaggaacagatgatagatcatgacctccggggtattattcgtcaattggcagagagagagagagagagagagagagccccttgctgatggcatctattagaaaaggctgaatgacacagcgccatgtggtgacctcagtatttacactatctggattaaaaccattgtaaagcaagtgaaagccacccatgtagtcactgcctgagtcaactaatgcaaactgcactctaacctgtgaatatgtgtgtgccacagttatgacggacacgcagtctcaaacatctagtgtattcaccttctctattgatttcatctattcacaggtgctggtcagatcacatgtggttcttgccctctagctactcacagtccagtaaatgagggaacatgtaagcagctgggtacaatccaatacagtgatagatgttgttggctacagtgaggggaccaaggaggtcacattcaaattgagagatgtggaggggctggcagaaaattctttctagagaaggttctacttgaaagattagtaggcagacaaggggacaaggacacttcaaactgagggaagttcttgaacaaacctgtggaggtgtgaaaaagcctagtacattccaagaacccagtctggtagtgtggaacgtgagtcctctggtactttttaaaggatggggtgaccttagtcctcaggtttaaaaacttaatcaataaatgatgacgttattgaaatatatcaccacataatgctaaatagaacaggtgagcactaccattctctgtgcctttctattgcttaaaatccttccatttgtcatacttcttaaaagtatgccaattggagaacaagacacttgcttccaaaatgagaatacctttgtgaaaattgacaaatttgtgtgaattagcttaatcagattgctttcttccacaacacctgaccaagaccagccactctgatgacgaggagaatagggggatgtggaatgcaaaagaaggtaggagcatggggtactgagggtggagagggctcctcttgcagtggaattacaggcagctagggagcagcacaaaggccctgcatggctgagaattagtttaggggaaaggaaagagaggatagcagaaataaattttacctgacttgcaatttggctccatgtcggctctcattttgtttatttctgtgctgtctagacatcaacagattgagctgctcccatccctggggacccccttccccactacactgaccagtgcagccccctgcagggccattataagaagctatggcacagctgaaagactgagtctcttgattagacctgataagaccactcatattaagatgacttaattttgtcccttgagaaatgcctttttaagagctcccacattggccaagagagactgcctccatattaagcttttctatttttgtttgaaggaagttggcacctctcctgtgtaaagagtttgctgaagcctaaattcttccattagccattttggtttgcaaacagggatctgaatatatgcagctttttacctggtggcctgagcacttgctcagcttcccaaccagagaacaatggggaataccccatggccacattctgaatctgatcatctgtgcttctaagcatgattgactagttaaaataatggttttctgggaaacaggactggctacagaatttgcaggggttagtgcaaaacgaaaatgtagagatccttgttcaaaaaattgttagtttcaaaatggtgacagcaaatcattaaacccagtgcagggcccttctcagagcatggccctttgccgctgcataggtcatgtgtccaggaggtagccctaccaaagaacagctattttgcctttttgggttctaaaggctcctgttgttcaggtccctgggctgtggatggctattggggtataggggacggtgtttgatttcagggcagaacaaattttctccatcctctgcctactgctgaaatcccatcctcagagctaaagcaattttgttgaggctggatccctttgggaggggctaacatttgcagctgttgtctgttacacgcttagtgttggatggaaaagtggagggagagagcacaaggcaattttgattatgcagagaagcttatgaaaaaatatgtaagtttatggaatgcttttggatatacattatcttcctttccatatagcactgaatatgggtactggggcttaataaatatagctcctcgtgggtgttggtaattcttcaatattcattgatagtgacaatattcagaacttgagacagatttcctttctctctgactcgagggcagttttcccagagccacacagaaggagaatccagtctgttcaaaaggaaagactcatttgatcccagaataacttacatttccatttctatttgaatttttaacaaaaatagtgggtcttccataaagcaaaaataaaaagcatggcaattttgtttcagggtttgctttttcttaaaattttgattcctatattaacactattgagtgcttcagtaacgagtatggtgtaatgctaaaatagtctgtttcttgctctttgttataattagctaaaagccttttcataggctgctcatagattttctgaatttttaacaagggactttgatatgaaaatataattttgtggcacagaactaaaagttctggtagaatttcaacattttacgtgtaattgttacagaggattgagcaactataattcttacaaatgtctattttgcttgtagcgttttctattcatcaataattcaatttcaaaataaaagacacatttcaacatcccaaacactatcggggagactttcagattcctgactgtgggagaagtctaccaaataaggcagccagctccaaaaacttctctaatgtgctgagggatcctgttacagaccgtttttcataattctagaaggcaaaataaaattttatgcttggaaataataagtttaagcaaatagtataggcaaagcttatgtctgagtccaagcaatggtctgattactgccagaacaatactgctacatgatgaatcattaatgatctgggagagccataatggtctgtcactaatgcccattaatgatctctctatactgagagtatgggcttgatgtttctggccattaccttggagaatactttagatatgccttaaactttctctgatctcctctctctctgtgtctgctccaaatgtagacagcaattgtctgggtaggaccagcttataaagaagcatggctttgttaaggaagtcgtattcaggtaagatttatttctgcaatgtttttgatggacatagatttgaatgtttatcctggacattaatgcctttgtagaaattaacaaaattataccagggatctttctgctgagatatttttcgttctggatgggacaggggttcttgattccctttactccgggatgtttgacgttaagaatggattcttttggaaaaatgcatcatttttttttttctgggaggaatttaaaatattaattgttataggaaactgaatgtgtatttctgaccatttaaaactctatttacatttagaaaatggtggcactaactgattcaagagagatttcctacttctagatttgcatttattctatgcatacagcacaaaacattaattttaatttctaaagaaaaaagagaataagtaattataattggcttttaatgtatttttcttttagcttagtgaaagaaaggaaagaaagagaagatgacacttagctaagggaaggtggacacaatcacactttaattttgacaaacttattaggtgtatcttcagggaaatcacagaagataggcactctataatgtctcagcgaaactaggagagtatctgttcctccatggcggcaaggcagatgccgcagatagctgatggaaccaacgcccaagagcttccagctcacggagaaaaacaagctgagagaaggttgccggagcgaccagtttcaagtctctttgaaaagagcaggacagggattcttttggaggagtgaaatcactcctccagctacatttttaatgggaagtttttacatgtaactaataaaaaaatggttttgccaatcttcatattagctgaataaagcaacctcatgaagcaaacactttcattgaaaccctttgcacttgctttattgttgaacctgaaagaatcccagagaactcttaaccttgctaaatgttttattttgctagaacattttgtccagatgagtaattattcatggtgattttctgtttcctcaaaatccttctctctgtcctgaaactgctgagtagcatgtgtttattcatgtaattaactgggattaataggctttctcttctgagtacttcacaggatatcctcagctatttggagttctcctagagcatccccaaatggagatttggattgatctgtcatgttgcatgagcattgtttatctgattgtttttaattggtttccccataaaattgagagagaaaaaaagcttatttgaaagattagtacatcaagggcaatattagtgatgaaaatcgttacagaatttgtgagattagttcaacatttaattttctgattatttccacaattcatgtctctaagaaacccgttagagttttcaccttccaggtggtggacagcttataatcatcattaaaggcaggagctacagactatatgcctctttactcaggatacagtatatgtggctgaaacaagtacactcatcactctgcttgtaaagtatttgagtgaaacacacacactaattatttgctgagtaagatctgtgacacaggaaattctcaccaaacaattattttattgacatgtgagtctatgaattggagactgtcaaattgccatctaagctgtttggttagattcaagcacaaactaactttatgcttacaatagacttataggttgattgatgaaatgttataaatagacatgtccatttttaataaatgtatgtttgtgggaaactgagcccctttgcagaaatgaatgcaagctgtgggacagattggtagtgattgaaaatgctgcagttgctcctctgaaagaaatattaaaatatctgatatagcataggctctgagttcatggtagaacaatgcaatgcaaatgaaatcaggagaaaggatatgcagccaaagaatggcgagtcgcaagaaaggtcacatggtttatctcttagccttcatacgggaaaacacttcaacccttgtacacagatgagactgtcccagccaccgcatccacaagctctctaaagaactcatttcaaaagctctcaaggcaagaacatccatcctaagttctccatctccagttaagtctgctgcctctcatttgatcctcagggaagctaaagaatagacagcagctgtgctctgtgtaacccttcccagcccagaagctctcatgattatgcttatttaagttaaggaaccctagtttctttagtctaccctttcaatcttgtttttaacctaccttatttagctcacccatttacttctctaaatgtttttgtccttgttgtgttcccctctgcttgtccacaattacttcttcagctttttaaggtcctttcgtgttcttttctaagtaattatgagtttttctattcagtggctattcctacacctgcctagtactccatgtatcatattgacttagagtttctcaaacagcacatgaagacagattttcttctctcggggaagaaaacaatatatttacatatatatatttgtgtatatatataaaacagtatatttgttaatcatttccttagctgtagggacttaggaaacaatatgtttactaatttttttttatcaataatcccctgtccatttttcaggggttgcaaatgtgtactttcagctgttctatagatcactcattccaaacattgagtccattatcacctgggcagtgcctcaaagtgctttctcatgatatgcagttccaactgcctggccctgggcttgtgcttagtatatacttagtttttgttgagtaactgtatatgcccaaaatggctgtatagaccactagaaaatatttctttatattttctttgggaaaatgattaaacaatctagctgatcttataaaacaaagcataaatgaccatcttcaatttgggtttctagaatgtatagcggtagtctatatttgtcttttgccatttgccttagaaactggaagatttgaactgagaaaactattacaagtgaagacatccagggtggtagaaaaattcaccccagcagctaagctcttgagaaggaaggagagtattcaaaaggaagtgagtgcctcctgggtagaaggagttctgtaagtcccccttgggagtaccagtctcatgggagaaaaatgtgccataacttttattttcattccggcagggccactgggtatggcctaaaaatttaggcatatctcaattggcagtataagtgtctctcgttttataaaataaaattgtttccagaaaattatatgtaaatcaaatcccacgtgaaatccacatgggatatgcagtaaagaaaggagcctttttgtgagtgtttctataaagcgaagacttataatagacgtattaaaatgattactctttaatttatccatttgaaagtctgagttctaaaatgtcagaatgaaaacaagatatctgcattctattcagaagaaattatttgaccaaagcttgctaagcttatgtatgctttaatgtaataatgcctcatttgtgagtatgttaaaaatggttacatttaagtctgcttactttgctttggaagtttctgaagagcttattggtgtttcttactatttagcagctttatctgatatgacattatattattgccttctaaaatagaatttttaaaaacttcatccaaaggagccatgaataactggcatggccacttacttatgtaaatagggtatacacatatctcctggacccaaaactctaatctgttaccatgccaattccctatatttagttcaacatgccgctgaaatgtctaaatattggctgtttcccaatgtactccatcctttactctgttcttagagaatgaagagttatgatacaggaacttcgccttgtacaacagagtaggtgttatttaggcacattccaaggctccagagcagtcagccttggaggtgtttactaggactctttctgtggttggttagtgcatgcatctctgcgtaaatacaaaatataagtgttctttgtagtattcattgttccactaatgcttaactgcatagctgaatgagaagatatttttccagctctaatactagctaatatgataaaatctaaataaagtctctaaataccacattcattatgtcccttccttatatcaaaacttttactggcttcactttgaatgccaactagttggaggcagtgtttgatgttattctgtaagcaaagcctacagtagtctggctcaacatacctttctagtcttatctccttcctttcctacaagaactacttcagccaatccaattgcctcctagaggaatttgcccaattcattaatgtataatctatgcagtgctctctctgtgatgtgctagacaccaaggaaggtgccaagatgaaagaatcatggaccctgccttccaggaaggcacaggctggctgcccagctagcttctatcagacactctgtgatgaatgctataaccaaaataacacaaaagcagcagaggactagaactaggaaagatgctttctgctggctggatttgggatagcctcatcgaggaggtataaattaaccagggacttaaatgtatgtgaaaatttggtttgtgtcctctgagatacctttcctctcctgacaaccaaatgagatttcttcacctctagaactctcacagtacttactggctaaaccaatcatatgacactcatccaaaactttcttacattgtttttacctttgtgctcattttcccctctagattattatattcctaggaggcaaggcccatattcaacactttatttccctaactgatagcacagaactactaatgagagtaactacacatgtcatttatgtgaaaaaaaaacctgattgggttctgagaattccttgacttagttaaccactgctatacagtagaataccaagataataagacagatgacaaaatgactcaaatttactactactggctgggaacttcattccaaaccttaatatagtctcctgggaaactgcactggattgcatacaagctgtgaagattcctttgccttctttcattcactcaacaaatatgcagtgagaacctacaataatagtccaggcactgtgctagcttctaggtatgcagtactgaatagaacatggaatatatagtctagaagcagttcaaacagccttttggtccttttcccccaagtcacatcatgaccctgtcctatatagcttttctaaatttttttgtccccttgcgctgagcatctatcctatatatcttagtactccaaaggaaaacagtccaaagacaaaatgtcaggttttcattttttttttcctgtccatactatttcattctcagagtatgtgatctgcttgatccttgttaaacagtctcttggctcctcttcattaaataaagtagtcttaaataaccaccctactggttagactgtgtgatcaaaaaataaaaactaccgtttgttaagtgtcaactacagcccctttcccagcttgtacactgcacaggtgtaactcattcatacagtaactgcacaatgtagattattgttttcctcattttaatactgaggggaactgaggctcagagaggttacataacatgaccaagatttgtgattaatgaacactgaagccagtctttggttcatgtaatgccatcctatcccagatatagtagattttcagcaagttttggtttgttcattggttgattgttaccattctgattgaaagatctttatatattttagattacagtataagaggttgttagtctttggtagctattaatcccaggcatgtgtgtttatgttcctaatagcaattacatgaatgctttatgcttaatagaaacaaagctattattttgatgcttaaacattctttaaacatttttacatgaatacatattgataattcatgtataaataacacaaaaagatttagaatcccagttacagtttctgtaagatgcccagtttcaaagatccaactaaaaataagtgtcagctcattgcaataaaataaaataatctgattttatagacatatgaaagctgactcataacactcataactcatgaaaatatccaaaatcacattttgagcattagcttcaatgttgtctaactacattatttctatatgggaaaattctgtattctgggctgaaaattctgcagcccagctgttcccaaactttagtgtgtgccatcaatatcctctgtgaaactggctaaaattgaagatttcaagctgagttggttggaacccaaggatctacattttaataagcactccatgtgattctgatacaggaagaccatccacatctcacttctgtaagtattcttctgcaccagtgactcactagtcttcattgttgtcgtcccctcgcccatccatacacaagcagttgtgtattgcttttaaagtttttttttcaatttaagtgtaatttatataaaataaagtgctcagatgttaagtacttttatcagtttttcaaaatacacatactcgtgcaatttattcctctttcaagatctggaatattttcatcaccccaaaaaggttccacatgccttttcctagtcaacatttctctgccaccagaagaaaccacttaatttacttctatcaccataggttcgtttttcctattttagaacttcatagaaatggaagcattacattttgtgcttttttgtgtgtctggctactttcacccagaatactgtttgtgaaattcacctatttttctgtgtatatcagtaagtcactacatgttatggctgactagtatccattgcatgaatatgccagtttgtgtatctattctctcattcagagatatctggattgtttctagcttttagcttaaatgagtaaagctgctataaacattttttaccaatctttttgtggacaaatgtttttatttcttttggacaaaaacctagcagtgaaattattgggtcataaagttgatataagtttaactttttgagctactgcctaagaattttcccaaatggctgtaccattttatatccccacaagtgatgtatgagagttctggttgttctacataatcatcagcttttagggttgtcaattattttcattctattcattcttgcatgtatatggtagcattgcatcttggtaataatttgcatctgcctaatgactaatgatgttgagtgctttgtcatgtgtttattggtaatttgtacatattctttaaggaagtatttgttcaagtcttttgccaatctttattttcttatcttattgagttgttcacagtagctctttagtatctttttaatgtctgtagcatctctagtgatatctccacttctatttattatattaatgattcatttttttctctcttttcttggtctatcttgctagcggtttaaaattgtattaatcttttcaaagaaccaacttttggctttcgtgattatctccatttgttttctgtcactgatttcctttctcatttttattacttctttcttcctacttatttggggtttaattagtttttttcgtttcttaaggtggaaacataaatcatttattttataactttcttctgtttgagtgaaggcatttaaagctacaaattttcctataataacagctttacattaacttcattgttttgatatattgtactttatcattcaattcaacctattttctaaccttctttttgattttttttttttttactcatgacttatttagatatataatgtttgatttcttattgagggggtggtctatgtacattctggatgttaattccaagcttgatatttggcagtcagataacatactctgatttcttatgaatgtatttaaatttgggttatggctcagcttatggtttacttggtgaatatttcacgtgaattaatgtgttatttgctgttggtcagttctatacgtttatatcaggtcaaattgattgacagtgttgtacaattcttccatattctgactttgtatacaatttctgtcaatttttgaaagatgagtattgcaagttccaactatgattatggatttacctatgttttcttttagtgttatcaattttttgcttcaaatatgtagtgcctttgttagtaggtacacacacatataggaatttgtatattattgattaattgaccattttataattatgacatttcccccattatctctgataatatccttcaccatgaagtccaccttatctgatagttatacagccacaccatctttgttaggattagtgtttgcaatgtgtatgttttctatcttttgactgttattgtttatgtgcctttatgtttaatgtctgtttcttgtaagcaatatgtaattgagtctctcttcttctagctcccaaattctgacttttatttcgtttttcagtccattttattgtaattgttgatgtgtttggatataaatcttccattttagtatttgagttctatttgtcccatcttctctgtgtccctctgtttttcttttttaatgttttgggagtgaatcaaataacttttgtattacattatttttattatttttggcagtttctcaagattacaatatgcatctttaaattatctctgctactttcaaaacatattctattacttcacaaacaaggtaagacatttacaacattattcttccaattttcttacaaacttcatgattgttttctcatattttattctgtatgtgctataaacctctcattacaattttattatttttaatagcagtcaatactcattgatgtaatttctatatacatgcacacattattattatttttttattattatactttaagttctagggtacatgtgcacaacgtgcaggtttgttacataggtatacatgtgccatgttggtgtgctgcacccattagctcatgatttacattaggtatatctcctaatgctatcccttcccccctcctccaccccacgacaggcctggacatgcacacattgtttttaaaataaagatctttaatattttacaaatttatttactcttcgtgtttttcatttcttcctgcagaattggatttttatgtgatataattttccttcattataaagaacattttttgttcatttcttttagtgtttatctgctggagaaaaattctatgtttctttttttctgaaaacttatttattttaccttgatctttgaagaatatttttgctggatatgtaattcaagtttggcagattttatttttctttcagcactttaaagatgagatattccattgtcttctttccctcattgttttggtcagcagttatatatctctcttattgtagtcccactgtaggtagtgtttctgttttctctgccagcttccaagattttctcattatctttggtttttagcagtttgactatgatatgcttagatgttttttgtttgtttgtttgtttgtttgtttgttttattaggcttatttgatattctctgagattcttagatacataacatgttgtctttcattgattttgaacaattcttggccattatcccctcatatacttctgcttgattctctcttctcctgagactccaaattactcatgtgccagatggtttcctattgtcccacagatatcacacactgttccaattttttttgactgttttctttctttctgttgcatttggatactttgttttcaaatgtatccaagtcacaaattcctttctctactatattcagtcaactgattagctcttaaaaagaattcatctctgacattctacattttatttctagcttttcaattttttctctatttgtactttccatcgccatatgtaaataatacatttattcaagcatgtcatttgcttttctcactagaccttttaaaatatgtatcatagttattttatggtccctgtttgataatcccataatctgggccatctctgagactcagatctatcacttgagtatgtttcatatattcttcctttttttgtaagtcttttcttgttgtttatctaatttctacttgaaggcaagtcactatgtgtaaaagaacagaaactgaagtaaattatgtcaatgtccaaaaatgagaataccttttcttctattaggccattagtattttgtttgggatcaatctactcttatattgatctagatctgagctttagtgacattcagttcaccacagactttaccttatttaggagcaggatcaccatcttatctacagcaatgctttagctctgagtacctggatggtttgtctctgttctcttaacgccatacttctgcaagctctgtgttccataacacaggcaggagggtgttttctctcttatattttttacacttcacaacagtagagggtcaatgggtggtaatcagtgtactgaaggtactcaatgcccatggggtgtctctcagatgttattcctagccttcctgtactatgcacctaggactgggagaggaggtctctctcagccctccttcccctctcccaatagtagatggtcactatttcccactcattgtaaagcctagagtgtgggagggttttaactcatactttctgaaatttgtttactagcatatattagacttgtgcctgaggaccattatcgcagaagtatgtgaactcaatataatgtaaataaaatatccaccagccacctaatattccaaaactctgtgcatacttgagtaagcaataattacacacattgcctggttaaacccagtctccaatttggataccagagtttgttcttggtaaattttaaatgaaaatagtctttaaagtttcaaggggcaatggctcaagggatggagtatttgggaatgggagatactccccatttaaatgctagatgagagatggattccactctgaaactctggagaaccaggagttataacccacggagccaaaacaagaaagttgcaaaaattatatcacttagagtgaaatattatcaaataagccattccatgatggcttatggttcataaaaggctttgatctaatataaatgtgtttatattttactgcatgtaaggatcctcttcagagtattaattcacgcatttttctttagtttttgctaagtttgactttggaaaggataatataatatgaaaatattggatgaataaaagtcactgttaacatataagttttcccatctgtcttctttttcatatttattgttacaaccttttgaacttgggagacattttttgcacaaaattgaaatgagttacatgaaattaatgtccaaagatgaaagcatgaaattgcagaacatatatgtttttccatctctttattgttcatgttcactgtaatgctttggggagcattgtttatgggctatatattcaaacacctaatttaaagacaagaaaatattaatcattagcctagttccacgtttttcctaggtatattttcttagtagagtatgaagaatgtattagcttcacattgatatcctatgtatttctatggtaaatctagaactgttctcccatataattaaatagggtggatttgttccacagttattttctctatgcatctcattgtatttcatcgtgtagaaagtaatgtgattatgggctttagtcagaatgttattttgttcacttaagattcattctcaggaaggttgaacaaatttgaatttcatatgatagctttctttatgtgcttcagtaactctctccctttatataagagaaaatcttcttgttgaagagatctacagatctccccagtgcctggggggcctgaactagcagcagggggggcttcaatgaaggctactgcttcctgtgcctcattgataggggtgctatgcatatttcccagacagaatgttggtgttgcagttactaacccttctagatatttgatacagagtaaaatttgccttatttcctaaagcctctgagttaaaaaaaaaaaaatgaatcttattccttttcattatgtgatgtcgggcaagttagtctttctgagcatcactttccatatcagaaaaaaatgagatacacataatacctacttcgaaggattattgtaacgattacagatatggtttataatgagcttggtacttggtaggcacttaccaaatatgagctgtcattatggcagcagagcgaagtgttaaaagtagggactccagagccagactgtttgtgaccaaatcctgattctgatatgtactagctgccatttgggcaaattgtttaacctccctacctctcagttttatcatccaaaagttaggagtaataacagtacctacctcatcagtaggattaggttaattaatacatgtgtaagaccagtgtttggtgcatagaataagtgcaatataagtatttgctattattcttctccatttcacacagcccatagtagggcaagctgaggagatgggaggccattagaggtctcaactgagtatcagtcgtctcagttggtctacagtagataagagattatgactttttgtcaaaatgtatgtgcagataaagctgtctttaatagtgtatgtacatcaacaagaagaataacaaaaacagcaactacaatttattgagtctgtactacatgcgaagcacatgctaaactctttacaaatattaaccatttagttctcccaattaccctaggaggtagacactaaagttatttaaatttcacaatagaaaaaattgaagatcagagaggttaaatagcattctaaagtcacatatctaatgtgctactggatcaagattcgcaattaagtttcctagttataaagcccatgctcttaaccactctgccatatagtcctcttctgcactaagggggaagcttaccccagggcttcaggattcctgtgctgcatgatttttttttttcaatttgatgtagcaaatgaaaaccctcaaaactattgtctttttgattagtggtggactaactaaattcgaagaactttcatgtccataggccttggaggtcatgtaacttagatctgtcattttatcggtgtggaagtagatgcccagagtatagatggagctttcctgaagtttaagacgagttggcaggaaaactgatactcaaaccccaggatgttttttttccgacattccaccaagcctgtagtttgaaaaatggcaatgacaatgcaacttttatacaactcgatgctgtttctagttatgtgcaaacccataacaaatgttgccttattataatgcctagtccttacttttgcaaatgcaaagtcatgctttgttcattaccaataatataatatttttacaggagggttgtgggggggaggaacttcaagcttcctgagtacctataagtaaatatcagtagaaatacatgccaaataccgttaggaaaaaatccattatattatcaatactcattgccctaaatggcatttctctactgcaatcatgaacaccatctgcagccagcttccctgaagaagtacagacttgaaattcataatgtctggtgctggcactcttaatgctgaaaaatcttaccgtactgcttaggaagaacaagtgtgcagtttctgattgaatgagacataaaggaactgttcttgacccattttgacttctcgtgcactggctcttagatccagggagttttatcccctgggtaaataaccatatcatggccttcagtagtctttacttgttgcttttctattagcagtgacgaaggatgtgcatgcttctcctacagacctgttggtgcagtattattcgtgtactcaagatggtccccttaactccagaaattataaagttagagggaaaaaaagactgagtgaaaaataggccttattttacatacatcttttccagtcccataataccgcattacttatttccccatagttcgaattaagtagaaactctgttcagaccagatggttctctgaggtggtttccagatcaaggtaagaaatgaagtaaactgtaagttgtaaaacatattgaaccatagctcgcaaaatagataaattgaagccaactatgatgtgaaagacaaatgaaactccaaatatttttaataaacttataaaaatgttttgaataattttaagtttacagaaaagttgcaaatatagtacagagaattcatatatacccttcatctaggtttccctaaagttaacatactatggtacatctgtcaaaactaagaaatcaacactggtacattattatcaactaaaccccagactttatttggatttcaccaggttttccactaaggccctttttctgttccaggattcaatccaggatagcacagtgcatttagtcattatatctcctcaatctcctctggtttgtgagagtttctttgctttttattggtttttagctcagactgttttaatagtaattccacatggcttatgtgtcctaaagataagaccactgactattccagcaattcgcctagtttacaaattctaacctgcgttgttaagcactatacttaaaaacttctgtcctaaaatgaattacctttgactaaccccagccttgaaaaccctgtaagtactctttgctaactcctcctttttaacatagtactgagactctgtcaagggggactttctcttgcttagtgtgtttcacatacccagctttgtatgatcagcaggtttctctggtagtctttgtgtgagggctttgacaaaagggtctatgatgataccattcaatcatctactaaatgcaagaatcccttccacaacatctgattggtactggaataggtctgtgtgatcccatggcccttctatgaacattgccagtgacaagacattgattacctttcaagatagtccatgctacctatttttatacaatccctattgttggaaatgtcttcatcaaaatgagccctaatctatttccgtgcagcttctcttcctttgtcttatttctgtcttccagaaaatcaaaatattggatggaaagtaagctccgtgtacagttccactcaagtggtatgcaaggagtcggacacgattgggtggtcccagctttgttcacatagtgtcacttgctggttgtgtgaatttgggctaatgactcaacttctctgggccttaattttcttacctgataaaaacaaaacaaacataaaaacaccctacctcataggagtgttgtgaaaatgaaagaaataacatatgttgaagcacctagcacactgacaagctcagagaattctcttaacaaatgatagttaccttttggtcagatgatcaccccctgagtacccaagatgaaatgtaccatttatgttatattgcattattgtgttattagttctgcttcacagcagtgaattgtaacgttcccttcttgttaactaatttcttaaaaggtttaattttatttttctgttgacctttttttcccctcgagacttaattaagttgttactgaacagaattgaagtgttaaataacctaagatgatgggtttctagcattcatgaattccacgcatcgccaaccggtgagattagtcatggcagtggatgagagagcttggcagggattagcaaatactcctgttaatcagcagaatgcgcaaattaggccctggctcatggcattgatataaatctccatggcaacaccagggtgagctgtttacatgtgaagaagtgatttcaaagctgcaaaggatgatagaaattactgcaatgaccataaataggaaaaaactgaggaaaggagaagtattcccacttcttaaagaaattcatacaactttctataaatttagtggtagttttaccatctctgagcctctactactggaaagttaattgacagtgatataaacagaaagaaagtaagagggagtagaagagggtctgaaatcattcataaaatatacaatccatccctctgaccaaataactataaatcaggattatttgcatatctgtgtgtagcaggactgtctgagttagtatcctacttccaccatccattagctgtgtgaccttaggcaaaatttttaatctcgtcgtatcttttctcctcacctataacataaagctaataacagtacctacctcagaaggttgttatgagatttggataagttaacacatgtaaaacatttggaacaatggttggctcagagtaaatgcttgggaaaatgttagctgctattattattatcactgttattattattcctgttagttggccataattcttgaatatagactacctttctattttataccctgtaaagaaactacagagtgggaaaggttatatttttcattttctaattttgtttgtgctggaaaagagacttggaaatgtcagcactagagaggttttatagatattatcattttcaatttcagtacaacacttaagaaaatgatagctgtgatactagttgaagcataggatccaagtaaagccactttattatttaaactctcatcaaaacccgggagcaggtggatatctataaaatgtgatgtgatcaaaattgaattagattatctcagaaatagagctacctttttaaacatatatgtagctctgaaaattaaacccaggcccctgtcctctcatggaccaattttctctgtggtttcagctcatttcaccttacttgtgtctgttggttgattaggcttctaatccaagcaggataattgccgtaattcaagtttggattcaattttcagtgcttacatttgatgggagattattcaaatagatactgggctgtttgctttgtgaggtcaaaattgttgctacttttttattaatgccaacaaatctcttgccagtcaccacccagtggttcaaaagcttttggaggcagcctaatggagctgaaagggagtgagactaagagttagaaaccttggttggaaaccctgctggcctcctctaccatctgactcttggtcgttcactctcatgtttctttatttgtgtttcaattttattttcttgtgcacctttttgtaagccacttcaattcttctttggaatgaggtaggtcagcagtgacaataaccagagtaattcatattccagaaataaggcaatatgaaagaggctttaacataagtgcataagtgtgatcaaaatgttcagtaagataaaggaataaaactcttaagatatgatcagaacgttatgaaaaaatagacatattatcaaacaccaaacagaaattgtaaatatatatatgtatttaatatatgtgtgtatatatattttatatataacatttgtgtgtatagatatgattttgtatgccattcataaaatattattgtataatatatagtatttctaccaatgaaataaaaacaaaatcaacagataaatccagctaaagaggggatcagtgaagcacccagattttgcaaagaaagatacagagatggaactaggaaagagaagtaaggaatcatgagggagagactaaataaaatgaatattttatccgttatttctatgttttatggaagaataggtaggatgcacctaacagaagtttcagtagaacaacagagatttaaagagaggcaataagtaaagagttgatagctaaatttccagaattgaagcacagcaatagaaaaactgattaagcacaattgaagaggaatacagtgagcagggaaattttcaatatgttttcaatatattcaaataccaaccaaatcctagttgttcctctcctataggaatactgaaatctatatagatgaattactggcattacctggcttggacagtcttttcacacaatctttaatttgttaccttaaagttttatcatcataaaaattatttattgactgcccatgtgaaaaatctctggtctccaacctcacgccagttatatcaggagaatggctgacttaccatgacatacatgccaatgtaattttcatttttattggcatctttctaaagggattacttctactacaccctctgctgttgccagtcagaaatcagtaacaactgtatacttgaacatcaatgttgacaatatgtactgaatgcgatcagtaggaaaaagaagacgatctctttaaagcaaggaataaaaacttacaaatgttcatcagaatatccacatagcatagtcgatttctcccagtccccagtggttgatgttcaaagggtagtgatataaaaatctaaggttttgcaaattctttacctgagggaaagtaatatggcctagtaagaagaatatagtaccagtagtcagttgaaatccaggtttgaagtctggctttacctaatttcgttccccaacttctgagcttcttcccatcctcccacattcatcttcagtgacaggttttgttttctgaagctggattcaattcctgccctcctgccctcctgcccacggagttagctgcaccctctttgggctctgaaaacactggatatttagtatcattcttaaagtgcttaccacacttgtgttttagttaactatttacttctctttctcctccacttgaggccagggacagtcactggagaggcagtagagtcattttttaaaacatgaaatataaaggcagtatgcacaaatttaaattctgactccaccactccctacactaatgaatgcattagcctttcttcatctcagcttcttaatctgtaaaatggagataagttcataaggttattataagtattaaaagagtaaacaaagtacaataagtcctcgcttaaatgtcataaataagttcttggaaattgcaactttaagtgagatgacatacagcaggtcttcaaataatgtcatttctttcaatattgtttccttataatgttgatgagaaaaaaatttggtttcgttatgtcatttcgcttaaaattgcagttttcaagaacatatcaatgacataagtaatgatttattgtactttgaatagtgcccggagtagagttggtgctcaatacattagagctattagtatttttgcatccttcaggtcttagctcagtacttgtcaaacagttatcagtaaatgttgaatgaataaattaatgaatgaacaaatgaacaaatggcccaagccaaatgtattcaacttctcttgcctcagatctcttctctaaaatgaaatcattaggtaagcatcaaggcttctgttaggaaatcagtttctaaaattgcttgaggccttcagtggttgcacgaaaagttactaaataatttcagtctgttgactgtacttttaactgtttgtcagaagagaaaagttagagcaaattagctagaatagatattggagaagctcctaattgcaaaaggatagtcatgggcttccgagtatggaagtgaatacactgtgtataatatttttctctcttttggctgaactcaagcttcctgtagctaaaaacagatggcacaaaaaagcttacagtgtggaaagccagtttttcctgtacgaaaagaactgagtgtttggagtgctttaacttcttgtctctgctaagtagtgatggagagaaaggccgggaagtgtcctttgggtctcatagcattccaaagtcccagattacctgagtcaaaacaggttctagtgttaaactatttcttgggctaggaaacatagaataacattaagtagtgctttataatcctataattttcatgagaaagttagcaatgttttctttaaatattgctataagaagttattgagtgttatgaactgtgcttataactaggcatagatcatatgtattatttttatttcataattcacttttgttaaagaaaaaaaaactgattagaaaaatcatgctatatttcatctcgttcagtcccccaagccaaaacatagtcacatccaggcaccactgttgagcaacccaaattccagacccactgccaatgaggaaagaagtagtatttaaaggtctggccttgtatacataaatgtgctttttggctcaggatccttagcttaaatacttgcacttccacttatgtactagccaggaaaccagagtcatatcacttagtctttccaggcttcacttttctcacctttgcaatggcaataatgataatacctaccttacatgttgttgtaaggattaaagggattaaggttatagcacttaacaagttgcttgtccaactataaccatagtatttattgagtgttatcaccatttccaaccccagttttgggaaaaacaaatctaaagcagaagggagagcttaaaaatcatctagggcatctgcacagttctcaggtgggttatcaacctgtctttcatctcctccttagaatatggaggatagtattttctctgaatataccaggttcttctccccaaatcttggtcagtgtctgaaaagagatgtgttaagactcttaatcctgagggaacactaaagtattttcccattacctctctgttgctttaaaaaatataaattcttgataggaaattggagcaaacagtgccattggcaagtaggaaatccatccagtgttccttaatgctggttgtgaatcttgcctccatatgctaaataataacagacactagatcatttgcccacactgcattcctttcctcaaatactgagtttaggtcaccttccagtaactttatttcctgaattggcttaaatccagaaaaattaggttgtctgccattgcctcaaatcctccatcattttttcccctagcttttcatttaggttacctagttcactgggcaagaaatgaacccagtgttacagatattttgcctctgattcttgtacatttttagcctgccataaatgtctcaccatagaagcacctcacttaatgtttgttagccatcacttagttcataaaatagaaattgttccttcaagatcttcaaatattattgagtaaaacagaatcaaattcacttagagaacctgatgcttttcttggctctagacactctgtcaccactgaagcaacccatttgattaataatacatttattgtgtctacaaagtgttttctgcaagttggatgagagaaacttcaggaaatgaatgtgactgccttgatccacatgctccaagttcatccagtatgatcttccaaaggcaaaagcactaacaattagctttgtgttatggctcacacctgtaattcccagcacgttgggaggccaaggcgggaggatcacttgaagccaggagatagatagagacaagcctgggcaacaaagtgagaccttagccttagaaaaaaaaaatagttaaatgtggtggcacgtgcccgtagtcccagctacttggggactgagatgggacatggcttgagcccaggagttagaggttacagagagctgatcacgccactgcactcctgactgggtgacagagagaccagatctcaaaacaaaacaaaacaaaccaacaacaacaacaacaaaaacactagcaatccccatgccctatcagaggggacctttgccttctcataatggtgttactgcccctttccactctcctagtgattacttcttggtggcaggtcatggttatacaaatagtcgtgtagattttatgacagaatgatagtcttaatggaaaccaacccacatacctagctagatagaaaaggtttttgttgtattcataaaaggttttatagaagaaaaatcagcaatcaatcatagtatttaacaacgctcactgaaaagaatgttttccttgtacaaaacttaaatccccacatattaaagcttaagctcatttccttgtattctctcctcaagattaagggagaaacctccgccccagaaagctgctatttctctccaggttttcttgattaaatggccaagcaggtaatcagaggccttgaactctcgatgttgcagctgccatggctaattaaatggtgaagtgctgaattcacagacatgattaataccatcagggcgttttatggctttaatgttcataaattatgactgaacaatgaaatttgtatgtgggttataggatttttcttcttaaggatcagaattaatcagtgttttctcaattgattttaaatataaatcagaggtagcatcagtaaattctatagcttaagtatttagagaatgatctcagaaacaggacataatgaaaaccaagccaccatcctagtgtgatgcaagcctaaggtcttgtggattttcattctaaatgcaattcaggaaggccaatcagtttctaaaaggatggttctggagacctttgtttctgaagtataactcccctaaatgatctaatctttgccagctaatatatgtgtcagggtatgtaacagaatacagtagtcactctttctttacctggcattctagtgtgacactaacaagatttccttaaattgcatttttcttcctggagttaagtgtctatttcttttctttcttttttcttatttttcttttttttagaggcagggtcttactctgtcacccagggtggaatgcagtggcaggatcatagcttgctgcagcctggaactcctgggctcaagggatccttctgcctcagcttcccaaaatgctgggattacaggtgtgagccactgtgcctggctggctgaaaagagcctattctgttagcttttctctaaactcctcatttgtatttctatccagttgtttctctgagcctttgtacataattagaccacaaaaggtggtacttggctacctcatctcgtaaatactctctctgctgccttacttagtgaatggggagatcccagtgttactcgacgttggtgcatttgaatctgccaacatttcctttctttgagctcatcatcagtccttgaccaggtaacttcccactcagatattttggtgaactgttagtgtagaaggagaacaaactggcaagtgattctgagtgagcttatcttcacataggaagggtgtttgaaatttctcattttcagaatttcagaaagacagccaattcctttctgctcagaatggactgaggctgctcccgattaggctgtctgagttctctcatttttactcatcacagtcacatctgtttgggtttctgtctctctcctggagatgcctcttgagagcaggtcccctcagcttccttacagctcctctgaggcctgccaaaagagattggcagagaacgatcagcattctatgcccagataactcacataactctctctgaaaagaatgctaaaacctagttctcaagtgaacccacgaggagtggaatcaaagggacttttgcattttttccttggaatccaatttagaatttatgttctcatggggtgggaagagaacagagagatgggaagtatgaagaggggaagataaagaagtaggaacaggaacatatgggaaaaataatcataggctcccagagccaaaaggactttaaggaacatgtcatctggaggtttccaaacgttttgtttttagtaccagaatcttttcatttttattttttacgtaagaaatcatacaatgagctccactatataaaacagatgaaaagagaaagagaaataaacagttgaatgaaaacagttaaaatagatgaaatctactgttgaaacattggcgagggaacttttattacttttcattacttttagattgctgaagaatacaaagtgaaaactgccaatcttgtctaagtattactttaaagatgggaaaattgaggcctgtaatatggagaaatgacatactcaaggtcacacagccaattagtggcagagataggattaaaacatatgtttccagcctgccaggctagaactctttgggagttgagttagaaaaaaaagctaagaatgctttctttctgaacatggtcaaaaagagaggttggtggacaatgcaatgggagagcggacacgtgggagaaacaacggagaatagaccctaccttagaatagagcatagaagagtttgaaccaccagggataagcagagataactgaaatttacaaatatggaggagatccaggaagttccatagcaaggccacaatgtgaactgctaggaacaaatcaaaactggagaaaaagggatttggaaataggtgtcaaaagagaattctttattacttcccctacacaaatgtcgtactattggcccaggatggcagtgggacagcaaagacaagcaaaatatgcttctctaggattggctgcaattctttcattataccttctcaagatggatgtgactttggcatagtttcctgttggagatttgaaagtaatattcacattcgtctctgaaattttaagcacctgggaaatagacatgagagttaggaaaacgcgaacatatctgctttgtgtgtgtgtgtgtgcgcgcgcgtgtgtgcgtgtgtggagtttcgctcttatcgcccaggctggagtgtggtggcctgatcttggctcactgcaacctccgcctcccgggttcaagcgattctcatgcctcaggctcccaagaagctgggactacaggcaggcgccaccatgcctggctaattttgtatttttagtagagacagggtttcaccatgttggccaggctggtctcaaactcctgacctcaggtgatctgcttgcctcagcctcccaaaattctgggataacaggcgtgaggcactacgcctggccaatatctgcattattaatggttaagttcattgagcaatatgatttggacccaatttcaaaatggttttctttcactttctgccccagattgaatttaccctctggtcacaggcctttgtgagttctctttgtggaagagagaggagaatgaatgaggtccgtagacagacagatcacagagagatgcccccttctcaagtctcattaataatgtgccatgcattttcctgttcatgaaaacaaaagattcaagggggtcaggatataaaaagacagaaatatcttttgtgggttggcaggaacatgtgacagagggagagtctcgttccccctcccccatactcttcatttttcaatattatacaatttaatcagggagagaaggattagagcaagaaggacatctacaaacacgtgtagaatcacctggttatcagccttggcccagtggttccatgagcttatgtggatggtagacaggagttagaaacaaaaggatgtatttacagtttgtgtttgcaaatttgtaataaatgcccccgccattcttattatatattcctgaagtcttctctgagtctgtttacctctaatatgtaccacagagtgtccacaccaataattctacaggcgtcctgaaaataccttatgaatggtgtttgcagaagcaaacagtgagagctatctgagaggagaagtggaggaaaaacggtgtgggaaagcccttatgattttctcaataccatctcttcttctaaggtctatccccttcctgaatcagaacttcatccttctttagcttttgcatgcctgctctgggtcaggatcccaagagagaaatgagagtaggaacaaaaggcccttggggttggtgcttggcagaaggtaaaaacatgcagagaataagcagagaccttgtacctgttcatcacccaccccaaatatttgggcttgatcaaagcttctcctgacccctctttatgtaagatatttcccttcatggtatctggaatttaaacaacaatcacaaacattttgaactaggaaatagcctcctactcttcagaatcaatatcaatcagtcattcctcagggatttatttttccctatgaatcaaattttaaagaagtggatacttgaatagacttgaggtgttaaaactctcgtctaccttgtcctcccttttcatttgggaaagccaaaagcacaaaagagtaggtagaaaatgtcagaccctttggcatcattctcctgtaactatcagtctcaacccactgcaacctttaccccagtctgccttgcagacacacagtggtgcttctgatggagcaagagacatttcaagattgcagagaagtggaaggaggggtagcaacagcttcccctgtgaagcaatggaatctacagaagggtccggtgattcagctcttatgggctaagaagcctgaaagcatttcagtgttgctgagtccgagcttgtttgttgggtagtcaggcaaggaaaaaagggctagagtctgaagataagctgagcatctggttttgcatctacattagttctgaaaagaggtgatgggggtgccatgtaggagtccagtaaagacggtgtagggctgccaggtagtagagctgctctattttgcttcctagttggcctcagaaatcaagtaaaatagtcaaataattgtgtctgtttgaaggtagggatgtagacaggccatttctctttgctgcatttctggcctcaaaacctcttctttcttttcctccagaataaaatataacacagggagaggacagaacttgttaatagactgaggccagcaaaaagccagactggttcctgaattggagggaaggaggctgcctgactttggaggagcagaaaaaaataagttaggagattagagatgggccacagcttaaatagagaggttcgactctgcatttcccaaatacgtaatgcttacggtacacgacccaagctctctgcttgaatcccaaatctgagcggacagatgagggggcgcagaggaaaaacaggttttggaccctacaaattggcttgaaatgaaaagtcagcaaaaaccactgggtggcagcgtggtgtgcgggcgcagctctgcagtgtctgcttctgctgctaccgctggggctgaacccgtctggggactctggcctcctcccctgaatggctacaagtgtcgccaagcaaaatacctctgcgcgggtgggtgagggttctccgggttgttggtgcgtccaagcctgaggcagggatctggcgaacttctgaggggctccagcccgagcacaatctggtcagctcaaacactgaggaaacacccccaccactccatcccccaatgccgagcaaacccccgctccgtcagcccaactacctcatctcagttcctcctccatcactgtttcctcccgaagctcctttcgggaaaaggaggggagaaggatttggacgactggggcagtgcggaagcccctacaggtgttagccggaacgggcggccggggacttgggggggtgggggtgggggtgggggtgggaggggcggcctgcggctccgagcctacgggctcagccccgggagggaggggccgtcgcgggagggggctgcaaggaggctgtcgcgctgttccggagggtgcctgcggcggctgaattcctgtgctgcgactgtgccgcgcccagagcagcagcaacagcgaagatgcgaggccattacctgtttgatccctgtcggaaacctggcacgggccaacttttcccgattatcacgccaagaagttgcaaggactagtcgaagactcggaggggccagggcgagggcgcgctcccccgcgcgctgcctcgtccctcctccgtccggccgcccgagctcccggcctctctcccgcccgcgctcactccctccgcccgcctccctcctctggcccccatcagaagggcaacagggcgagggggtccggcgaaattcggaccggagcagctggacatgcacggtgtccgccgggcgcaggggccgaccacacgcagtcgcgcagttcagcatccgcgtgccagtctcgcccgcgatcccgggcccggggctgtggcgtcgactccgacccaggcagccagcagcccgcgcgggagccggaccgccgccggaggagctcggacggcatgctgagccccctccttggctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccaggtcggaaagggcttttgctttcttttccccatactttacgagtgaggtgggggcggtggggagcaggtatgtagcataggtgagtttgttggtggcccatcttgtgcagaagaggccacctagcctgtgtgcgtgcgtgggaaggcgctggctttcttgcctccgtaacagtaacacgcttgctgcattgcaactgccctgggacaggcgcagagcctgggggcatactctgccctgggtggcttgccctcagcttcggacatgtcacatatgtgcatgcccggtgggctctgggcaggcgtgacccagacatggctgtgatatgtatggcgtggaaattgcaggcgcagagctgggcagacaccatcctcccgtccccaggagagcctggggaatccctctcttgcttttatctctgcctcagacccttcccctccagcttccacctccaagggatgtgggcttctgctgtctaggcattgcgtttctttgatgacttttaagctttttgggacagacttgacttgtggtgcagcttcgaaatgtttgctggggcggggggaggggggatttctagaaccttgttgcaaagagctgagagatttggttagacttagtgtaatcggttacatgctactaaaatgcggtgttgaagaggggatttaagctcatacccagactgtggtgcttttgaacattttcagtggtaggagtagcgcgatattccagcgactggaaattcagctctaggtgtcaggttgcgtcaaggcagaccttcaggcgagcatgcagtttatttgccattcttaaccaaatgaatcttttacactcttttctgccttttactagataaatattacaaaaaaaataagagtcaccgatctgttatttctccatttatgtgtgctacaccctgggatggaaaagcagacataacgttttctgtttgcacaaagtttttaatgcattaactgtaaattaggcttgtttcaaaaaggcttaagtggttgcaaagcatgcttatgtggctcgaataatcacataaatattatttcagcgcaggagtctatattcagtaaaagaaaattttggataacatggctgttattggtaaatgagacacttgattgatctatggttattcataattgaaaatcattttaattaagaactcatatttttgataatcatacttctgatatgaaatttgaaaaattagtatgcactgattttttccttcctaccaacaaaaaccctgctcttttcacacacattttcactaatgataattaatatgacaagatttgttaatggtggttgtatctccctcctcccttttttggtataaaaggctcaattttccaaatacagtttccttaatggggttccacgttatttatgcattttctaccttcttagaataaaggagattatttattcaaattgtggtcattctgaaggaaatctttgctagtgggtttttggtccttggtcggttggcagacaactctgaattatctttctatttctccttttcctttcacatgaaaagtagcacaatttcaaaaggcagaatagccatttgccaacccattacaaatactcagtgagatagagttccactctgtaaaccaaaggacaggttatcagaaactatagacactttcagaagctttaccaatgtttccagatagaaataaaatgtttctttagtttgaaaatttattctgaaactcagagtttgttttctttcttccagacaccttaaaagtgtagtttgactttttccattaagatttgtaaatgaaattagaaattgaaattcctagtcttttcaactacataggcacaatttatcaattgatccaaatcattgttctctttgcagagcctcagcttaagggtatagttaccaagctatacagccgacaaggctaccacttgcagctgcaggcggatggaaccattgatggcaccaaagatgaggacagcacttacagtaagtgactgcaaaataaatagtatatgccagcatgttgttaacattctgtttttatttattttaaaaataaatacgctttcctaaatcctgaattaaatgcaaaatatattcacactacataatcctgtttacacaggttaacctaaaggaagttgaatatgagtctgtctaagatagtaaactagggcaaataatgttgacaccatctgaagaataatccaaatgtcatctccatggaaatctagatagatttatggctatcctttggattttattacttttttcccacagaaaatttactcacccacacactgatccagaaatagcatgttatctctactcttaagaaccggtcttaacccaagagagaggagtggtttcataccatgaaaattcatcattacaagctttcacttctgctccctgctccacacacacactgataactctgagactagtggaattttaacattgagatacctccgcaggtgggtaaagggatttcttttagttctttctttttaaccatggtttcagaccaaattggagactataatggtgagcctaaaaaagaaacacataaaaaataattaggttttatttccaattactgaaagaaggtgattccaagatgttacgtaacctttaattacatgttttatttattaggagtaataaaaatataaactcacaaatagtgcaggcttctcctcaatgatgattgatgttttcttgcaatttacagatttctggagacttactaaatgttccacaaggctaaaacacttagttctcacaattttttttgttttctccaatttctactgaatttctctcaaaccctttgataatttcgcattaatattccaattgtcggctgagaaaataaccaaggaaactaggtctgaatgctaagcagtatactctgcagctttttaagagttgtatggctacagcaatgccattgacgagggtctcaataagtgtaaagagtttcccaccttttaggaatgcttcgtgggctgatggccgatctataacctcgagaggaagtcacttttaattaccattgaagaaagctttgttggtatggaggatgaaaaaacctcatactgaatggttcttcactgttttgcaaaagttctatgtcactgttgtgatattaaagttttatagtaaatcctagttgttcttttatgcatagtcttctatttgaaactattaggcaagtgtaactagagggctttactgtaatcaaataacagacattagtgtatagtgatcatctgcaataaaacattcccataagttattgtgcaaattgatatttggggaaggaattaggggatgtaagctgccctgctttccagagtgcctcaggaaaatgggtctgttgagcattattgaaggcaagttcatgattagctgccagtgagcctatccagtcacgtttctttcccctttttaacatctccgggtacaaatcagagaagaaatattttggatctggtgttcacatgtgtttcctgaaaagaaataaaaaaaaagtagataattcatgtgctgtgtcctatgaacagcaatataccaaattcatcgagatcacattctaagtaatcattttaagagatacacacacacacaccacacacgcatatatcaaggctccatttcttactgtggagctttaaatcatacagtaggttttactcttcagttcctacatatgcatagcttctgcctttggttgtcttataactgactgatacgcatggcatttctgtgtactactaatgatattgaaagaccattaaagaacatagcctgataacaggaatctgtatttaggcagattaaaatagagaggtaagtcaactaaaggtaagtattgtcataacctgatgcatacaaatggaaagtatctcaatagaaatagcaagtcagtagagcttggatctgctcctgatgttaagagtgaccagaagctagtgagctagctcagctttgccattgaggatattgtggggcataagccatcatgaaacaagaaggtttaatgattaaactggtatatcatgaaggccagctatccaaatgtattctttttttttccttaaaaccaagccgttttattggtattaattgtttaattgtgcataacgagaatacaagttgtttttttcaactatcactcatgtatataatatttccctaatatgtattcgtgatactatgtttatatttttcttactcttcttatttttattaaccttcattattttcagcatattttctcatttagtttaatttgattgaattgcgttatttttattcagacatagtaagcaatgtcctgataaatcagttcacatttatccagatatatccatttctgaaaacatatgtttgatattatgcatttcaccttaccttacgtagatttattacaatgataaatgtcagttcaataaaatctcatcatgaggaaatcagccattgtaaattatgtattttcccttgaaaaggaaaagatgatagacattccatggcagtaattttattatgtctgccctgggtgcaaggaaggacattttaaaagactagttttccctttctcttcaaactcacggtagcattatcagttcaacatgttgcctttccaacctacgttaatatatactttcattaattattctcttttgagaaattgaccttggccaactgatgaagaagcatggcttcagtgttgccttcagcaaacactgggtgccaactaggtacatggctctgattaagtggcccttcaaatagaaggtgtttgtttttatgcagacataacagagaacaaacaagaaacacaggcacatttatgttttaaaagcttcttcaaaactttcactgaaatggaagaagagattttaggtatttaatgaatgtgttttaaatccataaatgaagtcaactgttttcttctcatgtttatagtatttttatcctgatcaaaataatatattaaatccatgaggaaaggtaccagatatagagaaacaaaagcacataggaggatatttatttggtttaagctcacccctgatataatttctttgcatttttatctgggcagactgtccctttagacatattttaaacaaacccggtttatgatctatcttgaatgtttaaagaaatgaaaagatcgtagtagtatgatcagtcaatccctagattcgctactctcaacaagtttttattttggggtgatgttttttgttttttaatcaggcttcatggaaatttaaagtacatagtgaaaagtacatagttttgctatatagttaataccattattcaagattaaataatcacaggaatgtactgctgatgtttttttcttctattcctccttctgttttctgatgtttgaaatttagacatttcattgctcattaaaacctgagtcagagtgattggagaacacggtgaaaatcaaatcagttttttttagtctctctctgtttctttcttgtgcttgttataagctgcattaagagaactaagaaagttcataatattattttaaaaactgaagttctataaataattctgaatttcatttatcattctctgtcatttattactatgactaaactaggtgtcaagcatatactgatattatagttgtcaagtggtatgtagtgatatggcttttaaaccaaccccatgttggaagttttgctttagttttttagatctcagattttttgaagtatgagcttttatataaatgggattgtggtctcttacttttcaaaaacatagtatcatattttcaccatacagattgctatcaatccacaaatgggtgttgaacacctgctgtgaacaagacatcgtcaacagaaagggatatgacaaacatgacatgctcagagatgtcagacttcttgcctgtgtattgcattgtcaaatatagcatgagatcttggcttgcaatctgtgcaattacattcctttacctcacataacagaagggcacagcttttaatttgatgagtattgaatgaagtgccatcagtggcatgtggtaggaacacttgtcttttgaaccgtacaatatgtcctagctcctctttggtaacaccctggttttaaaggaacgatacgttgtaggctcaccaaggaatatttaggtcttcattagtatttctcatccatattaccccacctactgcagcagaatgtatatgcacagagataaacgatcccagaaaaactattcttacccacagggtgactcctttacattcttgttcacagaaaccataacagactgatttattatcctcaataaacttacaaaacaaggcaaaatcatcaacattggtctacgactcctgagagaaaggtgcacaggctattttcaaaagatgtgtgtggcaagcactacgttttaaaaatgtactgttttatttttattcacagtgtgggagggagtagacagctggtagtgggaggacacccactagttgtctccagtgagtggtgtgtggttgtgaggaaagcctgggtgtaagtttcacgcagtcagatcttcaaatggagaaatgaagtcctcactggcaccaactggctgcccacttgcaactattttgctaaaataataataataaaataataaaataaacctctttcaagttcattatttttattcctatgtcctttgttcttggagactaaaagctaggagccctctcaactctaatcttggaaaatgttggtcctttaagaaatactactctgaagccgggcatggtggctcacgcctgtaatcccagcactttgggaggccgaggcaggcagatcacctgaggtcaggagttcgagaccagcctgaccaacatggagaaaccccgtctctactaaaaatacaaaattagccgggcgtggtggcacatgcttgtaatcccagccactagggaggctaagacaggagaatcacttgaacccaggaggtggaggttgtggtgagccgagatcgggccattgcactccagcctgggaaacaagagcgaaactctgtctcaaaaaatgaaaaaaggaaatactactctggaaacataggactacaaaatgactttttctttttacaagacctgaatttattttggagttcttgtatttggaataacacagataatttagatgagggcattggactcttctaaaagtctaggactctctacccaacaggtagattttaaatatgactgtgagaatttcagcagttatcttggggagcagtttaaaaccttaatttgttgagaatgacactatttaatgtacagaacaattcttgggactgtatctttccagaagcatcaagattccccacctccaacactgtaaaaaccatgaaattgtgaccaaaagccttccattttctccaggctgttaaataatatgtagttacagctccagttacctggctgcaaccatgaaattaaatacactaaaaggtagaatgagacctatctgtctgcctcggggtatgtgtgggtgtgtttgtgggggtctgtatgtgtatgcatgtctacataaacagacatatatgcataccctcaccaactacacactacttttggaggaccaggcagtcctgctggaaacattgaaaagttctgaaattcagaattgtaacactgttttcattttcttttttaatttcagctctgtttaacctcatccctgtgggtctgcgagtggtggctatccaaggagttcaaaccaagctgtacttggcaatgaacagtgagggatacttgtacacctcggtaagcttttgactgtgtgcatgttttgactattctagttttcatccaatatgaaagaaaatgtgctttatatgtgttatcattacagatttctgtgatgaggagaagaatgttgatggaaatatttcattgaaaggacagattaactttctgtgaaaaatatatctattactaatcagttatttgaagcaagcattttagtatataatcaaagattcactgaacattttttaatacagtgtcatttgggtcatcttatgtagcatataatggtctgtcttgctgccttgctttgcagctgtgggaaacaaagtcatttctataactcagttgaacatatatttatccaggtttactcctaaaaaaacatgagatctctccctcagatcagctcgaggacatgaaaaccagttcttgaagggtttctagagttctatttcttatcttcagtttaattgaacaggattcctgattgcttctgctttaaatataagcactatttaacctttccttacctataaattcctgcttgtctttttcttgtaactttggagtgaacagaatgaaaaatggaactttttctcagatgaatgtataaacaatgtagattacaattcaatatggaacatggggccaaattaaactttaaaaaaagttaacatttagatataagcaaaatgatacagtattagggttaagattttattcttattggcagatctagtttcagattataagagactatttgatatatgaatttttattttaacttaattaattaattaatttatttatttatttatttgagatagaatcttgctctgtggcccaggctggagtgccgtggtgacactccatatttttagcagagatgggtttcaccacgttggccaggctagtctcgaactcctggtctcgaatgatccgcctgccatggcctcccaagttgctgggattacaggcgtgagccaccgtgcccagcgtaatatatgagtattttttaaatctttgttttgaattcatgtattttaataaaggaaaagaatgtttaaaatggagaaaattgcttgtcgaacttcttactagcaagtcttgaagcaggttgttagtataacaataaaaatctgttcctcaaacttcaggtgaaacactacctttaaccactcttgcttgcttgtttcctgaatttctttcaaagccaggtgtgcaggaagactcttggcagatatggtggaaaccatatgataaccctgttttgcagaggccaagatgggaaagaggtgggaatagagtaaggccccagagggcctgtttatttggtaaatcaggtagtttgtttcatatgatgagaaaagattatgaaaaaaagagaattatcagcatatacctcaaaccctggtcactatcagttttcctatcaggcaatttcagtggtctggttgcttaataaatatgggggtttgctctttttactaaatgaaaaatgtgattttatggcaaagttcatgaaatacgtcattttattactagagtgctactataaaagataggaaaggggattttattttagatttgtgtactaaggtaagataatttaataatgaaggattttaagtaatttcctttagatcaacagactgcctcagcaggaccagatacaaaggtaggttttttaataaaatagacgctttctgaaaatattgtgaaggcatgataaggaaacggaatatactgggcatacttttgagaaagcacatgccagatatcatatgaaataattactgataaatcatccagaatttcaatgggttgcagtcaccgttatggtgccctgatgagaaaagctaactaaatataaattttgcaacatcacaattgaagaacgtactttggaaataatatttaagtaagaatgtggaaaattatttaacttgggttatatgtcaggtgcccccactcaagaaaattagggcactcagcattacacttaaggaaccagcgttgaaaatgcatagcctaccattcaaattaatcattattccagcaaactggtaaatgtcaatgtgagctcatttctagaaaggcttcccagggaaatgaggactgtagattggtgaacttcctttccgtgatgggtgggccaatatacatccaaatgtggcacatcttgtatgtatttcctattaagaaaaaagaagccttaagtaagtgtttctattagagaaaaggaactatgtttttgttaaggaggaaatatgcctgcttgatgatcctggagttcatatatggaaagaatatccaaattagtctgctccaggaaataaatcagaatcctctttagaattaattttccaattcttccaattactccttattaattgtggctgggaatccattcaccaagttgatcaccatcctcagtgggcacttcattttgttgtcatcttatttaaagtgtggtgcccagattacttaggatggagttctatcctaataacttcagcaacttatattgctgagatcaaaagcttaatgaaatatcatgtttcatcaagaagagacagcaaccaaagaggaaggatcactcttcccttgcgtaaaaccatggcacttctactacaaaatgctatatgcaattttgcaaagtgcctcttagcaaagagaagacagaacaggacaatgacctaaagagaaagcaaaagtaagcaaaggaggtaaggggctactgatgtgggcaagttaaaaaaaattggtgagggatgactacagtctgcttaaaaagcagttgcagtgggaatggctaaaaggagatggattgctgagatattttagaggtagaatcatcaggatttggtggctgattggatttggaaggaaagcaggaccaccatacatggttaaacatgtatggttgccattcactgcacagatgagaatgaggtgtcttcaggtaagaattaaaaaaaaaaccttcacagaagtcagaagtgctcagtggattatcaggcgtcatgagggagagggggaattttgcctctggcatttaggctgaataaagcgggaaaaagcagatttgaggaagttacctgagtatagctttcaagggatatttgaaaatatgaacctagcacttgagaaagggacatgaactagaaataaaactcgggagttatcacatgtaggtagcagtccatgccatggaaatagttatgaaaatatgtagcataagaagaggagagagcttgtcaaataatgttagaaaataacagcatgaaagtgaccagcagaggaagaataactaattatggcagatatagtggtattgcaaaagctaaatggggaaggagttttaagaagagtcagcaatgtgaaatgtttcatatgttgtgggtgatcttaacaaaaacagttttggtggaatattgggaacagaagccagattctagtggcttgaggagtaaatgggatgagaggaagtagaggcaacaggtatagaatttctaagggaagggaagggaagggtgggtgtgtatttagggcagaacacagggttgaggaagactgaggattctttggttaaggatgtcacttgaacatatttgttaagtaaaagaaatgaacaaatagaaagggagtgattacagacataagaaatggtattctttatggagtcgagctgcagaagagatggaagggtgatggaattaagtataagtgaaagaattacattcatcttgaaaagaagggacactgaatctctaataggagacaaagagatgaggacagatgcagacataggtttactgagtctgcaagtaatagacaaggaagtagaagaattttctaccagatgatctgcatttttccattaaagtagaataagaggtcacctactgaaagtcaaaggtatgggggtaaccacaggtaaacaggggtgggaacaactgttttgggcaaggggaatggaaacagtttaataaacaggagtaggtaagctaaggccgtgggtcaaatccagcccactacctgtttatgaaaataaagttttattggaacgcagccacacccattcatttacttattgtctacggctgcttttgcactgcaacagcagagttgaatagttgcaacagagcccttatggcccacaaagcctaaattatttactaaataacttgtcccctttacctcccagaaagtttgctgacccctagattgtaatcagataatgattctcagccttaggtacccatcagaattacctgaggaactttaagaaattccattctttgtgttacatttggaccaattatatcaatatccaagggtgggatctacgcatgaatattttcgaaagctccccagctaatgcttatgaaaaccactgatctgagcttaagaaaaatggttgttgaatagcactgaggcactgaggacacgccactgaagtcagaaaccatgagtttatatgcacttaatcatttgttccaaattcctgataccaatgtttttctgttcttgcaagcaaattgcctttacatttttgaaggaatatttcttgagatgatggaaaatgctgatccctggaagagcgttcttattttatctctttttctttattctaccttcttttgcatttctacttctatatccctcaattttgggggggttgaattcaactttatagtttttgccatttattttctcccttttgtccattaaataaagaaacgacacctccacattgttattgttacagagatagcaatttactttccatgattaatctcagaattcttgcactgcaccctcccttccccgccctttttttttcttgttgccatgggggacagacttgatgtaggcacatctgtggcacagagaatcataattagccattatttcataacatatttacttttgtccatgatatatgctgagtctttctgggactgcaagaaagttgttatttgttgtgcagagataattttgttcttacctttggttttctttagcaataataaggagttgtacacaagcttttgagagttcctcaaaacttcacagtatgaatatttaataacataaagctatttgtaataaatgttttaaaactgcttgaaataaataatcattgactatagaaagtcaagtgtcttaaatataaaaaaaattcccgttctatgtctactttaataagaaataacagatattagaaacaggatagcaaaaactcaaagttaaaccaaaagcattactattattttttttattttggaatgttctagaactcattagcagcagttctacccatataattacttacctttcaaaaaattctagttttcctttttcacaatacacagtattgcttgggttgaagttggggcagacaaaacgtatagacaagtagaaatcctttgacaagcctttttcattcatggatttccagggaaaacttgtaggagtgattttactgtcacgttttgtagtcctgggactaccatagcaaactagatgcaagaccagaaagcagtcctctttctgagagtcagcttgatgccatgggaatgagacagcttgtgttactgatcccaacggctcagtcagattgcaatctgaactaaggggacatatttttcttctctactggattattttcacataccttaaatttaccgtttcttctctcattacatagagttgttcttacctatcactcagaacatctcataatacaatctcctttgaaggagtcactatcagaaatagtgacaaatgaaacaataccagccccttagcagttgtgacaccttagcttcacttgttttattctttgacaacttagatttgctttcctttaagaatgttacatgcctaagttaatatttaggttatatttaatgcatttagcttggtttttaaaattttataatttttcaacacatattgcaaatttttggccattgtaaaatcagttaagaattactgttttaaacaaactaaatatgagaaatataaatattaaatggaaaaattcttcatttgaccatgcctctaaacacgttacatttagagagatgcatttgattactgaggtgtgtgatatatgaatacatgcataaatattcttagaatgcttttgctgatgaatagggaaaagcccgagatggcagcccaagatgcagcatttgctacagataattcaattagtaagtgttttgtcattttccttgttctcaaagacactgacattgagtttgtcagtcatatgttaacattcttggtaacttcagaatccctgagatgacccgtccaacaaaactggtctcaagttctgtgaccttttttagctgtaaggatatttttctattcctcagccttatcaatctcatggccatactcttggaccttttcatattccagactattgaccgcttttccattatctattacctccttctttttttaaacagcttgaatgagatatagttcacagatcttaaatttatccatttaaagtgtgtacaattcagttgtttttagtatatttcacaaggctgtccaaccatcaccactgtgtaattctagaatacttttatcacgctaaatgaagaaattataccaattagtagacacaccttatcccgttccccagtctcaggcaagcactaatttactttgtctctctatggatttgcctatttggaacatttcatacaaaaggaatacaatatatggccttttatgactgtctcctttcacttagcataaagtttagaagactcttacatgttgtagcatgaatcagtacttcattccatctgatggctgagtaatattccattgtatgttcctacattggtttattcattgtcagttgatggacatttggattgtttcccccaaatacctgcatagctgcttccttctttgttcacgtctcaactggaatgacattctttagaaaggccatctctgaccaccttaactaaagcagtacattcactatctgtattatccacatttatcttcttcaaggcattatcactatttaaaattattattttgtgtgtttttcatcttccccaactagaatttaacatgttgacagcatatattccatttttcttatacactactatatccccagtgccttgattaatgcatgctgttgttttctcaatacatatttactgactttgttgtcttcaaaagggaaagcaaatatgtacttatagtccgattttagttgcgttgcttaaaattttttatttggaaacaacttcaaacttatagaaagtttgcaagaataacactagtacaaatgactccatatatcctatcctccgattcattttgctccatttgctttatcatttgttctttctttcccacacacacacagttttctgagccatttgagagtatgtaccctggcactttacacctatttcctaagaatagggatattttcttatatactgacagtaatgaactgcagtaaatgtaacattaatacaatactttagctaatctactgtccatattccaattttttaagtaaaaaatatgttcattttttccttccgtagagaatccagtctagggtcagttacagcattggcatgtcttcttagtctcttttaatctagaacatttccagagactttctttgtgttttatgacattagaatttttgaagacaagagtccactttctaattttaaaataagcattcacaattttgggtttgcttgatggtttttcttaattcaattgagattaagcattttagccagagtactgcttaggtgatagtatgtccttcttagggtatcacatctggaggtatgcagtatccatttgcccctcattggacgttaattttgatgataaaatcaaggtgttttctcattttcccctgtataactcttggttttctgggtttgtgtgtgtgtgtgtgtgtgtgtgtgtgtgtgtgtgtgtgtgtgtgtttcaactagtaaataatccactgggagacactttgagaccatgtaaatatcctactcctaagatcccagtttttaatgttatgttttcagcaatcccaaacctctttagaaaagtaaaataattagtccataaattgagaaataaccagtgattcccagatatgtcatataagtttactgatagctaaactgaggtagaaaaaattaacatggccgggcacgtgggctcacgcctgtaatcccagcactatgggaggccaaggtgggtggatcaccaggtcaggagatcgagaccatcctggctaacacggtgaaaccttgtctctactgataaaaaatttaaaaaaataaaaataaataaaaaaaaaattagccgggcttggtggcaggcgcctgtagtcccagctactggggaggctgaggcaggagaatggcatgaacccaggaggcggagcttgcagtgagccaagattgcgccactgcactccagcctgggtgacagagcgagactccatctcaaaaaaaaaaaaaaaaagaaaagaaaagaaaaaagaaaaaattaacatgtatttccaaaaaataaaaaatgtcataaaaaatatgatctggcagcaatttctggattccgcattctagtcactgggcttaaatacaattaatggaaaggttgtttgcattgtttaggtgcaataaaatcgattctgatatatgttttaatttcataccatgagtagggggttggttcatgttaagatgcctcagatgttcagtatgtttacctgtcaaatgcagggttacacttttgctgatttgtttacttcctgtgattttaatgtgtgacaatcgaagacctaattttcaatggtatggctttgcatctttagctcttattctaatacagaaaggatgtcaaactttagatgaactcattgatcaatttacagtgatgaatgtacttctagcaaatatttgtagcatgtaaaatgtttgaattatattagatggtatatcagcaagtacatctaatttaaattctagggttactttttagaggcttaaaaatctaatagaattaaatggagagctttgtttaataatgaaaactctttaggaaagtgatatggactcaattattgaaggaaattgatctaaaataaacacaagcagcatcacatccaatattgaagaaaatgatcattatcaaataaaatcaaaaagcataggcacaaaggtattttaacttcagattaaaacttttgcttattgatatatatcagttaattaacaaattgttgaatttggtttatttaaaattggaaaagtgtttactatcaaaacttaggttcctaattttggtgtgtagtatacatttgataaacttttttgatgaatcatttagttttatgggattaaacatttctgatgaatgttttcagttcacactaatggtttgtatgggtaattatacaaacacatatatttctgaatgctatcactagaaatggaaaatatagaaagttaaatttttacaggaaaaaagcagagaaaataagcaaattttatttattaccaaatggatctgctagctcaaagagctagattttatgttttaaagaggtgtccagctattgagttggtgttattaagatgaaagtctttaaaattattgcagtgaaaaatatacagaagtagcagtattcatcttagattttacttccaaacacaagtaaatcagcttaattttcaaggccaaaaaacatttcctacatcacagattatttcacgtttattattctttgcaattaatgtaagtttcactaaaatatgaagaaaacctagcttggcattatttgtatgtgaaattgcataagtctggttgcttgtacctattttctctttatggactctaagaaaataacaaaaatgggtaaagtattcagggtgatggtctagtgttttaggtgtaagaatgactgagaatggtactttctgggaaatcagggagactattggttgtagctaaatagaatgtgactggctctgtattctgtttttgaggccaagttgacaaaaaaaatccaaattagaggtcatggagcacatatttaacagagtgtttcatgattttaactctgaagctaaattcatatttgtgggaaaaagccagactcttgaagctaaacaataaaataattggcaagaaagactaagaggaattttagcaagtaaagccagatgtaaggggatttacacacacacacacacatacacacatgcacacacacatataagaaagacaaatggaaaaatgtaatgttatattcattgctctgttgctataacggcactagttattttggaattcctaaaataattctaagttttaaatacataacctacactgaacatttggaaattgctctagcaacatatttggtaatgctaagtacctttatgaaagagagcaaatatgactttttagctttattttatgtgattacccagtgattctcatgtcttggtgaagacgttgtttttagtctctatctcctcgtttgtataatgttaatccacaacatgatagaaaaaaaaaaaaaaacagctcaacaaaacatttttccccatcaaccttgtgcattgaaatagtttgcctacaaaatcctatgctcattaattagtaactgatttgttttctctctacttcccccttagtcatagagcagcctagcaaaagtatgtttttaacacatatttattgaaataattaatagagatgtatataataaagcataaagactgatgatattgtttctgtcaggcctattgaatattttaaataagttacagagaccaattatgaacttttgtgggtcctctgaagtgttaacatttcaaaattacataagaaagtgaattactgagacacaagaaaaaaaattggaagctacagcactggtttcagtgactacaccacttaaagggaattgtgacttctgaacagggaagttttgaatgaaagcattttctgatcattataatagctgtaaccaaggttaataacgggcaagcccctgaataatacagttaatatgttttgtccagctgaatgtgtgagtagataacacatctatgctatcattctgattaagttattcatcagataatctgatgctaactacttttgacagttctggaaatagaactactgtgaaaacctcaattgatttcttggatatataacacctccttttaaaagggcctcagatgtgtataggaattctggcatatcatataacaaaagtaattaaaattaggtgtgatgttcatttttacccaagaaaaaatgtcctataaagatttggaagagtcaaatgtaaataacaaccccaaagtattataacttagactgtaataatacgaagagtgaaaaatgtctgatagaaagagatgtgagtcattccataatactttcataattgtcaatgagataccaggaaatgaaagtcatagctttcagaaatgaaattcgaaaaggtaaaaacttcattgtgtatagtaaatactataacaaaaaagcctgtgtgtaacaaatctactgctatatcctggccacaaaatcagcaaggctacaacaacaaaagtcctctttagagtgcttggtggttgatctgattaaagacttcttaaaaatatttaaagtattcccgggctccttcccatgtcataacagtgattcactgtaattaacgtgttaatgaaagagcctctttgcagtgttattttcactgaggaagatagagcctatgggagacctgaagctgagagcttttatattgtatcataacctttgaagcagaaatttcctgaaaactcccttcattgctcttcaagtctcagagagcccagtcacacatctaatctcccagggaagtcgaagcataaaatggtccacaagctttgccaaccaattgattagcatatacctgttgaatatccataagatactaggcaccccaaaccatgatcatgttgatccattcatactgtcaatgtctggaatttatagtatacataaggagattcatcccaaattcagatctgtaattgttaatagttgatctactacaggatcagcataaactgtttcatcctgacttctgcagcttggcaatgctatttttagcccagaactcactgtaagaagattccatatagggaaacaatttgaatgccttgggatgggggtgggtgagagtgcatcattatggaaatttaccagttatatcaaacaatatatattggttgcttggcaccacagactttagcagatcacactaagatcatgcttctatgccatgaggaggtaaaattgaatacactggacaatggttttcaattatatcaagaaatgatgtaggataaaatgctttaaaatttttatatatgtgtgactcagaaaaaaaaaaggctcccacttgcccagcacaagtggattacagtagattcaaccaaccaaagcttttagatgtatcaaagtccacctcacatgtttggccaatgacacagggatatatttccctccatttttctataatttcaagttccaatagtaggcataacaaagagaaacaatgctgacccatagagatataatttcctgaagctataacatgcaatatatattaacacctgatattttgaggaacagaaagtgcttatttctctaaaaaaaagagttatcattttctactattgactttcatgagtgatgaggaaagagcaaagttttgaccctcctatctcctccttctttgagatccccattactcatttaccccttctctgtgattagatgggtggttaacactagaagcaataagtggatacaaaacacatgtattaaagctcttcattacatttatgttcctcatatctttaccagtaagggaagcgacctggccaactcattatgtttctctgtactcctctagtcccaaaaataattatttgcttgaacaaaaaagttctgctttcagtagggctgtcaaaaaatcaaagctcatgtacattacaagggtatttcagtcaaacgattattaaatttcacataagaaaatacactcaacagacactttaactgctatctctgatcaaggcatgaaactgttcaaacaaataattaaacttgaaaatagggtgtcaacagaaccatgatgggtggttttgctgagttattttctttgctgtggaactcggccttaaatgtccacatggagagcaaatagagcagcattttattttatgttctcttttccaataccctacttacttgaggtatgctttctcttcagattttgaggttagacttttcttctctataactcatctttttgcctcctctgctcagcggcagctatcttgaacctcagaagccttggtgagactaggagtttcagcatcaagagaggtgtttggtttggtttggttcatttgtttttcagtatctgtaacacattctagtgatgcctgtcagtttgctggaaccactcatggtccttgctgtcagaggcaaggctctgccacttggggcgtgagtgtaggtgtagacccatggagaaagttgttttgcaacaaactgcctggatagtagtgttgctttgtaattatgtaaaatcaaaacattcaaaagatgctggcagataaatgagagataataatagtaaagaaatgagaattccagaaatgtaaaacaattctgaattagatttatttcagacttagctacctttctttttggcagacagagcaccattcttgggagtttcagggaatcaaaatgaaaatgaaaggcagtttcttccacaaggtttttagtattctctgaaattctgactagcctctgcccctcagggttcaacagtgtgagagctcttggtccagatgcccagtaatctctgtatcacctctgtagtaagaaatacagtataaaaaggagtaaattcagttatttagtagtggaaattacatgatgacagatattttcaaagatgcttatcattgattttctctccatctgtgctaatattcacatgcatacctatgcaaataggctttaaatgatttgatttcatacccaaaagtcagattctcctgttgttcatttagcatttttctattaggatatttgaaaaaagtattttttatggtaaatatagaagcatttgagcagtcttctttttatatggtcagttttccattttgaaggggaaacacttgtccttgtcagaattattgtgaactgccttagtttaaaaattggaaccaaaatgagatttgattgttactggggtaggtttttttttaagttttttactgatatgtaataattgtacatatttagggggtacacgtggtattttaatacatgtattcaatgtgtaattatcaaatcagggtaactgggacatctgtcacttcagacatttctctattctttgtgttgggaatgtttcaaatcttttcttctagctattttgaaagatacaataaatttttgtaaactataatctccctactgtactgtcaaatactagaatgtattccttctatctaactgtatttttgtacccatgaaccaactttgctgcattccccctcccacctacttttcccagactctggtaaccatcattctactctctacctccataagatccaatttttggggccgggcgaggtggctcatgcctgtaatcccagcactttgagaggcccaggtgggcagatcacaaggtcaggagatcgagaccatcctggctaacatggtgaaatcccgtctctactaaaaaaaaaaaaatacaaaaaattagccgggcatggtggcacgcacctgtagtcccagctacttgggaggctgaggcaggagaattacttgaacccgggaggtggaggttacagtgagctgacatcgtgccactcactgcactccagtctgggcaacagagcaagactccgtctcaaaaaaaaaaaaaaaatccaattttttagttcccatatgcgagtgagaacatgcagtatttgtctccctgtgtctggcttatttcacttagcataatgacctccagttccatccaggttgctgcaaatgacatgattttattcttttttgtggctgaataatattgcattgtgtatatgtaccacattttctttattcgttcatttgttgatggacacttaggttgattccatatcacggctattgtgaatagtgctgcagtaaacatgagaatgcagatatctctttgatatgctgatttcctttcttttggatatatacccagtagtgggattgctggatcatatggtagttttatttttagtattttgaggaacctccatactgtcttccataatagctgtactaatttacattcccaacagtgtacaaggattctccttccttcacatccgtacccagcaactgttattttttgtttgttttatattagccattttaacagagttgagatgctatctcattattttgatttgcattttcctgatgattagttatgttgagcatatttttcatgtgtctgttgaagagttgtatgtcttcctttgagaaatgtctattcaagtcctttgcccaatttttaattggatttatttatttatttatttatttttgctattgagttgtgttcattatatatgctgcttattaatcccttgttaggtggacagtatgcaaatattttctcccattctgtaggttgtctcttccctctgttgattgtttccctgctgtgcaggaactttttagcttcatgtattgtctattttttaaattttgttttctgtgcttttaaggttttacccaaaaaatctttgccaagaccaatgtcctgtagcattttctggatgttttcttctatttcacagtttcaggacttacatttagatctttaatacattttgagttgatttttgtatatgttgaatgtggtaggttattgtactagtgaaatgctgacaaaagcatgctgaaggaagatagatcattattttgttttggattcttacattgctttaaccacccgtgcttaattgttttattattatttcctgaaatattattatgcatcattgaatactaagtcagcctttaagaggctttatatatacacattctaggctttttctaagtataactaatcatcaagtataggtgtcatttacacagtttgtttgagtcactcctttaatatgatataattttcttagctgacattgtatagattttatcaaacctaaaattgagtaatacaagaaattctaccaagacatcagtgtcatttgcatagaggcgtaagtatattaagatctctgtatgaaatgtgttgtaagagtatgaaatattatcctactgatttattgaataaataacatgtattaatagttaaatcttgctttttatatgtctcagagccctgaaccttacagatctcaaacttcatatagtatttgcaagtcaagaaaaatgaaaattgggcacattgtgaaaaatcctggaatgtattaccaacaaattgttcatttctggcacattaattatttcacaaattgttcgtcatgttcccatttcacttttataagcacagtaacactctcttttacagaatgttgccaacatttaatttcttaatgaatcaatgactctttcatacattataaataagaatataggttcaccttaccaagtggctaaacagcattctctaatatttgttggagcattagggaaaagctgatggcaaccagtatcagttttgcataaatagtatttttttcccttagaacgtaagattaaccttttttcttaaaagttagcagcaagatgttaaaacgtaatattattcataggaagtttaagtacagccatagtaaagaatttttcttttttattagattttattgaacgtttatttgctgttactgtggtcacgcaacctgttaccgtctcatcacaaacagcatttcatttagtatattgagaaaagtgctgtttcaggaagccacatgcagtgctactagatcagaatacattgagggtcaaaagtttatagggacccttgataaaaaaaataataaatgttctcactctatatagggggatctcatctgagggaatttagtttgtaacatgccaaataaactttgctataaaaatagtttccatttaaattgcttctaggattctaagagtaggattatagagacagctcagtgtaataatattaaaatacatacttttaagtatggcaattcatacttttaaagccctattgcctgcattatcttacatcatactgtgtgcacttgtcaagtgatcgagaaaagctgctgtatttgggttgctattttgaactgttgaattaaatataaagtccaagtaaatatatttgtaacagtaagtaaatcgtgataatgtgcaattcatcattttgtccatttttttttcatttatgacagtttttttatggtgtagggtcacactgaaagggttatttcattctagaagttgtagatgaagtacctttatttgttaggggtgctggccaagaaaccattaattggctttcttgcaagatacaataacttttctttagttgtttgatgagtctcaatctcgtgtagaattctcaaatcactgcccctggtatgatcttgtggcagatttgtatagattccggaagtcttagaaagtttctcttgctgttacgacattgctggtggtccccaaggcaattatgctcctttagtggtcatcccacttaattaaagggagaagtgttgctctagatagttttattatatctccttgtggttgctaaacgaagcataccagctcaacagtacttcctgcttttaattgaagtttcgttttctaagaatatttagtagttcattttcctttcaggtgtaacattctaaattcaaatgagttaggatcttcttttggtttgtttttgctttattgtttgttgttctctgcaattattccctttcttgaattgtttatggaaggactcactgccttcatatttttatttagcaaaaaatctcttgagtagaagaagttggattgcatgcccatgagaccacataccctgtttgggcttcattaagtccgttgtaaatacagatattagagataagtaatattggctaatatcaggctattttcttgtgatgttacaacctcataaaaagcctgcagaggcatcactgtgcctcattttgtgttcttgacgcacaatgtgtgtaatattttctcatatctcctttatttccaaatgtttgttgcatgtaaatctgatatttcccaaaccatattttaacctatttgaatataagaatggtgccttccccatcttttatatttcccaccataccaaattcattactaaataccaagtaaatattttaccaatatttagtaaataaatgatagaagataattttactatgtacgaagccaaagacagaaaaaaaatgagtgatttttctctttcacataataagagatgactggatcaaaatgatacactttagtaaggaagaatttggaggttcaaattatgtgtgtttcacaatatgggcacaccgaattagaaatacaggagtgcagtttctaacccctgttcaaatgaatgtatgaacttgagcagctcccttcctttgtcaggttatcaattaccttaaatatcaaatgatagtgtataatatatttctttgacctcttaagtctattttgcaagtaataaatcccttaactttgcatgcattattaaatttttaataaaatctacagcaatgaggttatgtagaatatagatctaatgagtgctctttagtactgagtagccaggggatcatatttgaaatagatgggatatacctagggaaatgaacagttatttcctgctcgtgattacaacagtggacataggtttctaatgagtctttcatgacagcattcttttattttcctctgcctttcattatttggtttatttatataaaagtaacagaattccactggggcataactggacttgaccaataaaggatgactctttgtgccttctatttgcctccacttaattgtcctgctcgtcatcccgctgaattatggaaaatgtcacatttccttggcctatgactcatataacaaatgaatgtgtgaatagtgtcaaaatacagcaatttgctctatgtaaagggaggtagacagcttttgaaaatggtaaggtatataactagatatttctaaactgaagaaaattctcatttgggcttagacgtgtgcatctatggtgcaattagttgttaaatcatttaattgagggctcacttgcctagtctgtatacttgcctcactgatagtgactcaggaagcaaatcaagtggacttaaaactaaaatatcaataccctatacaacaagagaagagacatgatttctttattaacattggagctgtgtgtgtgtgtgtgtgtgtgtgagagagagagagagagtgtgtttgtgtgtgtgtgttagtttgtttagcttccatccaagcactgatggtcctgcaaattaagtggattcagaatcttcatagttcctgaccgataatccccatcttcaaacatttttttgcaggaggaacttggaatcattgatcttactgtgtttctctaaaatataataatttgtgcataaataggaattttatgacatactctatgtcctctaatagttttgtgtaatttcattgccatttagtgatcaacaaaaggagtttgtaaactataaactagctttttcctggctcgcttatgagggaataggacagaactccttgggtttaattttcagaaatcctaaatatcaacattttttatacttgatagagttaaatataaaggaataaataagcaaaactaaggccaaccttgtgcattagcccttccactcacttcagatcaccagagcttggatgtttcatctgctaacaattcctctgaagcattctcaagcatgttttcttgccagcaaaagtaatataagtcctaggcaataatagcttgataaattcatagaagatagaagattcctatgaatataagcttgctgacattttacagtaatacaaataaaacctgttaacatagtaaataacaggtactttcgggggggtaaaattattttaatttgacctatgattacatgtcttgtctattctgctatgcccagagatcctttctgatgaagatcaacttttctaatactattttactgagtttggaatggaactatagattggataattaccatccgagggagtaaagcctctaactaccacaattactcacatttattcacatgacatgaaaataaaaataacaaatggtttggaagactgcactgtagggggcaaattaaacaaaggtgcgcacacgcacgcacacacacacacacacccctctgatattaacagaggaaaggaacttattcaatgatgtagctttccactattggcactttttgttttctgttttagagacatagctcacctgaatggcacaacttgtgtgggtactgtaaatatttcctagacatggcaatgcattatattttccatttcaaaatatacttatagacagctatgggaaagaattacagtggtagctacacacagccttgttttccttgtatacagagttagaaaatagagatataggggaatccactcctgataccaaatatagccaccataagcatgtacaggcataccttgtcttattatgctttgcagatattgcagtttttacaaatcaaagtttgtggcaaccctgcatcaagaaaatctatcagcgccattttttccaacagcatgtgctcactttatgtctccaggtaacatttggtaattcttgaagtatttcacattttttcattattgttgtatctgttatgggtgatcttgtgtaatcagtgatctttgatgttactcttataattgttttggggcaccacagatcatggccatataagatggcaaacttaattgataaatattgtgtgtgtgctgactgctctactgacaggccattcccccatctctctgtttctacttaggcctccccattccctgaaacacaatattgaaattaggccaactagtgactatacagtggcctctaagtgttcaagtgaaagtaagagttgcacttctcttactttaaatcaaaaactagaaatggttacacttagcaggaagggcatgtcaaaagctgaaataagccaaaaactaggcctcttgcaccagctaaccaagttgtaaatgcaaaggaaaagttattgaaggaaagtaaaagtgctacaccagtgaacacataaatgataagaaagaaatagccttacggctgatatggagaaaggtttaattgtctggatagaagatagaaccagccataccattcccttaagccaaaggctaatctagggcaaggctctaactctcttcaattctgtgaaggctgagagagatgaggaagctgcagaagaaaagttgcaagctagaggtggcttcatgatgcttaaggaaagccatctctgtaacataaaagtgcaaggtgaagcagcaagtgctgataacagaagctacagcaagttatccagaagatttagctaagatcattgatgaaggtggctacacaaaacaacagattttctttttttctgattttttttttttttttttttggtctcactctgttgcccaggctggagtgcagtggcataatattggctcgctgcaacctctgcctcccgggttcaagagattctcctgcctcagcctctgaagtagctgggattacaggtgcctgccaccacgccaggctaatttttttgtatttttagtagagacagggtttcaccatgttggccaggctggtctcaaactcctgactttaagtgatctgcctgcttcagcctcccaaactgctgggattacaggggtgagccaccacgctcggccatacagattttcaatgtagatgaagtagccttctattggaaggagatgccacccaggggtttcgtggctagagacaagtcaatatctggcttcaaagcttcaaaggagaggctgactctcatgttaggagctagtgtagctgcagccaatgctcatttaccattccaaaaatcctagggcacttaagaattatgactctacttctaatctataaatggaaaaacaaagcctggatgacagcaaatctgttttcagcatagtttattgcatattttaagcctacttttgagacttactgctggggggaaaaaaagattcttttcaaaatattactgcttgatgacaatgcacctagtcacctaagagttctaatggagatgtacaaagagattaaagttgttttcatggccactagcacaacatccattttgcagcccatggatcaaggagtaattttgattttcaagtcttcctatttaagaaatacttttcataaggccatagctgccatagatagtgattcttctgatggatccaggcaaagcaaattgaaaacctgaaaaggattcatcattctagatgttattaaggcattcatgattcataggtggaggtcaaaatattaacaggactttgaaagaagttgattccaatcctcctgatgactttgatgggtttagggcttcattagaaaaagtaactgcagatgtcatggaagcagctagagaactagaattaaaagtagggcctgaaaatgtgacagaattgctgcaatctcatgataaaactcatgacaaaatggatgaagagttgtttcttgtggatgagcaaagaatttcttaggatggatctattcttgaatggtgacgatgctatgaaaatttttgaaattacaacaaatgatgtagaatattccaaaaacttagttgataaatcatatacagggtttgagaggatataatccgattttgaaataagtttttccgtgggtaaagtcatatcatacagtatcacctgctacagagaaatctttcatgaaaggaagagtccattgatgcagcaaacttcattattgtcacagaaattgccagaatcatcctgaccttaaatagccaccatcctgatcaatcagcagcaattaacatccaggcaaaaccctcaagtaggactaaagatatgacttgccaaaggctcagatgatcattggcatattttaacaatgaaatatttttaaactaaggtatatgcactgaatgtttagacataatgctgttgcacactttatagaccataatatagtgtaagcctactttttaaatgcactgggaaagcaaaattcatgtgacacactttattgcaatattcactttattgagatactcactttattgcagtagtctggaactgaacctgtaatatctccaaggtatgcctgtatattctatcactcccaagctgtgtgctcttgggaaagttacctaatagaatccttaataaaaaatggagtatggggctgggtgtggtggctcgtgcctgtagccccagcagtttgggtggctgaggtggaaggatcacttgatcccatgagttcaagaccagcctcggcaacatagcgagaccctgtctctacaaaaagaaaaaaaaaattagcggggtgtggtggcatgtgcttgtagtcccaactactcaggaaactgaggtgggaggattgcttgagcccaggagattgaggctgcattgatctgtgatcatgtcacagcactgtagcctgggtgattgatagagtgagaccctgcctctaaaaataaaatggagcattatctattcatggggttatgtgagattatttgtgtgaattgttagtcatatatatttgccaaataaatgtttgcatcccatcaccgtggctgaatgagcatcggactaaggctaccttcttctatgcgccaaaagttttggatacatttcttgaggctcatgtagttgtagaatctaaaatctaattttagcttagaagtgcaacttgaggaaaagcaatcaggatttttgaacttttaatgaaacattttataaagaaaaacatctcttgtgagtgctttgttccctgtttaatttggttgagggtactttgttcagtagaggccaaaagcctataagttaaataagctgagactatcagtggaaaaagaaacactacattcattcaagttcatgttatataagtttgccatcatttcaaagcaaagattttacatggctcacctgtgtaacaataaaaaaatctacggttcagttgtaaatgtgcacaaatagggcatgatgataggctcacagttgtagcttcctctaacttggtcatggactcaagatcaatgtgaatgccatatatcagaaaggagcaaagagtgctttaaaactacaataagaaagattggcatgcgtgaatctaacggtttagttatccattttgagggataatttatttggaatgctactttatttctttattttattttattattattatactttaagttttagggaacatgtgcacaatgtgcaggttagttacatatgtatacatgtgccatgctggtatggtgcacccattaacttgtcatttagcattaggtatatctcccagtgctatccctccccactctccccaccccacaacagtccccagagtgtgatggggactccccacaccacaacagtccccagagtgtgatgttccccttcctgtgtccatgtgttctcattgttcaattcccacctatgagtgagaacatgcggtgtttggttttttgtccttgcgatagtttactgagaatgatgatttctaatttcatccatgtccctacaaaggacatgaactcatcatttcttatggctgcatagtattccatggtgtatatgtgccacattttcttaatccagtctatcattgttggacatttgggttggttccaagtctttgctattgtgaatagtgccgcaataaacgtacgtgtgcatgtgtctttatagcagcatgatttatagtcctttgggtatatacccagtaatgggatggctggatcaaatggtatttctagttctagatccctgaggaatcaccacactgacttccacaatggttgaactagtttacagtcccaccaatagtgtaaaagtgttcctatttctccacatcgtctccagcacctgttgtttcctgactttttaatgattgccattctaactggtgtgggatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgttttttttcttgtacatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtaatacctaggttttcttctagggttttcatggttttaggtctaacgtttatttcttaagctaccatcccacaattcatcactattcctgatggtctgttttacagaaattttctgtcagcacataactataatagatagtacataatatagtgaaatatgaaaatctctgtgaaaggatcaacgaaatttgaagagagagctagtttgaaatacgaatcatattctcaaccttttaaatttctgattgaatgatttatgggaaacattctgtagcaatgtgaattccttataaggaaatagtgactgtgtccataaggatgatgtactctataattcagataatataaccatttatgctttgtagcaggagttccccaacctctgtaccaattcatggcctgtcaggaacctggctgcacagcaggacctgagcgatgggggagcaaacattaccacctgagctccgcctcctgtcagatcagcagcagcattagattctcatagaagcctgaaccttattgtgagctgcacatgtggaggatctaggttgtgtattccttatgagaatcgaatgcctgatgatatgaggtgggatagtttcatcacgaaaccctcaccgcttccaccacccccatccgtggaaaaattttctcccatgaaatcagtccctggtgccaaatagcttggggaccactgttttatagggtccgtatttcatagattgaaagactgaggacacagttaaggcattatgaagtcaatgagacatagtggtgaagaaaagataaattcttaaagataaatctttactggacatttaagtgggttttccaagtccattaatcccattcatgttttaacatgtctttgaaccctgaatggcccctaaacttagcctgtaccttagttccaactcacccagttttcttagtgtgcctacaaggctaacagaccttgtaggcttggtggggccaggcatgaggtagctgtggattcactgtgctattacaagtctaaaatatggaagtgtttttcagctttttttccttatgtctttttctgctgactctaatctttagttgcttttccccctttggttttactgcagattgaaaatgtttccattcattcaaaacaactatttcttgtttaaagtaaaactgttagttaataataatgatgctttagcaactatcatttttctcgatgatttagcagaacactgaattactgcgaaatgcaaacagtgagagggtataacagcaacaaaaatatatcttggaagactcaggtctcatctcttaggtctccttccctaccaaagatgaacattccccaaaaagattcaaaatggctgtcaccacatggtggaatcatatgtgattcttacgtttatgcccgtatgcaagtttctaaattagttttattacctttgttaaagaaaaaaaaagcagaagaatggaccctttagacagtgtctaacttatctcaattttccactcccctttgtgtaggcattgatttaatttgtggcatcgtttttaagatgcatattagattatcagaattgcatcaatgtgaaaaaaggagtaaaattaagaataataaatcaaaatagaataaatatgaaaataatagtaaatagaatttgtaatattttatagatgttattcatacttattttataacatttatataataaatacaaaaattagcaaaagaatttttctttcacagaattattattgcatgtaatatacaatgtagagttaaaaatgtggcagatgaatattatgatttctcaagattttcataataaaattatgaatgtttcaaatgtcaaagatctagattccatttatcctttgccttgcagttgagtaaatcctatttcttcggctaggttaccaggactttaaagaaaaatatttttctaacaaatatttctgtttggagctttttacaacaaatgagctctgcgtttgcatcgtacaaagtctagcttgcttcattgggaagaaaatggcatgagaaacagtatccatagatttaacaagctcatgacaacataagttatcaagtagcaaactgatagaaacgtaaactgattacttgggaaagcggcaagagtttggggtgctcatcagagccataaccatgagaactgccaaatgtttgtccttaactattagtttaccttatactgtacacgactctttagttctcccttgattgcacctcctgtaaaggggagataaaactctttgggagcctttcctgtgtttgattatcattctctccaacaccactatcaattgcccttgacaattttgtcacaccctccagcattactcttgctataaatcttgataattttagtatccatatagatgattcttaagtgctctgccatctcagttccttgaacttttgtcctccaatgatcttgtccaccctatctcagccatccactctaatggaaaaccttagactgtcatcatcagtaacctctgccctctgccccatctccatttcaagcatcccactgtttgactgttaccttctacatttacagattattccttcttgttctcagacttcaaatttcttgaccccacagagagatagtatatttaccctaacaccttttctcagttcctcaacctccactccctctttcagcttgcttccatgtcttcacttctctctttcctcatcttaggtgatgcagacctcataataatcacactttcagatattgattcaattttctgtttctcccaccgtaattaatcaactggcaatactccagcccttgttcaatccacatctgtgctaattcagcatctatactagttctgctggaggaaaatacaaccatgctgattggttttgcttaaacttaatgaccatcagtgcagaccaataagtcttctactcaaatgagttactgactttactttgttctctcatctataatatggggataataatagaaaactatagtcatagagttgagggatttaagtgtattcccatatacaaagaacctgacaatagtgcctggtacctagtaagggctcaatttattctacttctccccctcctctctccctccttctccctctcctcttccaccttctcctttttagtagtactacattagaattcccctagttaaattacctttataccaacctaattaattattttgaactttatttctcctgaaatcctgaatgcctccctctccccctcctaaggctaaggcttttaattcgcagagaaaacagaaagtcagaacaaaatggcctcatacctccaccaccatatctactcacccacttctagctgtgacccatattctgtctttttctttgttactatggatccttttccttgttcttatataaggccagctcttacagtcatgcagtatattcaactccatatttcatactcaaatttctcagtctagaaattgttcttttctttctttctctctctctcatgtcttcgtatccctctccaccatatcaaccccatcagcatacaatcattactgttatttatcccatttgatttaggcaaataaaaagaaaaaggggtccttaaaaggttttttgcagttccaagtaatttcttgtctagcataaaatccctggctcttaaacccaaactgacagtctttaatatgcaaatccaagccaagaaaaactgggtccacccaacatggcaattcccaccgttgtccccttgcccttgcccccacatgtgcttggcagcatggctactcccacatatccccatgtgtgtaaaacatcatggctccctgcatttccatattaaaagactagggtggaagagtcagtttttccgcgggctacgtaaataacatgcctggtcaaaccaatcccctgagccctatgcaaatcaaacaccacctcctccagccatcgcatgtaactggctggtatcccctaaacacaaggtctcctctttcagcttcatttaaatgagaaaaaatattcctttattgcatatcccttaccagctaccattccatttaccagtttccctttacagcaaaatccctgaaagtattgtatatcattgtgtccacttcatctcttcccattctgtctatttaaacctattccaatcaggtttttacccctccccgcattattctacccaattactcttcctaaagtcaccagttacctccaccttcccaaatatggtgtcttgtcctcaatatctgcttccttgacctaaacagtggtggttgatgcagttcatcattccttcctcctgaaaacattttcttcacttggcttcaggacaccacactcgcttagcttttcttctacctcactgactgatccttctaagtctcctttattggttctttttcatcttcctaacctgtaaactttggtgggctccaggactcatccttgaacttggtcttttctctgtgcacactcaccctctttgtgtattactctcatgacttcaaacactgtctacatactggtgattccccaaattctccagcctggcattcttatttaaagttcaggcatatttccaactgcttccttgacttctccatgtagatgcctgattatcgtatttcggttaacaagtcccaaatagaaatattcatgtcacttccctaaatattatatgttcacagtcttctccatctcaataagcggcaaccccatccttccatttgcttaggtcaacatccttggagttttccttgccttctctctgtctctgacatgacacatcaatgcaccacaaatctttggctttctttcagaatatatgcactccagaactaaaccaactctcatcacttccacttctaccttctacatctaccctctcacacctgagttattgttatagtctcctcattagcatccctgcttccatccttatgcctccccactttgtgctccacagttatcctgttcatagtaagtcagataatgtgacaactcctctgttcagatttctccaatggattcttcaacgtccaaaatccttagtatggaatttaatgccctctgtgacatggcctaggggactatctttctgacctcatctccctaacccttactagctccttacttaccactcactgtgctccagtcatatcagttttcctgccgtttcttcacatcatgacaaacccacccctgctttagagcctttgcactggctgtttcttctgcttggactgctctttcccagattccccattgctcactccctcactaccttcaggtctctattcatatatgactttttcacagaggcttccctgactacttaatttaaaatagcattttgtcaccataatttcctatctcccattatctattatttatatatccattttatgcatccataatttatacagcacatttaaataaatcaagtcatgttaaatatgttaaatgtacatttattgaataaaatgcctatttgtatattgtttgtgtatgcacagtagagtataaattttttggcggtcaggatttttgttttgctcactgttttttgttgaatgaatcaatacgtacttgcttatttgtttattgtcttcctctactagaatgtcagctccttgagggcagggtctttattttgcttagtgatctttcccgagtacctggaacagagtctggaatatactaggtactcaataaatgttgcctacaatatttaattaattgattagttagttcagacattgaaagagcttccaagagtaatgtttaaactcaatcaatgtaatggataaatatccaagtactgtatgaggaaaagatattgataaacgttgcctgtatttataagattcataattttactcaactctttgatgaggaaatgttgacttgtccaaaagcaggtaaatataaatagaaaaaccggaggtttttcttgataagagtatccctctatatgaagcagagacgtaattcagcctaatttatattgaactcctatagtccaactattgattccttatcacttgctgacatttgttgctagggagcattgtgagtatttgaaatatacatttatttccactaagagttatgtaatcaattttaatatattttaaatatactttatgatgatgtagattaataatggaaatgatgatggcggtggtggtggtggcgatggtgatggtcatgtgtgtttgtcatagctaaagaacagcattgaaacttttccagtgcacacaacacacacaaaatccacttataactaaaaattaattatgaagtaggtcagtcttataaaggatttttaaggaaacataattacatgaattttctagattaactcaaactatgctaactcttgtcctcagatgacttgaattaatgaaatgatatataattagtgtttcagttgtttacatgtaaatataagttgagtattccagaaaagtttgttcgtaggcactttttcatctctagtttttattttatactgaaacaaaaagaaataaaacatcaccccaaactcactacacagatatttcagtgtctatcacctgtatgcctccctgtgtatatatacacatatatctacttgattgtatgtaaatgagataactttatatgacctgttctgtaacttgcttttttacgcacatcttgtgcatgtatttctatgtcaataaatgtacatccacattattgttttaaaagatgaataacattctgttgtatgtatgtaccataatctgctcatccagtcctctgctgatgcatttttttctttgttgctgttacaaaataatgttatggtaaacattcttatgcatgcatcatctttataatttgacttgcaagtatttttaaagtttctttctcagtgtcattattttgttctatacgtataaagggatctctaaacaaaatcaagtttcttccctattctgtttttaaattattgtaaatttcaaagtagcgaaattggaataaatgagattttactgtgtactttgcctggagccctctcttgaagtgtattcaaagggaattaaagggcttattaacggataggactatttgtgttaaagatgaagtctgttgaacattttcacctaaatataccaatctgatattcttgacgtttttttgttaaatttgatgctgacaataaaaactttggaataagctataatttctgcatccatgcatattcaggtctgaaaatgaaagaagagtgtgacaggtttgcatgtagaacttcccacccactcatttctttcctttctgcttctgacacttcagcctttgaaacagtttcccatgagcaatactgagattcagactatttagatctaaaggaaaaaatgcaagctcttctacagcttgtatctagcacctggaaacgtcttagaagaagtgctaaaatgtaaataatgctgttatttgttatgcacataggagaaatcctaaaggtattttagggaagagatggaatccagagatattaagaacaaggtgtgggggccaggggagaaggggagaggcagaaggatcctatccacattattaaagtgaaatatttccagtatactcttatcaactgacatgtagactgcatgccgctttcatgcaaaggtatcacatttcaaacttagcatttaaaagaagccagacaagaaaggaaaagagacagttatttgttgaaaaaagtctgggtttagcatcaggcacaggggttattggtagttgtctgaagtacactggagccttgtaacattgttttgtgccatgtattgccagcctgataccactggagtacatcctctgtctagttttccagaactcactacaataactgtaggatttttccatcctttatgaaattgcatcagtattgtgaagggccttaaaagccattcagttcaacaaccatctcccaaaagaaaagttcctcttctttttccatttattttatctcttcccaaagccatggggacctagatacatcaattatcctttgtcctgtaccttcactacctcctggactactaccttttttccactggcatacagatcatttcaagacttctcatcctaaaaagtccctcctaagtttctctttcagactgtctctttcctttgataggcaagagctttcttcattttctcgcctatttttaaattattcagcttcacctttgcttttattttctcatctaattcttaattattcagccctccgcattctatcttctgcccacattgccatccatgaactcctcctgctaatgtcgctagtgactgccaactaaaatccatttctcccttcagtccttaccttatttctcctttctacagcacttgaccaggttggtcaactttttcattgaaaccatctcttctgtgggctttcacaacactgctttttctctgttctacaccatcactatttttcttttaatttttacacttccctcgtcttttctgaaatgtttgatgtcctccccacccccagtttccagcctcagtagttgtcttgtattctgcttgtgttctctagattattaaatgtattcttgtggtttcagttaccatccatatgcagacacctttcatcttgagagccaggcttatatatacaaatggctgctgcacattaacctatcactaatggctctttaaactcaaaataaccaacaatggagtcattgtctctatctctgaaatagaacacactaccctcccccacttcttcccctttttaccctgtggcaacaaccttttgctatcctgattttaagcaggctgcagcatcataataaatgatacataatatctgcctttaaaatgcctgtagtggttaagagggagggctctgacattacatggatttgaaacacaattcaaatgcttataaggtttatgatttggggcaaaggaattattaatccatctgtcctttagtttcctcatctataaaatggaggtaatagtagtatagacctcatagggttcttaagaggattaaatggaatgataatacatgcacagcattttacagtgttaagttcattaagttaacaaatgcttcatattatttgccgttacagtccatataataacatgctgccttcaggccaatatatataagcctataattcttggaagactatggaaatcctatcatatattaaattgtcattttttttaagactaagaaaaatttatgtaaagtccaaaagtacagctgtttacaggggacgaactgatccacaaggccacagtctaccctcatcagttagtgtccatcactgaagtggaataactcaaaaggaaaaggtaactcaacgagccatccatttcccacatagattcacaacagaagacagaaaatatggagtggaatgttgaatcagctgctgttgggagaccctggtctgcactctatctgtattcttactgaagggagtgcagggcagggtttcccatacagagggcacagactaccaccgtatggcaaatgttgactggaactcaacttcaaagccatttcacctggaatcttaccccaccaccccaatgcttcatgaaaattcaactgatcctcttctatgaagaaactcaatcctgataagtctctttagtagttattgaaatgtctttgtaactctcttatagtcaggttcagtaagaatgttaagtttctaattgagcttttctttctgaacagttattttgtgtatgtttattttctgtttaccaatgtaatatatgttctttgcagaaaaattggaaaatacaaaaaggtatctacaaagtcccccaaccaagagaaaaccaatattaatgttctgttatagatccttgtagtggctagctggaattcgtgtatatctctctctctctgtctttgtctttctttctctctctctctctatatatatacatatattccaaatatacatttttatgtaatatatatgtatattatatatgtatacatatattccaaatatacatatatatcttcatgtaatatatacgtattttatatatatgtataaatacataatatacatatataacctaatatatgatatagcataatatatgtatacacatatatgtgtacatatataaaatacatatatattacataaagatatatatgtacatttggaataactatgcataccatgtttcaaacctgctgtttactcgttattatgactattcctctatatattaaaatattattcttaatctacattttagtggttgaatagtaataatctatttagtttgttctctgtttatttgtttttgtttttgggaacaaggaactgttcacacctaaatgtgtacaacctttatgtctagatcaggcacttgaattcttaaaaaagtgttaggaaatggaataatgatcttttatttataagttgtatatgtttctgtattctgttcatatatgataattgaaatagacctatatctaacactttaaaatttatagtattttcatctttatttcctcatttgatccctgctacaccttgtgagatagagaagggcttattattctgtccttatagataaggaaacttatgtccagaaagatgaagtggttttccaaaagacacgtagctaataaataattgacaacattggaatttggaattagaaagcaagtcttgtgactcctaaccaatactctttccagtacactttgccatgtcccaacttcactttctttaagtgcttctttctagcacctcttattcaattattgtcatacgtactttttggatcataccttaggagaatgtagctttctcatgaatttcctcattagctgacaactgaatatggctagattttaacaataaaaacacatttttttcttttcaggaatgcaaatacacagtgtattatatgtagaaaaaactctcagatattggatccttattgatgaggcttatgagataatatagcaactcagacttttctcaggaagaagaaaatccatgtcttttgttggacagtttagagagtctagactaccatcattcagcatttgaacattttgatttcaaaatgtagacaattgaagaaatacaatgtaaatgccagggaattaaatcataggacaaaaactccctatgaaaacatcttagtgatagcatacatgttaaaatttttgaaaacactgggaatggtttcacttctcatctgagtatctgagaaacagatgattatgtacctcccagccctgtgtcagccctaatttagttgatggcattattgctccctgctttcttttttttctctttatagcagattgctattcttttttactttaaaatagcaccttttgctgccctgtcttatccttgtgctcttttaaaaagtggtcaggcacacacttttgtcactagttttacatgagggtaggggctttctcttttcttttcaaaaattaagtgccactacatctcagttaaactgccttcatctgacaagcacttacagaatactgaaatataatctactgcaaaaaatctacatgtttttcataaatacgaatgaaatgcttttaatattatccctgtgttcagagttaatgcttaggcattaactaaagtacgctagacgcttttgatatatttccaaaggcccagccagaaagatatattgcagatacacatattctaagtgtttacaaaatcttccaaaattattttgcctgtgtctgcttaaaaggcacaggaaacagctcccctactatctcctctatccagtcaggaacacttgcagtaaggacactggttgttcagtgcacaaggattaaagtaacttaattacacagtcaaatcaataataaattgagatcattagagccttggctcgagctgaaccccaggtagccgtggaatccctatgatacttgaagaagaattgacacagattctaaggcctcacaggttcaaggagaagcagacagcctcactttgttccttcaaattagttttgagtggaggaatcttaggtttaagtgagacctggatcttgttttggggtgatctctggaaactgggatataatctactctccagggtagaagactatgaagggactaaaggagcaaactctaggtcactgagaacccctttcctacaaacaaagatcttggttgtgttccctcacttccagagagctcattggaccgagcatacccttgagtattaaggtcagtgcatactgagtttaaaaacaacataggtataaaattgaatggagcagtggtgaggaaggtggaaaaggatgagaagggaacttcctttggacttctttgagccaaaataagtagtatgtttcctaaattcttgtaatcagaccattgttggctattggtagagggaggttcagattttccatctctatcttttttcttctgtttcttggtccttctgccactgcttcttttaaaaagaaataaactcatttttttctcagccttatgtgggaaaccctcttggcattttctaactgccaagtgttctataactagccatctgtggaatatttttttgttaagttaattttttaaattaattcatttcccttttctctctctctctctctctctcacacatgcaaactagtgtttgaagatcaatgagcaaatgatctttcttgtaacaacttccctttttcagctgatcgcttttctgaattttatctcctaaaatcacttaaataatttcactgaaacaaaggaatgattggtcttttaaagactcgtacatgtattgaatataacatttccgacctgactaataatttgaagtaactttgagcttttcgagggccctagccaaaacaaaatgttagatggcctttaacatttatgtcttcaagggactgtgctagccaaagtttcctcccaatctggaggcagctttgtgccatagcaattttcaggcttcattgcatcaatcaaacaaattgttcttgtagtgcttacttactggggaattcaccagctggaagattgtaccattgagccaaaacaggccactggaacagccatactctttacttcatttatggagccatttaagaagatgctgtagtggcagctgcctgtttgtcagaacagccttggaggtgtgctgaatgaaacctaatttagactagtagatgatcagatgacaaagaataccagagatacaggtgaatcacaaaagaagatgctgtgagactttctgtaaggaattccccaccatgactttagaaaaactaaagtttcagctgcagttatgttgagtgaagtgtaaagccttgaaaacatagactaaaatggtccccctcctctctctcttatcatataaacacaccccaaccctataatttttctgatacaaattgtatttggattttgcatagatggccagtttacttttaaataagaattatatgcctgtttatttgaatgtctgttcctaagattatccacaaccacaactccatttattatatgtttacataatgttgggtgagggagagtagtcaatgatgattcatttgggactagatacagaattaaaatataaaacaaatattatcattctcaaggttttaatagatggctgaacacaaggtatgagtttagaaattgtcatcctggattatggtgtggattttatgtgcaccttttcatgatgggcatcagctgctttgtatattttgttcccaaatcttgttagtcaactttcaactatctgtgtatataaataatcaaggtgatgttaactgctttatggattttcttgagcaatttaacacaagattgattagtgatttctgtctgtagaaaatgtttgattccaggctggcttagcctcaccacacttctgactgcctcctccctatctgaggaggctcagaaaatacacaatcatttcaatattcacctaagcaaaataaaataggaagataaatttctgccctgaatactgtgatgcgtaatattaatacaaaactccaagagaaatacatttgaggtaattttttttttaacttggataacttaactgtgagtagaggcctgtgattccacaacttcactaatgtggaattttttctttctttccattagtccagactctagactttgagggtggagggggaactagtcttgttcaagctggagttccttattaatgagagatagtttagaaatcctgaataaggctttggaccagacaataaaaaaggaaatgtgaaagctcagagccttctagaacaaagaaacaccccaaatcttatgcctgtcagctggatggtgacagtacccagtagctctgcagtaggcaccagagcatctgaagtacaactggtggacctcgagagaatgggagctagctgaaaaccattctctccttcttaatgattatccattagcacaccatgtttttattgcagaatagattagaaacaattagcaaatggaaaattgaagaggcccttgctgcttttagtgtttagatgtaacttttgaacagaatcaaaatgctctttttggagtcagatttgccattttacctgaattccattttatgcgtctgccatgggttacatgcttcattccatttaaaaacggaaattttctggatgtagattcagtatgtcttgctgattgctgcatttatttcagatgctctttagaaagcattgtttagtaagctaactttttcatgctgagcattaaagtgatggttgaagcatattccaaagtcatcttttaactcacaagaatatggaaccatattgacttctaccaagacagtttaatcattcattgttaacaaagaacattatcatttttattgtacttgtcattacctattactgtactcttgtctgaaaaggcactatggtataagaaaaaataatgaaattaaacgaacaatggatctgattttgtcaatgctcaggaagtgaatcactcaatgccagtcctatagaattcagggaaacatcattagggcttcaggaatttcgactttactaatgtggattttgttatatttctcacatagacttggatgaagctttatgtgaatgcaaattttctcatttcttatattgatgcattgtttatttgcatttttattgtaactcctccaaagagaagaaaatcttggttaatatgcagattagaatttttattgaggattgtgttttattgttcttaaagactaaggtggtaaagaaggttagaaccccctgatgaaatctgcatcacattcaaagaaatagtacttagtgagattttgtcatgaacactttcacagcttgattctatttctcattatatcccaattatcaaacgaaataaaacaaagccattcctatagaatgaaacacatgaaaatggcaaactgcctgtaaaaatgaacaaggaaatactgatcttcaactattcctatacccttatttctaacctaatgtaccaactctccttctctcattttcttttaccaaagtactctgaggcagagaaattaaatttctatctaatactattggtgaaaacagaagactatatgagaaacagagaaaatctccaaacaatcatggtgtctcctggacttcctaatatggaagtcatctaatatgattaagtaatgcagcactagtaacatcaccagagttcacagtgaaatgttttcattcatccccactggaactccaaagcaccaagtggacttagcatcagaacttaagaaactgaagccttcgttagccgtaagtctttgcaaagaaatggaatcacagttttgatttatgtaagaggcacaaagcaaaccattactctgtatccacaaatgtcaattgtagaggagcaccaggtatctgagaggaagatctttgagggatatgctgcttcttatacccttttccaagctcttatttgtttagagtacaacaaaaggaaaggctgagtaagagaactgtgatagggtttgggagaaggaaggaaaattccatggacatatactagccaagtaacttacgtagtttgggtcacttgttatctgttaactacccctaactcctctagtgaatgaggagtagtggtagtagatttctgaaaagacaacacagtgtttattacctaaaggagcagacttcctcaaatgtgtttctgttggacctttggattgtataacatactgtttggggacagaaatgaaacttcctagttatatttttcttagatgtatactatagtgggtgtgtattatctgtgtaattcccccaactgtaatatatttcaaatcactttattctaaaaatgaagtacatcttacatagagcaacattcaaataaaatatttgccatagaaaatagagggtacaacgatggttactagaggttggaaagggtgaggcagggagtggggatggttaatgggtacaaaaatatagttagataggataagatctagtgtttcatattcacagggtgactactgtcaccaataatttattgtacattttaaaataactaaaagagtataactggattgtaacacaaagaaagggtaagtgcttgaggtgatggataccccatttactctgatgtgattattacacacagtatacctgtatcaaaatatctcatgtactccataaatatatacacctgctatgtacccacaaacaaatttttaaattcaaatttaaaaaattaaatgtgtgtcatgagaatttctaagaagggcactccaaatcattggtttgccttgctagacaaagtgtaaattattttaacacaatatacagctgggtaaaaggaaaaaaagactgtgacttgtttgccacccacagggctgtcaggaaaggctacaacatttcacttctcaaggagtaagttccttttacagattaaattggaaatacagttacattttatttcatctcaccaatgttgaattaataacctatgtgaaacctttatttagaaatgaacacttcaagcatgcgttaaattagcaactaagtacatagcttataagaccatgaagaatggttatgtttataatgttcatttttaaaaaaaaatattatactttaagttctgggatacatgtgcagaagtgcaggcttgttacatagttatacatgtgccatggtggtttgttgcacccatcaactcatcatctaggttttaagccccacatgcattagctatttgtcctaaagctctccctccccttgccccccacctgccaacaggccccagtgtgtgatgttcccctgcctgtgtccatgtgttctcattgttcaactcccacttatgaatgaaaacttgtggtgtttggttttctgttcctgtgttagtttgctgcgaatgatggttttcagcttcatctgtgtccctgcaaaggacatgaacgcattcttttttatggctgcatagtattccatggtgtgtatgtgccacattttcttcatccagtctatcattgatgggcatttgggttggttccaagtctttgctattgtgaatagtgccacagtaaacatacatgtgcatgtgtctttatagtagaatgatttataatcctttggttatatacccagtaatgggattggtgggtcaaatggtatttctggttctagatcctcgaggaatggccacactgtcttccacaatggttgaactaatttacacacccaccaacagtgtgaaagcattcctatttctccacatcctctccagcacctgttgtttcctgaatttttaatgatcgccattctaactggcgtgagatggtatctcattgtggttttgatttgcacctaatgttcatttttatacttaattattttagaggcaggttgttgctatgttgtccagactggactccagctcctgggctcaactgatcgccctgcttcagcctcttgagtagctgggactataggcatgcaccactgcacctagccttacttaattaaaaaatatctttctagaacatttttagctcattgcttcagaaggtattaatgtgatggttcagatctgtcattcattttttcaagtcattactcgtgtccttcacatttcagaaggattagagagataagaagatcaactttcaagattatgtaagattgatagaaaaagcaagccagtatttccaccatcagcttgagataagattccatattttgacttatacaggtgatagaggcgaatgtttttcaatttgaggtatttgtcagaataggcaagagatgaggacttacactttaaaaaattcttctttaaagacaagtttgagaataaaatcaagctatgattatgtagcctagtagaaataatatttatcatcccttaacttgtaaatgagaaaggtcagtatcattctttctgttgtataaattttgaagctcaaggctcagagcatttgccagactttagtaagggtcatctttaaaccagtgaccgatccagagattcctctccattagaattcctggatgtaaaagaatgtaactggtcttgaccttaagctactcccgacactcgaatgttcaaatgtctttcagacaaactgaaaagttattttccgtactattatataagaatgattattcttttgcattcatagattgaatttaaatttgtcataattgtaacttttgacttatatacctagcctaaataaataaaaatgtttactttaaaaagtccaattagaatcattggcttaactagttgctttcatttaagtattcatacaaaagaaaagaggttttaaggattagtttctttcatgtgctaggcagtctagctgatagctgttgtagtgaaggcaatttctgttagtaattgctggttgtatttgcttacacctttatttaaaggaaacttgtctgttttgacagtctcacattttttgctcattctgaaaattacttgggaaaattacttgagtgcagaaaagttattttctttgtattgtagaaaaacatccttccctcctgaacacaaatattgtagtcctggtgaaagctaactgctcaacttcacttgttggctttgtttcagtaaggttctgccattacaatggaagcttatttcatagtttccactttcacgactgatcctcaataaaagaaaacaaccagttaagcataataaatatttgatttagtaacttgaacatagtcactttaaaaatcagaagcgactctataaggcaagacctttattagaattctctgctgtcctatgcagtaatggaggaagaaacataattatcaaagatctacatcaatgacatatttcagattgtgatttctgacatcagtgtagtaatcatactgggaattggttgtttttatttctagcaggcagaatctgaattttggttttggattaccagaataattgcttctcggccttttggctaagatcaagtgtggattaccagaataatccttcatagagcccagtagtcagtaaaagatttggtttccttaagtatatagtcaaagccattaagtggaaaattgagataataaaagtaggcaatgtagttccgtcatcacatgcaatatgattgtataatattgtgtcaaaatttcaaaatagtttcaaatagtttatgcatacccatgtggcttgaggcaaaagctcctaatattggctctttagggctaacggcaaatgcccatatttaaatgcttgtgtctataggaagtcagtaattgctaaaggtaattctgtttgcagttctaataagataagtgaataacatggtgattaatgttattttaataatagatggagtcatataaacacctaattcttaagttagtgggttgtgtttgttcatgacaaatgggaccccggaggatcaaaattaaagattcaactaaatattttcattcatttccaagaacctagtacattaccctgcccataggcaatcaataaatatatgccaattaattggctttttttttctaaaattgatttccaataattcctaaagaacaaggtcaaggagaataatatgtaggagtcattttaccaataattgataattgagctcagagtgcacaggggtgatctatgaaacgccatcatgatttctgaaaagctttagcaagggttattaaatataacagattatttcattcagtactatcagtctgattgaaaagttaggccttaatgatgtccatagctggtattttgttcctttctatgtgtagcatttccctggttaagatgcctcacaatgttctcaaattagtatctttcagccttctttgttttttggacattgtgtctgttttttgaggaggagtctgcctgccatttgtttcacactttagtagtacctacctataagattgaaaaggaggttgtgccccctacttttctgacactttaacccaccagcattaagctaataacctactggcgtctgccagaagatttgttagtgttaaacccatatgcttctagtgtttggcaatgtgaaatattataccaagtcttatcattcaccggttatcatgaacccctcaaggtgctatggtctcctcctccaataagctcagttgaactccttgccaaccaagagatactgtgacaggattgttcttatttgctgttgctatcagctttgaggagccactgcagcctggagaaagccttagaaaatttcccaaggcaactctgctattcccccctaacacctacgggatttacatacgctatgccattgtattccctatgataatatatgtaaagtcctgtacacattactgacatgctatacgtgttgaataaatgtcagctatttctattattaaatatccattattatgactgagcctctctagtggcccttaggctaaaatgactgttatacctcagtctaggatgctcttactaaacagcagctccttctctgattaaagcaccatgtgttctcaaagttcctatagtgcactatgattactcctactttggtactcatcttgccaaacaatacttgcaacatttatccttcctgtttctctaaccagactgtaaattctgaaaaagcaggaaatagctgtgacttgttcactgtagtatccctagggctttagcatagtgtctacacttttcatgcatgtagtaggtgttcagtaagtgtttattgaattaatgaatgaatgaaaagtatcctagtatcacaggttctgaattattcctacagagaagtccccaaagaagctatgtattctccagttaccctctgaaaccatagggtaagcataatcaacatattttctatgaatagatgcaaagcgttaatattagcaattatgctccaaatactaatctcaggatggatgtaacataataataacactttaatattaattaaaattattttattgcataatattattttaccatcattattcagtatcattactgattggctaaaatctgcttagagtagcagcttcgaaaaggcatttcacctctcaagtaactgtcacccacattcatcaaccctggtagcccctccttagcacatcttaaccctctctcactttttactttgtctacctgttatcaatagtctcaccaaattatatacacaatctaaacttctcttgtttttctttaaccaattagcaagattctgaataaatgtatttttgacctttttatatttactccttctaccatcgtcaagatagcttcctacattatatatttctatcccttcatccatccaaacatttattcactcaacaataatccacagattgtctgatacttgccaaaaacttcctctgccttatctgagcttatcgttaaatgggagaaacagatattgaacagacattgaattaaaagccagtggatactcagggtttccttctttctatgatacggccactcccaaatgaagactaccaggcacagattactgttgcagagcaacagtttgacaatattttagataagggtattaacaaaacaacaagaaaaacctaggaactactatgtagacaagaagaaggtacactagaatgaaatgcatttttaggtggtcactatcaaaatttaagctcttggaattcatttcctggcaatgggaggagcagcctcactcctcaaaagctatggaagagcagaggagtggaaaagcacttgcagagaaatctcctggggatttcttagccagatatttagaaatagggtttaaattcttcaagttggaggattctaacctatgctctaaggatgactgatgaagtacagaaagaaaagcaaagtttaccaaaaaaaatgaggtcacagaatttcattacctgccatcaccccgctatttatgtatgtatgtatgtatgtatgtatgtatgtatttttgagccggagtttcactctgtcacccaggctggagtgcagtggtgcaatcccagctcattgcaacctccgcctcccgggttcaagcgattttcctgcctcagcctcccaagtagctgggattacaggtgagtgccaccacgcccagatgatttctgtatttttagtagagacggggttttactatgttaaccaggctggtcttgaactcctgacctcaagcgatccgcccacctcagcctcccaaagtgttgggattactggcatgagccaccatgcccagcccatcaccccattttgaaaaccaaaagcctaaatcactcaccttgaagcagatttgatgctgactatagacactaattgattgttagtcctgttttggtttatacataggggcagccattactatgctattttattcaggcacgaagtaattgttttatatgaatgcaaacattctaaaatactgccattcattcctcaatttataaacttcttctttaggaaattgtattccttattataggctgggtgaccctttacaaatcttaacttattttatcctcctaacaactttatggagaatgtactatattttccccattttaaagatgaggaaactgaggcatggaggtaacattacttgcccaaagttactaagttagacccgactgggttctaattattgttctgcaacttactgacttaaaaactcaaccagtatgcaaattcaaagcttccttaatacagaatgtaaagtgaagaacaagagtgtacagcacaccaatctgggacgctatttgccattagttcagatttttttaaaggcatgtaatcaccccttatacatttttccttttcccagtgtgccaaaatcagcaagccaagacagttgattgcagtgggcatgtcttaaaaaccagtttccatgaaaggagcgactaaagggcctattgtgcttgttgccttacttttattttgagtccagtatctagtctgttagtttatatacagaagagactatcttgcagggaattcagctaaccctctgcactgctcttaggtcagggccctgaacctttgctcctggctaagccatcccaggtatttgattagatacgttacttctgagttcacttattagcaaggcacactatgatggagtcctgatgtacctacttgccagtgagtagaataaagatacattttgtgtttattgctgttgataaaacacttgtgtaaagtgtaatttataatttaatcacttttaattcaatttttaattaaaaatttaactttttaattttaataattaattactaataattaacttaatcattctttttttctttctccttcactatgcttcctttgaaatcatttccttctctaaacaacattggaagcgtggcactgaagtgatagatttttgtatcccattgtacttaattagcaagttgtggcatgtatttggttaatatttctctttctaaaaagattattatctttgttttggtaaattgaagagaaattgtggtccatggcaaaaagaatgaaccatgaacccatctgtacggtatgtgctcagcctgagatgcccatattctacaaagagcaatttaagcatgagtgatatcaggtgttaagcccccatgaaacatcagagataaatactaggtccctggctaacctgctttcgatgttttactgttcaatctgtaatctgcagtgtattttaattaaatcatcaaaattacagaattttctttggaaagatgtattcttcatttgttgtttggttcaatacaaggagttggcatttctgatatgttgagaagatttcactttcacatattactaggataagtccttgaaatttactagccatcaggatttgctgcttttaatgattaattacctgttggcacacttttcaaaggtattctctttagctgtttcctttcatcttgccctaccttttttgtgaatagcctttcatgtttagctcaaaagagtattcataaaggtttatttcgtttctttgggtagagatgctgatttataattttaatgcagttcgtaacagcagtgaaaattaaagtcctgagaactgtacctcagtagggtcctaaatattttatgacaggtctaattgtttaataattatgcaaagaccttaaaaatttggaataatttgtcccttcactgtaccaggctaccaggattcatctatcccttaatttagtaaatttttatgtcaggaatagagtaccatgtactgttccaaacactggagtacagcaatgagcaaaacataatccttgcccacagggagctcatattatagagagggtagacagactttaaacaaataaagatatagttttctttggagaataaacaagaagggttagaggggtagagagtgcggagagataagggtttctctttcatataggatggtcaggggaagcctctctgttgaggtggtatttgaaggatgagaggggaaggttcaggcggatatctggaggaaaattattcaaggcagaggtgtaagccagttcaaagagtcagaggtggggatatgcttagcatattaaagggacaagcttggaagccagtgtgacatataaaatgaaaaaagaggacaaatgatacataagatcaaagacgtagtagtggtcagatcacagatgatctcataggccaagtcagggactttgtctttgactctgagtgaaatgaaaagctattgggaggtgtagagtagaagaatgacatgatctgctttatattgtaaattaatgttatactacatgtatagtttacatgtatagtggccaactaacagagtgaattagggaatgctatcaaggagtccacaattttccctccaccccatgtggcctcactggctttgctttgttccacagacaaagaatgaacctcagattttaacaaaacattgtggacatttgctctgtaggtcagaatggaattggcaagaaagtataattagctcagcccatcccatctacactgcacaaagaaaataatgagtacactcatttaactcagctatcagcagtgcagcaaaaacaactcccactgaagtgagtcaggagcatcttcataaaccaaggcaagcatattacaccctaaatgatggctcagtggcctcaaggaaataaagtatcttcctaagcacctaatttactaccaggctgtgactcaggctcaggaaaaatcgaatctattattatatattcagaatacagtgagcaactgtggctaaatattgagaatacttaaaagaatggagagttaatattgctaagaaaacaaatgtgtagtctgaaattattttcactgcttatgtgtatgtctgtcttcctgtcactgctgtttacacacccatctctttgcttttttgttggagttgtacacataatttgatgtgcttgcacagagttaaacatccctattctaatggcttcatacctgctaaatttgtctactcctatttccttcaaatgctagaaaattagtgaagtccctggcaactaagtatagtctgcagagcttaccccaaagctatgagatttgaaactctgttagtgtttactcagagtcttcatactatcttttactctggtcacttggcttatggttcccctgttccttcctcctccctatggttttcagcaaatatccagcttctgtaaacattccttcagtagatctgaattgcatagagtataacttcagtgacaccaaagtgtgttttgtagcatgttgtttctgatgattgaagcaatcttcctgtgcagaaaggtgatttaaaaatggagccgccttatacaaaattacagctagataagaggaatgaattctggtgttgtgcagcagtaaagggtgaatatggttaactataatttattatatagtttcaaaaagctagaagagaggatttttgaatggtcacaacacaaagaaatgatgaatgtttaaggtgatggatatgctaattatcctgatatgatcattacaccttgtatacatgtatcgaaacatcactcttatcccattaatatgtacagttattatgtgtaaactaaaaagagaaagaaaaaattgaatcttaatatcttatattggcatagaatgtagtgtattgtttatagttcactatgattaattgactcatatttggctagtcataacatgtacgacttgtatgttcttgtaggaacatgtacgacttgtatgttcttgtaggtactgtcatgatggcaacttgggtcattctgaagtgtgattctgaaagatctggttttaggtttcaacaaaagttatttaaattttaatctgttccttgctctaggataatcacatttttttttagagattggtaagcaattagctgctgccgcttctaatgataatagaatacttaactataacatgaatttaccaaatgaatccttttggaatggaataaatgctcaagcaggttattctagtaggaagagattcatgcaaagtagagttatatcttgtttggccagtgtagactatagaactcagttttggtctgttgtcttcttgctgtaagaatacactttaggatacttcatgagttcaggctgagacctgggaagtgctctttggacaactgtctagagaaggcacatgctattccaaaagtgctaagcaccatggttgtcagaatctagtttaggaaaactagtgcacgtgataggcacttaagaattctttgttgaattgaatgagtaaactcttcattaaatggcatatagaaaaaatggtcttcataagtcagccagaggtgataccacacattctgctaaacaacaaacattatgtgaagatgttgttcagaggagttctgactgtctagggaaatcatgcattgtgattctttacacaaaccactttctttctggaaccagaacttatacctgctttacctagagaacagaatagaatagctaggctcatctgaaaatgttttagttgatataaaccagcacacataattgaatgtcttcttttctgaacaactgacatttgagagtcagtcaaagaacaagtctatgtctcctttccccagtagtgagcttcaaagcagagcaaatggatccatgacagggccgaggagggaagaatcagatgtggagtgcatgcaaccctacccccagagacataacttgggcaggagaggaaaagaatgtatatctggtacaccctgtctcccttacagttatcacctttccatcaactgactgtgtttattttagttggaagtcagcatttaaccagttctgcctgaagcttagtgagggagtttgattctgagaactgtgttctcactgaagggcaatattctctttctcttggggaaggagtgttgtttgtatcctcctgatgttgagggatatagtagccatcatcatgtaatgacataccaaatgtattttatctgagagtttaaaaattagaagcaatccaattgctgatgtgattcatgaataaatgatgcaacttataatgacttggtgataacaatttattgtataccaatcacgtgcactcagaagaacctgtgcatgaaatcaatgtgagcgctaagactaaatgcaaatatattgtggacatttaaagttttagcccccttgattatctttaaggtaatatatacaacatatttgccaatatagatttttcttcaccagccatctggtaaaaattagtatgagataaataatttagcttccttctgttcagatacaacttcattatcctcttccttgatgctgtgaaaagtcttcagaaataatcaatggtaaagtgcatttgcattcctgtcaaagctgagcctggaggtttctgacatgctgacgtttgattctttttctctgtgcgctgtgaaaaggagaggtgcctattatcaactggccccaaagaattgcgtgcatagtggcagccttgcacaagtgcactgcctgctaaatcacagtgtgaggaagcatgacatgacacaactgggatgttcgagaactgcaagtcatttttcaggatttaaaaaaaataatactgcagaacataagaaagagatttaggaggaattagttacatactccttgtgacctaatgattctctctctacccacagagactatcttacccttgaagcacagtaattggtttgtaggagatatttttccattcataagaaaaaaatatctcctacttttcatcctggacttatttctccaatctggcttgagttgaggaatcttatgctagagttgtaggagagcaggtgccagattgtggagggccttgaacgcccggccagggagtttagattttatcctgtaggcagcagagagccattaaaagattttgagcaggaggaatgtaaaaaataggacttgatttggatgcacgcttagtataaaagtgcaatgataagatatattaagggagtgttacggttctgttcacagcatgaatataactgtaggattcatctctactagctgactagttcagtttttatagcatgcaaattttcagagccagctgtaagaggttgatggtaaaagaacaaagtacgaattgatcatgtgaatgtaattgtaaggagggatttttaaatgatcaagatcactggtaacacagaatagtaatcattttaaagggtgactgtagaattatttgttattttgtttgagttatctgaaaccacttctatgctatataattaccttaagttttaagtgctccctgcagggataatttatgcattttgcattctcatgcaaatactttaacagtctacattgttgaaaatagaactgaacattatttcagataggtaatggttgtacaaagcttatgaagtattcatcatttttatatattctcatggtttatattatattactgtgttgtgttttcagctacagtgatacttaggtaacaaatatttgaaaatttaaattgcatgttttgataaagaactgtaatttgccaatttcaaaatttaatgtcatcaaaatccttttaaaatattaatataaaatgttgcagtatttcaggaaatacaaggcaagccaaatttaatttaagctactaggggctcagttatgaattgtagctagatacgtggccaaacactcccgtaaagcattgcatttttaggattcaggcttcaccgcagtggtttctgtagagccataatataagatgataatcataaacagcatcacaggcgatggcagtttagtcgtaaataggaaaccgttgtcttgttcactgcaacatagctacacatgtaagcattatatatcccttgtgaaaatgtgattcactttatgatggtgacattcatatttcaaagtgtcttgttttaatgagctttcacaggatttctttgcaccaatcttgaacttctcaagagtcctggatttccttttttttttttttttttttccccagagatggatgtgcattaagcataggaaaacctccaggaagaaatatgtttactcctctgtttggctcctctatagacactaactttacagaagaactttacttaccttgggcagcctatcggatttcaccctgagctctgagcacagctgggagtttggacagtaaagagatgtcttctccagcaaaggggagacaacttactttccagccttccccgttaaacattcacgggtgagggtggtggatatttctcaaagtccacaggtttatagaattggggaaagcaaatggcccatttttttaactttctgtgttttcactctctgttgtctttctccgctttgtatttctgtgtttcgctctgtctctctcatgtatgtatgcatgtgagtgcacacatacacacacacgaatctgactaaataatttatatatctccttatatgtgttacctgcgtctgtacctgaaaaggcagaagcctaatttcagtaaaggtgctctagggtcatttcctgaatacctctagagtagagttcactggaaataaaaaacccaacatgtgcccaaactcagttgtgagtatttttgcagtagaagagtgaacttttcatgccatgatctaggagaatgttaagtggacagatttatataagataaatggaatgctgctgcccgttgtaatggaaaaagaagcggcctaggggataggctgcctggcttggcttctgctctgtgtcagacctcttcctaccctctggaactcaggatcagttggagctcctggatcttcagtgtcttgcagccccagaaatatcacatgccagtaccagctaccgtaaacagattccagcttcctctagaaggagctgcttccctgcactggattagttctccagcagaaagtgttaatgccaggttccagtgtattagcatctcttgtttcatttctttgactctaaaacaagctctttagagatttttttaaaagtctaccaaaacccattataatcattacttttgttatcattacttttgttaaactgtcccttacctgtcacttgaatgccataactattcaagcagttgtagaaaactttaaatgtaggcactgcttaaacataaaatactgttatatttttcattattgttattagtaatctacattatgaaagtagaactagtaaaacagtggtttggaacaaaagaagtgagataataacattgtagttttgtagcatagtaattaaagtgagatgtgtaaatgtcatctggcctattaatatggaattatttcacaaatccctttattatcatgtggtctcactgatacacattatagtaattctagtattagattcttagaatattttaagcgctaaatcaaaggctcatgcattgtcatccttgaaaaggaatcactactgtaagcatttctcacacatacaattaatgtgtagcattagcccctcacagaaatggaaaggtgcttttcttctctgtttttattgaccaccaccagtttttataccaatttcaagttgcggggtggggagaatactacattttcttatatatcacacaaatggaaagttaaaggaagggaagagatctggtagttgtcgagcatttccacttaagctaactgcttccccatgccttctgtgatcttccgtatgaagcacatgatgctgtccccatcttgcagatgcaggatcagaaaacacacgaattgcctacagtcagaaaacttggaagtggaagaggcaactttgagctgagctcttcaaaagggccagggcacacaaataggagggagggctgagccttcagcaaacgttgaagttgcgcatttagaagggagttggcattacagctgttgtctacccagtgactactctgtgggtgaaaaggtgcacttgcaattgagtttattttaaaaatgacttgttaagggcaccattgctgtgattttctcacctgtgaggtgggaggaactctcctctcaggccagagggaagtaattactgagaggtgccttcaagagtaaagcagattgttatatatttcaaagggggctgtcacagtgcctgggacacagtaggctttcattaaatcctagattagaattaattcttctatttgggtctcaaatgaataaattggctccctccattcagattcgtgacaaatgactgccactagcatcctctcatgtagctcctttcaaggggctgatgagtagaaatgcattcttcataaaaaaggttcctctctttagcacttgttatcctcagcagtcatttgcagatgtaatgtgatgcagcagtttaatagtcctctgcagcaccattctcatccattcaaatccttggtttatagatgaggcctttgcaccttgccctgtgacaccagcttttatgttttgcagcagaaagaatgctatagtgacttccatttgagcagttgctgttggctagcattactttcctacttgttcaagaaagtctcctttcaaagtttttgaagaagcagactcctaattactgtgacacttttcttcagagacaaaccctaccaaatgtaacagagctgctatccaatgtgtgtcaaaagtgtgattctcaaagattcctggccaggtgcggtggctcacacctgtaatcccagcactttgcgaggccaaggcaggtggatcacctgaggtcaggagttcgggaccagcctggccaacatggtaaaaccccgtctctactaaaaaaatacaaaaattagccaggtgtggtggcccttgcctgtaatcccagctacttggaaggctgaggcaggagaatcccttgaacccgggaggtggaggttgcagggagccaagatcatgccattgtactccagcctgggcaacagaacgagactccatctcaaaaaagaaaagaaaaaaaaaatcctgaggtacaagaatataatatgcacccaccttggtatcattttatttttaataggccttgccagagcttttcaattcatctaggaggaaaggacctttgtcttgtgcatgacagttggttggatctctgtgaaaatttttcagagctcctaagctttgaatttttagtcaagtgcttgcaacagctatttaaaaagacacaacctactaagcttgttctcctgataacatgtacttcagaactcatattcttgcagctggatttagatcccactctgaagtcagtacagagaagaggactgccacaaatgagaaagcttcatagtagcagagactatgtatccaataggcacaaattaattacagagaatggctaaaagactagaaggtttgtttttagaaatcatatctgatatttgattcacctttcaaaacacatagatcaacactgccattaaaaaaaccaatatactgaattaatacacataataagcaggttaatagggggttttttagggggttattcaccttagagaagtgttcttcgcttgaaataaaaaattccacagatttctgttaaacagtgagatgccctaataagttttaaaatatacaacagttcacacagtctctctagaacatattttatgtaaaatgaattacaccctctgccacctaattggattgcctaaacaatccgtatccttctgcagggttaaggtcagactaacacagtcttgggccagtcacacagtcttgaagacatatggcctatctctcttctttgtcacgagtctcaacaagctacttccatgtcaaaatgtatttgctgaccagtcttgcaggagagtgaggcgtttggatcatgtaatttttgtatcacgacaaaaataacccatcttagcctctggaagggatgtattgtatttgtttgttctcattctttaacttctagcttatttcagtgtgttttataaaacattgttttggaagaatggagagcctgggtaatccattgtatgacattgctttagagaaatatatgaaaatccagaacaattcagtatagaggactaaatgaactccagggctgaaatatggtcatatctgagtcctagctctgttttcagcagtccattggttgacaggttcctgaatagttttcttatttttgtttgtgaagaactaaggagaaaaagcaacactgtgttgacatattttgtggggccaacataaggtaaattaaaatatctatgaaatatctaggaatatagaaagtcttggtaaagaattcagtgtaaccatatgaggcaaaatagtcccaatgtgcatactcttaattccaatttgcatttctttagaaatcgttgctaattaacctgtgtatttttaagtcattttgtggcatggtatttcatgaagcccttttatttaagcactgcatttctttagtgctatggcttggattactgcagccatttcagcctattgcagacagaaatgaaaaatgaaaggaggcaaaacagttctctgagaaccaagcttgaaggagagtgctgaacacaaagtgtaattcatgtacagtcctaatttttgatagaatttatattcttccatgttaataaaacacatatagccaggccttttttttgtaaattgattccatagtgaaaaagaatcttgaaaagtggatttatttatttggccttgatttctgggcccgtattatcagaagcaatcccacatttcatgtttatggagctttacaatattcagagcttctttcaccctagatcatctcattgcatcctcatacaacaaccagtaagatcagcagaactggtagatttttttcaccattttacaaaaatcggtctaatagaatttaattgaaacacttaactatttgcagacaaaaagaccaggagtatgaggttcttgcctatgtcaggattattaggaatttctttatttttgcttaagtattgttttgcttttgttattctctattcttttcctccttttctccctccctccctccctgcttccctccctcaccctctcccccttttctctatacctcccctccttcccctttctctcatcctttccagttttgaaattgaatttacctctaggccactttcctcctttgatcgcctactttttctgctctcacaggcaagtttctgacttgcctgtatctactttaaaatagtcctctattcattggaaaatgtagtgccacatttaacccttttttggatttacacaagggagcttccaaagtttcttcatatattctatttttaatttatttgtttcactaggtatgtattgataatttactgtatgccagcccttatgttaggagctgccctcaagtatctaatagtccagcagatatttgagtgagcaatccatattctgtttatcgtgaattaataattttgcttagctacagtgcactgggtgagtattgattccctcttccccagtctctcccttcccatgctttgatctcagtaataatgaaattcattcacatcaaatataccctggaagagaacatcaaagccctaaatataataattagtcctggattttgaaatcactggtggaggggaagcctgtatagagaatataggtagttacattgtcacccctatgggcatgatttatgttttaagattctgttgtttcaagttttttaacagagttgaaaatctaattttaatctgcatattaatttcattaggctggggaataattgatgtacacaagtcaaacctgcttaaataacctaacttttaatctggaaaattaattatcatcggaacatggctcagaattagaagagtgacccttgctattggcagtaattgttcaattaattggaatgatcaggctactgaaaatgtgactggaagagaggagaagaagagagaggtgggaatatagaaggaaaaggtagattagttaaaataggtttataaaacctactgaaaagaggaaactgtgtttctaggttcattatgaaacattctttaaatgcctactcataatatctatcaactgtttttctttctgtgttctatggttcttgctttaaaaaatgttacatgtgaattaaacaaaatgtattgagacacattaatctataccaggatgtgtgcacttggcaacactgccatcacaggctttgttcgccaggctgaggacttagtgttcccattttatgtatggacaacttcagtaccctctgttgttctctccagatccaagggaatcagtgcagcccatgtaaaaaaaaaatatgtttttgagagaaatgtgttaaagggaaacatttacagtctgcatggcaatcctcaaagcctcccatcctgctgagatacggacacacatgaaacagtgccaccctatcagttgcactatagctgaaaatacaagagcagggtgaaaaaaaagtatgaaaaacctgttattaaggcctatgtttgccaaattacttatttgcatcaggaaggcatttagtcttggtgtgtatcttttggtattggagatgtgtttaagacgctgaaacaacataaatgttttacagatattttagctctcatcattttggtatggctactgaagatatagctacacaccatctgctgactgacatggtccttacttggctcaattcagggaagccatcatcacagcccactcgtctattaacctggctccagctccgggaggccaaagagatactacactctgtccatactttgccctcggtgccaggggcaagccaggccactattgcttcttctgactgtaacagagaataacaatttatattgctcccaagcctttgttcgggggaaaaaacgttttctggcacacctttgggtcttgcggttatttccatatattcaacataactggttgcactaatgcattctttacttgcctctctaaagtctgtgtggaggtcttaatatgccctgagaagggcagctgatcattaacatctgtggctgtaacaattccccaatatgttatacagatgtggtgtttagggttcaaatgttttattcttgtcagtgatatttcaacctccaaagaattatttcctccttaataatgtgagtacattggtaaaaaggagtattagattttgctcctggatccacctactctctgaatgtagattcctcattccttatccaaaatattatcattatactataatgatactaactgataagaattttttttttttattgagatggagtctcgctatgtcacccaggctggagtgcggtggtgcagtctcggctcactgcagcctctgcctcccaggttcaagtgattctcctgcctcagcctcctgagtagctgggactacaggtgcccaccaccatgcccggctaatttttttttgtatttttggtagagacagggtttcactgtgttagccaggatgctcttgatctcctgacctcaggatccgcctgcctcagcctcccaaagtgctgggattacaggcatgagccaccatgaatttcttaaataaaaggttcagtattcactgagaagaaccaaacattgaactgcaagagaaatagacatgattatacagaggaaagatattagagacagattgattatttcattaactaaaaagttgttatttttctgaaaaaacatagatatgccaaacatacatttcttttaagagaaatcaacacataaaaggtcagaagacttaaagcatcttttattttgtactcatgtcaagtaatttctcagtaactatgcagggaatgcatgacatctttttaactcattcatgcattaacgacaatagcagacatttatccagtgcctgttaaatccagaacacagtgattgctgcctttatttagtgcctctcatgtgtcaagagcgctatggtaccttcttccagggcactagtgagcatcttccagatcagtcaaagtaggttggttccttggcatacatctacttagtctcctctgaacagggatttcgtgggttgggacaaatccaatttctattattcatatgaatcactgcagagacataggggtgaaactgtatccttttggtggacctgcctgtgttgggtgacatgctcacatttttccacatttgataaaaatcaagcctcttctgcctactcaacactggataaaatgacagtgtcatacacagagaacagaacactcctttggttgcttcagcattctttttttggcctcatttttctccctctttactgagtttttgagtccaaatttagtggtgatgactaagaaattgccaggatgtgacagagcattcagttcattgagtccttccttgccatttttcaatagttgtaacaattgccaagattttctcctgatgttataggtgccacgttataggtgccagatactaaattacacttgcagaatctgtccatgcagtgacagcctcattttacatacagctgatttcatgatatggtattaaggaaaatccctgcagactttttactagttgataattctgagtcctagaatttccaatatttaaatctgaatctctgaaattcaaatcacataaacaataatcaagcggtctgccatgtgctaacgtgtcatttttgttgggggaaggtagattggggaaaaaataagacaagttccctaccatctggagctaatcatacagttgtatgagtcacagggccatgctagagatgtagatagagtttatgggagcacagataacaggtgtaatcagttctgattgggagagattatatgtgattctggaaacagtcatatttgagctaggccttggagggttagaggaaagccagtaggtagagaaacaaaggaatgacattctaagcaaaggaaatgaatggcatcagtaaagcgcaaaggcacacatggttctgtggtgaatgacactggaagatgacgctggaaggcatggtagtgactgaattgtggagaatttttaaatgttacatcaagttgtttgttgtttttactataggcaaggtgaaatcatcaaaatttcccaaggaagggaactttgctttaggaaagcaaacctgccagctgaagagaagaaaccagttaggatgttatgacagcagtccagtgaagaggtaataaggcgcaaagtagagcagtggcattgggaatggaaggtgaaggtcatggatcacggactagagggcacaggaatgaaatgaaaggccctctgaagtgttaagtgagcaactgccaggatggtggattccagttactaagacagggaacacaggaaaagtagaggaagtgtggccctgtgcttcaaatattattcttccctgttttctgtattgaaaagctcggctaaaatgataccctctctgtgaatccctccctagtccctcagtcagaattaagtctggctttttctgttttcatacagcacctcctgtaagcctccctttctttccttatggtagcacacattgtatctatgacatttgtgtacatgcttgatacctacaaatatatgataagctgtctgaagccacatattacttacctatgaatatttagcaccgatcaactacataatggatccttagaaaatgtgtattaaatgaatgtatgaatgctgctatcacacaagacattaaatgcagcccatttttgggacctgacttagaatatgcaatgatcccatctcaccattctggagtcagccatacattgtttatgtggctatttggtatcatttgccttgatcatatgcatttttcaccagatatattttcaaaatggtttgattctttatgaaaggaaaatccattctccaatgatgacttttttccgtacagtgatttaattcccaaagaatttcagcaacgttctatgtacttgtcctcatcactaaaggaaatgtggagacttctagtcaaatttcttggtactttcttggctttctctatgttgagaaatcctacaaagaggagttttcacagcccataaatagaacattttggttcctaacatgtgacagttgccttagaagtacattgcttcttgagtaggttgaatttgtgtgaatcctctgaacatctatcgagtgtgcccctaggctgaaataaccccaaaagatacttcagttcgtgcattctgggagccagattgggaagatggggggagattaggcagattactgtgtgaaacactgtttgtagaatcccagaaaaaaggaaaggaaattgcttgagtgcttaaatttcagagaaaagctgccttgcctgaggaatatatccctctttgctgaagtgactgagagggcttcagatgttgctgctcagctagtgtgtattgcttaaaatggtatccaatatgaaaaataaaggaaggtagaaccatggagacattgtttttaaaagactagtgccccagaaagcttgcaatatttgtttgtatacatgtttttggtgatagtaccaagtgtttttcctgataacatctcagcaaattagcaaaaatctgatagtttaattggtgcctctatgacatgtagctcacttagcattttcctaataatcttccactccaagtaggccctttgctactctatggattacttatacattcaaatctactattcatttcatttagcttagaaattatcatttttaatggctgtttattgtacacatagacacgtgtacactcaaacacacaaaaggttttttgttgttgttggtttttttgtttgtttgtttgtttccttgaaatggtctattgagggcaggagcccttcatttgaaaaatccagtctaaagtaaaaatggccaaatgcatgacagaaaaccatattcctgagttcaaagtccactgggctgctctatcgtgtctgctagtaaaattgctgtaaattccttgcttttgtattgatttgcatgtaaatgttactgtaaggcaaggatggggtgaggggggaatttttctttctgtctcaagtcaaggtccaatgatccaaaaaaaatcaatttggtttacctaaaagtaaaaggtaggctttctttgtagcattcttttagaaatataggcagaaagcattgtaacacagatttcagcctgaggcaattgacaaccatagtgtataataactcaagaatccatgaaaattaagtacaaggaccgaatgtttattttctcatattgaaccctgaagggaacaaagctccatgtgtcagttttatgcttgtcttttcaatccttggctcttgtagttgtccaatatatttcacttatgtggcttgttctaatgttcccattacctattacaaagagagctaatcattgatcaatagcactttcacttatgactttttctaaagcatcatgtgaaatgttatatgtagtctgatggtttccaatgatgatagtttatgctattaaaatagagcaccagtcacacgagcttttacaaagtatgtcttaatctcctaaaaggcaataccacatgattctacaggaaattcatagctataaacactgaacttttgtttatttacttttgttgcaggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaaggtacatttgatattgtgggaactatggattatgctactaaatatacttatttatttattaaatttcaatagttttgggggtacaggtggtttttggttacatagacaagctatttagtggtgatttctgaaattttggtgcactcatcacccaagcagtatacactgtacccagtatgtagtgttttatccctcaccccactctcaaccttccccccaaccaagttcccaaagtccattatatcatgcttatgctttatgtcttcatagcttagctcccacttaagtgagaacatacaatatttggctttccattcctgagttacctcacttcgaataatggcgtccagctccatccaagttgctgcaaaagatatcatatcatttctttttatggctgagtagtattccatggtgtatatatataccacatttttttatccactcgttgattgatgggcacttaagttggttccatattttggccattgtgaattgcgctgctataaacatacctgtgcagttgtgtttttcatatgatgacttattttcctttcagtagctagccaggagtgagattgctggatccaatgctacttttagttctttaaggattctccatactgttttccatagtggttgtactgatttacattctcgccagcagtgtaaaagtgttccctttcaccacatccatgccaacatctgttgttttttgacattttaattatagccattcttgcagcagtaaggtggtatctcattgtggttttaatttgcatttccctgatgattagtgatgttgaacatttagaaatagtaatttaaagcagtccttaataatacttttgaaaatgaaacagttgttccacattaagacatttatttaaaaaacttacattttgtaacactcaaaaacatttgctctcctgattttaatttttccatagtgcatgtacatatagtgacactttacttatgtggaagtaacttacatgctaactcaggacagccaagatccccaaattatgctaaaatgttgcctgggcagaaacataggtgttaaaaatgtgtatacacagccgggcacggtggctcacgcctgtaatcccagcactttggggaggccgaggcgggcggatcacgaggtccggagaatggcgtgaacctgggaggcggagcttacagcgagctgagatcgtgccactggactccagcctgggcggcagagtgagactccgtttcaaaaaacaaaagaaaaaaaaaatgtgtgtacacttaacacttaccagaaagctccttgggtcctctctaagggcccaacatattatttcagcaaattttgcttatagttttcccatcattattagcagattaatagcaaattagaaagggtgagggacaagaataggctatggaagatagggaggtaagaaatagtgagatatggtagagaagagacagaaaatgcgggcaaagcagaggaagacttcaaagagattactagcctgaggtaagagtaggggtttagagtagaggcagacactgtgcaattcgaataagcacagcactgtgttttacagcacattttttggagccagactacctaaattcaaggcccaacttcactttttgctaactggatggtcttgaacaggttatttacctgtgtatgcctcaagttcatctgtataatatggataagagtacttataagattctcatagggactaaatgggataatgcatgcaaagaacttagagtagtatctaatgttatgtgttccataactataagctattatgtttatttatagcacaataataaattttaccatttactgtaccaagaattatccaatacttagactcttgaagtgtttcattttaaagtatgatagaaatcagtgttttaaaatattttaaattttaatatttgccttgtacagtatgctatagatcatatttaaacttctaagaggtttattaaatgcattttttattaatcctctcttacataaccatatgtggttgaagttaggcattaaaattctttacacactactacaccaaggctagatttttgcttaatctgaacctgtccactctctactgagtccttgaaagcagtgtttttcatgtctggcttaaggcacagaagcctagtaaccaaaagaaaagttgaggaccagtgtggtaggcccatttttttaatgtattttttttctctttttccttttctgaatttaatttataattgacacaaaaattgtatatatttattatgaacaaggtattttgaaatatgtatacattgtggaatagctaaatcaagctaattaacatatgcattacctcacatacttatcatttaggtgtgtggaatagaacacctacaaactattcttagaaattttcacaattggtatgcccatttgaaggccttttacaccatctttgtgtgcttttcagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttgtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattc
